United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 47

SEQ ID NO: 745 - DNA, 210091 bp, Homo sapiens
tcaggtatatagcatttataggcatttcaaaatagtcactttgaaatgttgagcagattcatgatagattttcaaggctttgaattatttacattttaaaaagtttatcagatattgcaatgttaaagataaattatttgaacttctagtaggtagtaatggtgtcagagaatgacaggtaattaagtcatacagtacatcttgtgtccacatttcatgcaatttttgcagaatgctgtactatgtaaactgctactgcaaaaaaaaaaaaaaaagcaattattgcactgaattttccataaaatccctccaagtaaatcttatcacccctttgcagatgagcatcttgtctttgggaagatgcaatagaaaaggaacttgccatagaaagcagtagtaagacttcttatatgagactaagattttcatttcattagctctctccttcaccttgtttattaattctacaagcatttattgccatctcctatgtgccaagcactggtccaggctctggggatacactatgaacaaaatacagtgaagtccctgccccatggagcttacattctagtagggggagacagacaaacacataaatacaaaatatcagagggttcaaaacagcttagaggtatcttgcctgaattctgtttactgcatatcctcattcttgggcaatgataaagtgaagagagaggccaacaatgggctgcagcaatgttgctagtcccagctctaccatctacacattgagtggatttaagtgagttctcatctgatctgagcctcagtttcctcatctataaaatggggagaaattggattaaattacttataagggaaagggtcctttcaggcttttttcatgagagtagggtgctgaaaatcaagagccagtttgttgactcctctaaggtttaaaaaatatttaaatataaaatctaagaaatccttagagatcccatacactcaatacttcaaatgccaatctgaacttctttcatcaatagcaaattcttatttacaatggctatagaatgaagtcattttaccatctttagccatatgaaaaataagttatttacttataaaaacattcatttttattattggttacaaaatctcaccttatttgtgaaatgttccctagctatgagatcctgcccttgatgtgacactatttctctcttctgctaacccctatccctgactttgtgctcctgtttaatttttccaactgaagtattagctttatgaaaacagggatcggctgcttgcttctttgaagaacaacccaaatgagagtatgtccaggtaatccatagacatgtataatcattacacctgcattttgttttacaggtacaggccttttggtaacccacattagctctttagactgtcagagttgttcagcttagtaaaatttagtttatcaaagggtactctaacatccgaaaaggaaaaacacgtttccagactaattcacagactagggcattgtaacttcactggaagccctggtgagaggcgttaatacatatttaataatgtaagtgaagtagcacatattttataatcaattaatttttctcaaagaagataatgtagcagaagacctgaatgtcaaacaaggttagactcatacttactaacttggtaggagttacgatgcctctgattctcttgaaagacaaactgtattcactagtttgattttgaaatgtagagatcaaatttcaatcaacccagcagctaaggatgacaggaaattttacaggactagaaggaatcatcttctcttatctggatctgatcctcctcgacaccttgggggtttccgaaggctgtgtgctctcagttttagctggttgttacgtaatcaaatatcccatgcatgtttttacatttgatcaggtgggcctaatcacaaggactcatgttgtcagtgcctttgggagcaaaatgaaataaatctctgtctcaatattggaatttattccttcctgttgcttagtggtgtcaagatacagtgtcaatgttaccagaagtgcctaacacagtctactgtgtaggctaaagtctgccgtgttcgtacagtgactgaaaaggaataatgactatatcctcatttgggtgaatgttactacttcaggaccagatgagcaggggcatcccatgtaaccatgaagaatcttgaagcagcattacaacatctaataataaacaatctctcaaacagtgcctgtatgaactgcaagatgagggcaggtccagctagacattggctgcataaatgaagatcagagaagaataaggagattcagacaacttttggcaacctagatcacagttactggtaaattcttgttacaaaggaaatggattttggtatacggaatttgaatatgtgttttactcaacagagtacatgctaccaacaagaatgcagccccctttttacaagttaggcagaaggaattataaagtcttgctgatgtttacagtccttacatcaatgtgactgcagccctccccagtcattccaaaaggtccttgggttggatacgagaatgcgtcaggcctggctttggctatgacatccccaggaagtcactgtgtgcagtgtggtctccagggtggaagtctttgagctgccaatgaatatctcttaagtccaaacctccatgggcactatggcctctttggtcccaacagaaggcagtaggctttcttcagacaagaaataaaaggggaattgcaccaaaaatccacggatcttcttcagttcctcctcagctcgaatgggatcttccttagctaatacgggcttgtttataaagtctctcagctgaattaaattgtgtacttcatcattgggaaggcaccggaaaacctgattagagcataaatagaaaaatgagtgaaaagtttaaaagcgagcacatggcctttatggaaaataattattccaacagacaagacctctgttgtatgaaacatattattagtcttatgttacagcacagacctgatttaagagttggttatcttataaccaacaatagatagatctgctacaaacagatagatctgcttccatttaaaaaatcatggttagtggcaagaaattacactaatgttaccccacattaaggttaattttttttggataataatcatccctgaatttcactggagcttctggtctaagaggaatattgcatattatattttccctaacttttcttgaaagaggctcatatctgtacctttacatagcattatcaattgttaatatgtaacacttactttgctggttgaaaatgagttttggatatcataacacttcacccctgaatacttctctgcaggtatgtcttaagaataaggacatgtgcctatataatcacagcactattctcacacctaagaaaattaattatataatgtcatttaagttatgcttcatattcagatttatcctgttatccccaaaatgtcttttatagatgttttcccccaaatccaggacccaaataaggctgtgcactgcatttgtaaaattacattttaatgactctatgcacatgacctatttgatcatggccttcggtccatgaaataaggatgaaataaggttatacaggggtcaggcgcattgggtcatgcctgtaatcctagcactttgagaggccaaggcaggcggatcacttgaggtcaggagttcaagaccagcctgtatcataatacaaaaattagctgggtgtgctggtgggcacctgtaggcccagctactcgggaggctgaggcaggggaatcacttgaacccaggaggtagaaattgcagtgagccgagatcatgccactgcactccagcctgggcaacagggtgagactccatgtcaattaaaaaaaaaaaaaaaaggaaagaaagaaaagaaacaaggttatacagacagtagacatgtttcattaagaataataagtttctctgctggaaggggctctaagagaaaaattgcgtattttccctaatttttttttttaaagaggttcacgtctgtccctggaagtcatgaagaagaacacagacttatccaacttctcacagatggtcaattagtctgggctagaacacagcttgaatagttttccctgatgggcaactagctacttttcgaagtaagctgttctactgttacgcaactcttaactcttttacattctttattataaccaaaggatagacttcacaggcaatgcatttggtatgcatcaaatggagccggttttaaaacacctttctaaaactagagctgtccaacaaatgacatgtcttgttattaatattaacaagattcatcataaggatgaatactgtttactatacactatgtgctaaaaccattcactagactattctttgtcctcataactacccttgtgaatattcctcccaatttataggagaggaaaaagaaactcagaaagttaagtcactatacacaaggttataacaccagcaacggggtgagctaggctggactcagctgtggcttgtttttttatgccatctgcccctcttctctttgtcactagacatgtacaaaggctgggtaaccaggtgctaaggatgctgctgatgggattcctgcatcacaggagagactggaatgctgctaaagcctcttctaaaccaaaatccacaatgctttttgcctttgtttttcagggtccacaaagaggtattttattacaacctggacatgtattagcttttttacgtttattaagaataccctgtaccaataatatgcagaaataacaatatgctttttgtgatgagattcagtgaaaagaaacggaggaggggaatacgtgaacttcaccttgtcataaattgtagcatttcgagctgctgttgaaacccacacctccttgaagaatttgtcactcactggatcctgaatgtcctcacttgggtcatcaagatagccaaggacaaccctgaaatacaagtgacctccacattgagtaactgagataaagcagtttgttgcaggatatatgtctattatatctatctctatatatgcaaatatatatatgcaaattatttgagagaccatgacctagctactctcatatcctcagagtgcctgacataaaagaaactattgtctgaattgaccacacataaacagcggactagacataacaaaaaattctcaagcaaacaagacaagttttagaagtgatatttgaaaattataataacccttgtacttagagaaggctttaggattaaaaagcacttccaccttaatcctgtgtggtaggcgggacagatgattctcattctgtagataggaaactaaagtctcgaggcacactagtaatggagttagaactcaaactgagggcaaagcccttttcccacatacttgataggctgaaataataccaagaagacctgtgctatttggaaagagcaataggaaaattggccttgtaaggctttggtttttatattaagtgaaatggagagtgtagacatcagtgcagaggagtgacagaatctgacttacatattaaaatacggctgctgtattgagaacacactctggggggcaagggttgaaacagggagcccatttaggagctactcccataatccaggtgaggtatgatggtggcttgggcctgggtggcagtggagatgaagatagagccaacaggttttactgatagagtgaatgtagggtgtgtcaaaaagtgaggcatcaaagatgactacaaggtttttgtcttgagcaactataataatgtacagctgtagtcgcctttagctgagatagggaattctgtgggtagagctggtttgtgggagatcaggaattcgattttgagcctgttgagacatctattaaagatgcaagtggcagtgctgagtaggcagtagataaatggaactggggtttgggagagaaggcttgtttagagatataaatctgagaattgtcctcatgcacatgctcataggctgaatgtttttttctgagttcaccaaataagtgagtatagacagagaagaggaccgggtgtatatcaacagtaagggagaggaggaggaaccagcgaggctggagaaaagccagaggatgtggaatcctgaaaccacacaaagaagtatgtcaaggagaactgtccaattcagataagaattgaccaccggctttaacaactggacatcattatattgttaccctccttgtatttaaataaatgtagatttgcatcatcattttaatggctgcagagtttcctatcacgtgaaatttattgaaccaattatttcattatggacttttgggtaatttccaatttttcattattataaacagtgttacaatgaacacagtttattcatcatatgtgattttgtacatttctgtgattatttcataagaagaaattttagaattagaattcctgggtcagagaatattcaaattactgcaagaaaggctgtaccaaaacatacactattaagcatgaatattttcccagttttctccaacattatcaactcacgaaaaagttcaagtctgtagatattaaaggacactcattttagttttagtctgcactttttccactgtataaaaatttttttaaaatggatctggcaccataggctttctaggattcttgacttttataacctcaaagttctgtttccacttcaaataatgtgcctccttcagactacacgagaataactttttttaaaaaaagatttaagagatgtttgcacatagacattggctgctaattgagacccaaagcacaattttactgcatcaaatgtgaatgacagtacaaatgatgacagtaagtcaattattataatacctttgatttgggccagatttaagaagctgaaaattgagcagaaagagtttttctgtaactttgcttttaaattagagcaagagataagccaatgtgtccaccaaactatcaggtaagggcttgtttgtagaaaaagtatttaaataagtctaaaataggcaatatattattttccctggcagtattttaattataagaaatttatattaaatgcagagtaaaaataatatgaagtactctggatgttcttttgaggactaaagtttgagagaaaactagtttaattttatgttgatgtatttaatgaaaattatttaatatttgcttattcatcaaaaaaagtgggacagtaggaaaaccacaaaaaattatttctgttctttccgttcctcatatctatcactttaaatgattctgagtcctaattgtgtggacaatggtttctcttgagtgatggttatatctgcaaagtttggataattttctaggacttgaactgttcagcttatagctgtgaaatttagtgcatgtttgattctgtctctatttagaattgatttcacattgaaataagtctctctatttctattttaaaataggccagatggaaaatggagtgaaactgcattttttaagtgaaaaaaatggttgtagtctaggccacaatatttatctttgggaatgtttcctaataaaaagaggctaaaattgacgcaatgtttttgtggtgcttttaaatatattatctgtgtttgccattggggcaaagtgaaaataattattgaagaacaactgcctctttaacacaatttgaaaaatgcgaagtaaaagaaagcacctagaaacaaagttagcataagatcagcattaaaaaaatgaattatttactgtagaataatcttcctccccaccaataataaaaacccaaagctttattgaagaacaataaaatattcatataaattgaagtccataccttgttcttcaacaagatgactcaatattataaaggtgtcagttcttttcttcatctataaatccgctataattccaattttataaaactagtaagaacttgagagaacgtgagtaaacaattctaaagtccatgtggaagaattaatgtttatgaataaccaagattattttgaaaaagaatactaatttgaagaagtggtatggcaaaaagtagtcttaaaatgcacagccacaataattacatggtatcacactggcatgcaagtaaacagactttcaatatggcataacagagagactagcgagaagccagaacagatagtgattcagtgtatcttaaaggtggactgcagataagagaggcgaagagtcctactacgtatcgtaaggttccagatcatctggttagttgagaaaaagagtcaggaccccgacctcacttcttacactaaaatacactgcagatgttaattgtaaaaagtaaaaccaaacaagcaccaggagaagacacaagtaaatgtttaatcttaggctgaggaagctattctaagcatacagaaaaaggcaggtggggaaaaaaaagaaaaaaacagattgatttgattaataagaattgaaaaatttcccccaaattctccaaagatgactaaaagccaacaggcaaacaaaatttgcaacacatatgacaaaggaataagcatcctacacatatttaaaatacttataaatcattaaaagaaagttaaacaacaaccccattaaaaagtgggcaaaagacaatggaaaagacatttttgaaaagaagacacacaagcagccaacaaacataaaaaaatgctgaacatcattaattatcagataaatgcaaattaaaaccacacaagataccatttcacaccaatcagaatgactattattaaaaagtcaaaaaacaacagctgttggtgaggatgtggagaaaagggaatgcatatacactgttggtgataacagaaattagtataacctctataggagacagtatggacacttctcaaagagctaaatatagaactatcattcaatacaacaatcccacaactgggtatctacctaagttgtcctaaaaatgacacctgcacttgtatgtttatcacagcactattcacaatagcacagtgttggaatcaacctaaatgtcctgagcagacaattacataaagaaaacacacacacacacacacacacacacacacacacacacacacacacaccagagaaaactactcagccataaataagaatgaaatcatgtattttgtagcaacatgcatggagttggaagccattatcctaaatgaaataacagaaagttaaatactgcgtgttctcacttataagtgggagcaaaacagtacatacacatggatgtacagagtggaataactgacgttggagactccaaaaggtgggtgggtagaggtggagtgaaggatgagaaatcacctaatgggtacaatgtacactatttgggtgacagttacactaaaagcccagacttcacccctacacaatgtatccaggtaacaaaactgtacctgtactccttaattgtataaaaataataaaaaaagaaagttaaaccttccatcgtaatgggcaaaggatacaaataaactaggcaatttatgaaaaaaattatacatggctaataaacatatttttaattctaaaaaatgtgaattaaaatggtgaaattccatgtgaaatctaacaaattggtgaagattaaataaactcagtcaagatagaaggaataagccctctaaaatattgccagtgatataataagagatcaaaggagacaataaagaaggtgaacaagaaggtatctacaaacatacccatttttttatatcagcaaaaatatctgccaaacaatgagggattaaaggaattatggcatacacatacaataaaatataatgtagccattaacatattgtagaagaatactcgatgacatggaaaatgtgtgtaacattgtttaaataataaaaaacatgtaggcctgcaaaattctaattttgttttaaaaagggaatacaatatattaatatctatgtatagaaaaaagtggaatgacatataccaaatgttaaaactgttatcacaaggtgatggtattacagatgaatttaattttcttactggttttctgtatttgccaaatttgtacataaaaatgtgctgtaatcaaaaacctctaccttctataattattacacatttaaaaagttataaagaaactcatgactttaaagagaattcttaagttcttacggaactgaaaagatataacatacattccagcttacaaaaggaagtatttgtcttttatgtatgccgcagtaggcaatcaatgggttaattagcagggtaccaatttttaaattctcctctgctaaacaaaacaaattaccattagaagctaattgaattatcaatggtttgaaaatcttcttactggcaaatcaagtagtaacaaaggcaataaatacagcaataaaagttgttagaaggtattgatagattttgagggatggattttttgagctacttagacagagacagcagaatgtctctacaactgaggcttatgttggtcttggaagccgaagtctggattggtaggaatgagcgaagtggcctctgcctttgccgggagttaagtgctcactaagcgcccatctgcaagtgagccagtttccaaaagggaccatttaacacaaagaaaacaacaggctgcagcgcagtgcccttcccgaaagggcataacgcactgatcttaactatatcggggccacctgctgcatcccactatacagtcctcaccaaaattgcattatggcaaatatagttctagaatcataaaactgtggacttcctacaaaggcctagagttgggagagtagtcagggtgttccacagccggtggggaaatgagtgtctgcagggagcaagggaaacagtgaaaggagacgagattatattacttgttccttgtgagataagaagccattggacagtagtgagcagagaagcaacatgatctagaaggttctagagggaccactgtgttgagaaaacacaacaggggacgtggacagttacagcgcagcccttgaaagttctaaataacactttattgaatggacttatttaggatcgcacagctgaaacgagcccagcttcctagcccagtattctctctgcttcaccacagattagtttaaaatttgcatcttcttgccaaagatcagggatcttcgacacctggagtcattttagacctgaaaacagaagtttccacatttaaattttacaccagcagtcactggcataccccttcaataatttttattatatccttgtattactggaattaatttgattttaaaaacttaaatggaagctggagggtttgacctggtctagtcctaattcagttaaggactagtatttaattggctcacgtctgtaatcccagtgctttgagaggccaaggcaggaggatcacttaaagccaggagtttgagaccagcctgggcagcacagcgagacacggtatctacaaaaaatttttaaaaattagctgggtgtggtgacacgggcctgtagtcccagctactcggaatgctgagccaggaggattgcttgagcctaggaattcaaggatgcaatgagctgtaactgcaccactgcagttttttctactgcacgtgacagtaataaaaagctattaaaataaaaaatattcatgtaccacctaaagtcatttcgcatactactggtggtacatatcctatattctgggacacactgttttagatgaagaagaacctaggatgacccatgtgctcagggctagcggggctgggtcccagcgactgctgcagtggaaatgcatcagagagacacactttggcggactgacctaaagcactgtagccgaagtcctcgggcaaaccggccagcttggtactcttttccatccattactgaaggaacagtctctgtatcttgcacaatgacagccatttcactgtcacgctttcccagcatgctgcggtcatttatgttggcagagcctgtaaggagaaacagtgaggctgaacaaccttcctgttgtggcagacactgttggttgccctcccaactcaattcatccttgcaaacaaaaccgtaattttgtccaggttttcaagggaagatgtgtttttagggaggtggggccctccctaacccaggggtgaatcttaatcagtctaagccagccatggtaatttcattatttttattagtgactggcttagaaatgggctcttgacatggtgctagccaatgtgacatgaaggaaagcttctgagaaagagtttcccctttgtataaacacacaaaaaatggattctgtctcttccatcctttggatatcttggcttgaagggttggaagaagacatgattccaggagctgctgcagccatttcacaaccactagagaacaaacaaaaaagcttaaagaaaatgctaagtagaaaaaagagccaggcatggtggctcatgtctgtaatcccagtgctttgagaggccaaggcaggaggatcgcttaaagccaggagtttgagaccagcctggacaacatagcgagacctggtctctacaaaaagtttttaaaaattagctgagtgtggtgacgcatgcctgtagtcccagctgctcggaatgctgaggcaggaggatcgcctgagcctaggatttcaaatttgcagtgggctgtaactgcaccactgcacttcagcctgggccaaagagcaagacttcatctctaaacaaaacataaaaataacaattaaaaaagaagaaagattctgggtctttaagtcattgaattagccaacctttgaatattcttaccttctgtcatgtgaaataatatattttccttattttctacattgttccttattgtttcacacacacttctagttgagttttctaccttgtggcacaaaagattctaactgttacaatcatcaagcacttgaaaaaaggcatgcctaccagttcagtaggaaagatggctttgcttttggagttaagaatcaggctctctgtaggctttaactcaaagtcacataactgtgaatgtcaaaactcaagagtaccttcataattaatagagtataatctcaaatacagattgtcatttgtggctttgggctttctgctttcttgcctccctcacttgtgtagcatgccaatagcttctgtagcaactttcctccattctattttttaaaattattaattctctttattagctcaatacctggttcattcaaggagtccatttttttttttaaatccaagtgagctgagaatgttgacttttacatgtgaagggcaaatattttgctattagttcaacctgtgctttctgcagtcctctgctgtgtattcaggaacctcatcacgtttttttgcattaatctctgcagattcatgcatttgaatccttgaggtgtcctgcaaactacagaaagggcctgactgactcttcttgttcctcttgctctagctgcaacaactccactgcttcttcagacgtggagcagaagggtcaggttgaacaggcaccctggcggccctctgactggagcagccagagctataaggtgacagcagccctaccagagctcaaatggtgagatgaatgagaaaagctgccctttcctgaagagactttactgcctgttgccagaatattgtcatgtggttaatatataaatctatgatgactatggatgtgagtgtttccccatggtggccctgggtaacagagaaaggatcgagcaccctacagaaatgtgagaatgctactggagtgctgctgaaaagtgggaacctttgaaacactttgttttgttagcaccaaatcatcctttatacatagacttacatcgtggttatgctataaaatttgcagctatatctttgagcttgacagttgccccaacattaatttgggcaattcacttaatctttctcagctttaatataatctttcataaattgagataataatatagaccttgtagggatattgtgggaattaagtaagaccatgtgaaagcacttaatgatttacaagctgctctacaaatgttaattattactggcattattatcagatccttgttaactctacaataactgcaccggagaatgctgccataggaaccgaccatttgatggaatgtagcatttgtttaaagaagcctcctctctggcttaatcgccccatgtgtgaactgtaggagctcaaagattgaagatcccatattgctactttaggacttttactgtgcccctggagccagcagaggccgctgtcaggcgggggctgctggattgaactgacatcactgctttgtttcgggtcaggagaacctgggatgtgagccagcctggaaagccccctccgcacacacattctcccacgcgcccccattcctctcccaccacagtgggccccgacactcccgaggtgaggaatacatttccagcattctgagctggaattattagacagagggtgtcgttcttgtattttaagggccaacatggaattacccagataactgactctccaccacattaaataagtgtgttggctgctatttaataggcatgtgaggaaagaaatgagaaaattttagatgaatgaataaattagatataataagatatgatggatgtaaatgctccctccatttgttcctgtattctgaaaatcaaattcagaagaacagttgtagtattaccctatttttatacaacatatgaggaagaagacagaacaagagatctagaaagatacacactgaactgttaacaatagtaggtgcttttcagtgaagagagagaagaaaataaggggaattttggtcttttactctataagcatccttcttgtttatatgacctgttctgagtgctattagaaaacattctaaaaattgtgaatatggcaaaatacaaaaggctatatgaaaatatgtgtgtaaaacttaagcaataataaaatagtcatcactgaatttattaccctggccaaaaacaatattaccacatcccagaaggctttgtgcaccttcccatgcatacccttccctccccaagaggaagacttgatgtttaactttgtgttcatcatgctctgaatgttttcctaaacaacaaaaaaagagtttacttctgacttgtttttaatttatataagtggaatcatatatcagatagtcctttgagatttgcttctttcattcagtcttatgtctttgagatttttctgtacataattgtaatgcatttcttttccttgaatgaacacactagggatttctttatttattctgctattgatggatgtttgggttgcttccagagttttgctgtgatgcacaattctgctctacatagctgagtatttgtttcttggtatagacatgtgtgagtttcttaggctctgtatgtaggcgtgggttgctaagctgcagggtgtatgactttactaggtaacaccagaatgttttccaacttacactcccaacagcagtggaggggagtctgtattgctccacagccatgccaatacttagattgcccaacttttaactgtttgccagtctggtatttttaaaaactcttatttgtctcatgttaatgagaagcaacattttttcacatgcttatgaggcttgggtatgttctttttgatgaagttcctatacaatttctttgcccatttttctttggacatttgttttttcttattgatttataggagttctttatgtgttctgtgtattaaatgggttgcaaatatttcagtttgtggtttatctttttattctctttacagtaccttttaatgaagaaatttctgaattttaatgcagttggatttatctttcctttgtggtttgtgcttattttgtgtgtctcacttagaaattgtgaatccttgtgtggtatgcagaatagcagctctccaaaatgtccgtgttcaaatctccgaaaactgtgaatatatgttcaatggcaaaggcgaactaaggctgtatatggaattaaggttgctaatcagctaactttaaaaatagagtgagtagcctggattatacaggtggacccaatacaatcataagatctgtaaaagtgaaagggagtcagactgagttatgattacagaagaatgggttgagacttttggggattttcagagatagaatgttgctgactttaaaggtggaagaaggggctgtgagccaaggaatgcaggcagcctctagaaacaaggaaatggactctccctaacggcctctaaaagaatgcaacagccctgctcacactctgattttagtcctgtgggactcacgctgaatttctaacctactgaagtgtcagataataaatttgtgttgttttaagctactaagtttgtggtcatttgttacagcagtaatgggaaacgaacgcacgaactctaccccgttttagtttgttttgaaggaaaactggttcttctattgagcacactgggctactctgtcttttctgcctacttgtatttcctttgcctccaggtcagaagttctcagctctgaccacatatgagcattacctaggaaagctaacaaggaagctttttaaaaaatactgatgccaaaaacaaaaccaaaaaaacccaaatgcctggccccaaaccagaccaactagatcataatttctagaaataagaaccaggcattggtataccactccatccctgtatccattgttaatttatatttttgttttgatccatttaaaagcaaattgcagacatgaggaaatatccccctctttactggggcagcccttcaactccagcctctcatctgccacagtgaagcctgctctttaaatcctgagactcatgagctcgacttagtttctcctcctacccacacttgttgattgcccctgaaccttcttgttctggtttggcaacatccatcctagtgtttctgctctcatatggaaggagtagctgcctctcctccagccagtgatctctgggagggcagtggcgctgttttactcacgtttcgcatctctctattgtgctttgcagtgggttagtgaacattaaaaacaaccgtttcacttagtcatcaggataggcttaaaatctacttgaaggggagcttggctttgttttggaaaccaaatatatgtgtgtctggttaaaggctaaaattaagataggtaagaaaactggatttggtcacagatttcatgaccagcagggttacccagggccacaggcaattaaagctatgcacaaaagagatcttcagtgtgagaaaacaaatatttcctcatgaggagtaaaatgaagataaatggtcatttttcttatgtcagctattcaatcattctggcataagtttgccatggaagaaaaattaatcatacattacttaaacctcctttaaatgtttaaatacttccttaacacctataaaatattctcaacctaacttctcaaactcgtctctgagaattttaaacactgttttctgtgttaggaacttaaatagggtgaatgtgttagaacagtaacaataaacctgcttattcttgagtttccaccgagataaaaagaacaaaagaaactctggattttttccttgggagaaatcgattctctaaggcacttggggaaggaaaaaaggaatccagcctccaaggactagcaagtaagacctctttagactcccagggccatatcctcagtttcaagagaatgtgtaagaattgtgtgcaaaattgatcaagtattgctaaacaaaataaattggagtctttgagtgtttagagacttttccagaaaataagtcaattaaaaacctcaacaaatttatttaactgttagctctgttaccaaaaactaatttgtatttatacttcatgtaaagtaaacgaggctgaaagtcaaaatgacctttcaaaaaaatatttacatctgtcagtttttacttcaaggcttctgaaatcttggtgaagaaatatgtggctttgtttatttttccatttcagcaaacatcaatagtttttatttcttactgtcattgtcaaatttaattccaaagtattctgagatttgcttttgaagagcaagtcagagtagctcaggagaaataaatgaaatcttgagtattagggcaaatgggggaataaataaactcctaaagagcttttatccctataggccaggagataaaagaacagtattttttaaatgtgctatacaaatattaaaagtgtgtatgtgtgtgtgtgtgtgtgtgtgtgtgtgtgtgtgtgtatctcaccatactgtggtttacacagtttctggctatagacgaggagataaaggaacaatattattttaatgtgctatacaaatattaaaagtgtgtgtgcgtgtgtgtgtgtgtgtgtgtatgtatctcaccacactgtggtttacacagtttctggcttcagaactatgtttcttttctattcaaatcatgttccagataagacagttttattcttctcagatatgagatatgttttcttttctcagtggagaatagaaagcatatttattgtccaaaattttcaaaacactccatgacatttagtttcttgaataataggaaagtatcttattatagctgataaactacatttcatttgaaacagatgagcagaattcccattagtaggacacatcatctctctaaataacatgacccacactggttacctcatttacctggttgattatttatactctatcatcctggacttccaatactcattttatataatattaatattagaagtcaaaataattcaatgatggaagaatgaagctttctatgtatataaaagaatgaagctgaacatctacctctcttgtcaagctaatctaatttgggtagaatgtacaagttatttaggagagtaactctcctgaatttgtcagtgggaagaggcctttggaaaagtctcctgtgtatccttgacaagaaatgactgcagaccttagtgcagggctacatcctatcattagtacacaattcccacttcatccatacacatcaacaaagttggactgctctacatcctaattaatgacatggaaaacatgcatgttaggaaaaatagtggtaatgcatagaggcagcaatattttaccatccttctgatttcgacttttgtacaacttcagatctgtggtaatggttaggtggatgtggtataaacacatacgaattaccacaaggtactcacttatgacacactttccctccccatttatcccccaccaatccctgaaatctgggcacttggattgtaaataaaaataaggggatagctgggtgtggtggctcgggcctgtaatcccagcacacgggagactgaggtagaagaatcatttgagaccagcctgggaaacacagcgagacccccatctcaaaaatagttttaaaaattaaaaaaaaaagggagtaataaagaattagtgaaatctggcacattattggactgctgggttaaacagctgcctctggattctgcaattttcacgaagtccatttaattgctctgtacctctgattcttcacagataaaaatagtttagttcacaaagagatgataaatgcttgaagtgataggtactgcaattgccctgatgtgattgttatacattgtatgactgtatcaaaacatcgtatgtaccccatgaatatatacacctattctgtacctataacaatttcaacaactgggttagaaaggatgtaagagaagaggatggcttcagaaatgttttagttatggtgttactgtctgtttcaaatgcaaaggatgcttaggaggaatagcagcaaacatttttgcatggggtaagtcaactggcaaggaatacaattatagaccatatactgtacttaccaataataacagtgttatcatcagcaattaacaacttgctgtggacatagataagctcagttactaggtttccttcgagctctgcatgtgttctaagaccacagaatgatatgtaatttatccactgattaccaactgcaaatttaaaaagaaattattaaaattaatatgaccaagctcaataaacgtacattaaatcttattgtttctcaaaacatactacttagactgttcagaatagattgtatattatatgtatatgttttctatttcagaattcatccaggatttatttttgatatctgaatttcatattgtcagtctgaatggctttctctctctctctctctctctctctatatatatatatatatatatatatattatatatattttttttttaattgaagtgttttctgtcttccctttgctaaggcaatccaaaaagctattcatatatgaacattttattttaatgatttgatgagttaactactgaagagtgatggttaaaactgagctggaatagattaaccaagacttcagtgtgacatttgcttctatcctgcttgacacttgctgcagtttgaatcagatgcaaggtgtgtgccaaaccacctgatgctacatcatttgtagcatattcagcgtgaagcatcagttaaattctgcagactttgggtaaataaaaatgttggcaatgaaaaaccactcctccctttagatcattaaaattaggaaacagaagaatccttactacattagacttagaattttcttcagagcaagcagcaccaggtttgtacttcaaaatattgccatccctctaatcacatgggggccattcacatgataagaagaaatacattccatactaagccaagtcataatcatgacccctgttgtgagtgttagtcacaggatttttatggtctttctcccacacagcagttgtcttggataagcaagtctgataccaagaataaatggagtggaaccaaactatcacaaattctcatagaaagagagcatacatttttttttgtctttaagagaatttgaagcatactaatagaagggtggcagttcatctcccatttactgaagtttccatttattactgatggtttctattttgctactgatgttattcagtgtttctattaagtttgggtatcttggaaagaaattcattcataggttatgtatagagatgcctccatttagagatagctctcccctcatatatatatgagtgatgttgtatagctgtgtttgatgagagttgaaatgttggtatactagtacaccatgtgtaagagatgcatttctaaaacgtttcatgtaaatgaggtttttgcaatttattcccccatttgttaatgttatattggaaagacacttcatctgaagaatcacctccttttttaagtcttttctgatccatttccttttttaagcccctcagacctataaaattcctggaaaacatttctaaataatgcctagtatcttacaaacatttatataatcttcaagttattctactgttgtacaggaactgggtcttacacatttttgtttctcatcctttcacagtgctaaaaaaagctaaataaatgtatgagtggataaatgaatattcaggtatcagctgaaactaaaaaatattttaccttttaatttctctgtatcatctactctcctacagctggatcatgatctagaatttataagtttaagatacaaagcagcttttcaaaggaatcatggagcaggacctttgctaaagtaaatatttttttacagtaatttccattaaaattcacattgaacaatatagtagaccagtggttctcagcatgcacaaagaccacctctatggaatttgttaaaagcagattcctgtgactcttcacagaattctgattcagcggaaatcaattcagtaagtccccgaggggatattgtttctgaatgacactgccatagagctttgataattatttaagattagtatacactaagaaaataatacaccatgaccaagtgagatgcattccaggatgcaagtctgctcatatgaggaaatccattattagacattatattgatcaatctagggagaaaaataatataattattttaacagatgctggaaagcttttgacacaattcagtatccactcctgataaaagcaatgaagaaagtaggaaatgatgaatactttcttaacatgctgaaaatatatataatatatgtattatatatttatatgcatatgtgggtataatattttcaatactatttaatattgccttggaagtatcagccaatatagttgtataagagaaatcatataaaaagtaaagtcatcttcacttgcagatactgtgaaaacatacctgaagaatcagtaataaaattatatcaaataataaaaatattaaatataataacaggatataaattaacatatagaaatcaatagcctttatatacacaaaacaataaccacttagagaatataatcacagacaaagcctcatttagaatgacaacaaagaaaataaaagagataaacttaatggttcacgtgcaaaacttttataaagaaaaagttaaaaaactatcaagacacaagagtagacttgaacaaatggaaagattgctcttgttctgggatagaacaattcaccattagaaatatgtcaactcttcccaggttaatttataaatttaatgtgatctcattacattacatgagatcgcattaatgtaatgtaatataaggtaatgtaatggtaaaaatgccaacaagttctcatggagttagataacctgtagtttgtatggaaaaataaacatgcaagaataaattgagaaaaatggaagagaaaagctatgagtcattagccctatcagactttttttttttttttttttgagatggagtctcgctctgtcacccaggctggagtgcagtggcgtgatctcgactcactgcaagctccgcctcccgggttcacgccattctcctgcttcagcctcccaagtagctgggactacaggcgcccaccaccacgccttgctaattttttttttttttgcatttttaatagagacagggtttcaccatgttagccaggatggtctcgacctcctgacctcgtgatccgcccacctcggcctcccaaagtgctgggattacaggcatgagccaccgtgccaggccagccctatcagatattaacacatactataaagtctgtataattaaaacagtgcagatctagcagataaatagacagatacaccagtgaatgggatagaaagtccaaaaagagatgcaaatacataaggaaaatttgtatatgataaaggaaacagctcaaatgataaggacaaggccttttcaataaaaaggtgctagtacagttccatagccacctgaaaaagataaaactccaaattttttttaacaagaataaactccaaatggatcagagataaaaatgtaagcaaatgaaaccagacaagtgttagaagaaagcaagggtgaattcctctatacttcaaatgtaagaaagattttgtaagtatccagaggcaaaaaaaaaaaaaaaaagatttgtaaattggttagattaaaaaaataacaacacgtttgcatgacacaaaacacgacaagcaaaaaacaaaaggcagaagacaaactgggagaaagtattttcagtacatgtcacagataaagaggtgataatcctaacatataaagaactctaaataattgaagggaaaagaaaatcaaaatcttaatagaaaaatgggcaaaacacatgaatagacaattcacacacacaaaagatacatttgaaaagatatccatcttgactcataattataggaatgcaaataaaaatgacgttgagaaaccatttgttatctataagattggcaaaaaataaaaagtacgacaacatattctgttagtgagaatgggttgaagacagactctctcatatattggtgatgaaaatgcaaattcatacaaattttttgaagggtcatttagcaatatctaacaaagctacctatgtgtttacctcctgactcagcaatcccactctagaaatttatgctaaatatataccttcaacaaataagaatatatgtatatatattaatatatacacagttacccattgtatgtagttccgttagaagcatataatggttgttgaagacaatctaattgcccattcataacacagtgattgaataaacgcaaatccacatatggaagactatgcagtgttacgagaaatgaagatctctgtgaattaatagggagtgatttccaggatattctgttaaatggaaaaggcaaggtgaacaagagaatatgcagtatatttttttgtgaaagagatcaggagaaataagaaaatatacaactatctgagcatttttccaagaagaaacacaacaagattaacctagaaactgatgaaattggttaccaataggggatggataagtacagggtgaaaaagatggttggggtagaaactgaaagtatagaggaatggcatttatttaaatatgttttttgtatagttctggctattggaagcatagttcatgcattcaaaaaaataatcaagagagatttaaaaaaaaaacaaaaccctgagagttccccttcctagtcaaagaaaggggtgacagatggcacctggaaaatcgggtcactcccaccctaatactgcgcttttccaacaggcttaaaaaatggcgcaccaggagattatatcccgcacatggcttggaggctcccacgcccacggagtctcgctgattgctagcacagcagtctgagatcaaactgcaaggtggcagcgaggctgggggaggggcgcctgccattgcccaggcttgcttaggtaaacaaagcagccaggaagcttgaactgggtggagcccaccacagctcaaggaggcctgcctgcctctgtaggccccacctctgggggcagggcacagacaaacaaaaagacagcagtaacctctgcagacttaaatgtccctgtctgatagctttgaagagagcagtggttctcccagcacgcagctggagatctgagaacgggcagactgcctcaagtgggtccctgacccctgatccctgagaagctaactgggaggcacccccccgtaggtgcagactgacacctcacacggccgggtactcctctgagacaaaacttccagagaaatgttcagacagcagtattcgcggttcacaaaaatccactgttctgcagccaccgctgctggtacccaggcaaacagggtctggagtggacctctagcaaactccaacagaactgcagctgagagtcctgtctgttagaaggaaaactaacaaacagaaaggacatccacaccaaaaacccatctgtacatcaccatcatcaaagaccaaaagtacataaaaccacaaagatggggaaaaaacagagcagaaaaaccggaaactctaaaaagcagagcgcctctcctcctccaaaggaatgcagctcctcaccagcaacggaacaaagctggacggagaatgactttgacgagttgagagaagaagacttcagacgatcaaactactccgagctacaggaggaaattcaaaccaaaggcaaagaagttgaaaactttgaaaaaaattcagacgaatgtataactggaataaccaatacagagaagtgcttaaaggagctgacggagctgaaagccaaggctcgagaactacatgaagaacgcagaagcctcaagagccgatgcgatcaactggaagaaagggtatcagtgatggaagacaaaatgaatgaaatgaagcgagaagggaagtttagagaaaaaagaataaaaagaaacaaacaaagcctccaagaaatatgggactatgtgaaaagaccaaatctacgtctgattagtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaaggcacataattgtcagattcagcaaagttgaaatgaaggaaaaaatgttaagggcagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggaaaaataaaatactttacagacaagcaaatgctgagacattttgtcacctccaggcctgccctaaaagagctcctgaaggaagcactaaacatggataggaacagctggtaccagccactgcaaaatcatgccaatgccaaattataaagaccactgaggctaggaagtaactacatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggaggcaggaagatctaccaagcaaatggaaaacaaaaaaaaggcaggggttgcaatcctagtctctgataaaacagactgtaaactaacaaagatcaaaagagacaaagaaggccattacataatggtaaagggatcaattcaacaagaagagctaactatcctaaatatatatgcacccaatacaggagcacccagattcataaagcaagtcctgagtgacctgcaaagagacttagactcccacacaataataatgggagactttaacaccccctgtcaacattagacagatcaacgagatagaaagttaacaaggatacccaggaattgaactcagctctgcaccaagcggacctaatagacatctacagaactctccaccccaaatcaacagaatatacattttttttcagcatcacaccacacctattccaaaattgaccacatagttggaagtaaagctctcctcagcaaatgtaaaagataagaaattataacaaactatctctcagaccatagtgcaatcaaagtagaactcaggattaagaaactcactcaaaactgctcaactacatggaaactgaacaacctgctcctgaatgactactgggtacataacgaaatgaaggcagaaataaaaatgttctttgaaaccaatgagaacaaagacacaacataccagaatctctgggacacattcaaagcagtgtgtagagggaaatttatagcactaaatgcccacaagagaaagcaggaaagatccaaaattgataccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaagaaaagagagaagaattaaatagacgcaataaaaaatgataaaggggatatcaccatcgatcccacagaaatacaaactaacatcagagaatactacaaacaccgctacgcaaataaactagaaaatctagaagaaatggataaattcctcaacatatacacccttcgaagactaaaccaggaagaagttgaatctctgaacagaccaataagaggctctgaaattgtggcaataatcaatagtttaccaaccaaaaagagtccaggaccagatggattcacagccgaatactaccagaggtataaggaggaactggtaccattccttctgaaactattccaatcaatagaaaaagagggaatcctccctaactcattttatgaggccagcatcatcctgataccaaagccgggcagagacacaaccaaaaaagagaattttagaacaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacgtgattatctcaatagatgcagaaaaggcctttgacaaaattcaacaactcttcttgctaaaaactctcaataaattaggtattgatgggacatatctcaaaataaaaagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagaaacccaaatcatgagtgaactcccattcacaattgcttcaaagagaataaaatacctaggaatccaacttacaagggacgtgaaggacctcttcaaggagaactacaaaccactgctcaatgaaataaaagaggatacaaagaaatggaagaatattccatgctcatgggtaggaagaatcaatatcatgaaaatggccatactgcacaaggtaatttatagattcaatgccatccccatcaagctaccaatgactttcttcacagaattggaaaaaactactttaaagttcacatggaaccaaaaaagagcccgcattgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctattcaataaatggtgctgggaaaactggctagccatatggagaaagctgaaactggatcccttctttacaccttatacaaaaattaattcaagatggattaaagacttaaacgttagacctaaaaccataaaaaccctagaagaaaacctaggcattaccattcaggacataggtatgggcaaggacttcatgtctaaaacaccaaaagcaatagcaacaaaagccaaaattgacaaattggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggctatcagagaaatgcaaatcaaaaacacaatgagataccatctcacaccacttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcaccattctcagtaaactatcgcaagaacaaaaaaccaaacaccacatattctcactcataggtgggaactgaacaatgagaacacacggacacaggaaggggaacatcacactctggggactgttgtggggtggggggaggggggagggatagccgtgggagatatacctaatgctaaatgacgagttaatgggtgcagcacaccagcatggcacatgtatacatatgtaactaacctgcacattgtgcacatgtaccctaaaacttaaagtataataataatgaaataaaataaaataaaggctgaataattaaaaaaaactctgaaatgtaatataaaccaaagtaaatgaaccaaacctaatgaagttaataacataatccaagcaaatcaagttaacaatgtaatcaaactacttttgattacagacatttgagtgtatacccttaggctaaaggcaaaacactataagcaagtgttaaactctagtaagtagattcatttttcatggtggtatgggccagcaatcccaaacctattttctgtgtattaaaaggttgaggatatacataaatatgctgcggataatgggagccgtgtttctcactgtgaaagaaaggagctataaacataaaaagagggatagctagaaggaatcctatgctgtgggattggaattggagatatccacatgacaagaaagagagagaataggtttgtgtgtgtgtacaaaggcccaaagtagtgatattctagtagcaatgatcacatctagcacccagattttgctttataaataccatttttcgctaaaataacctaggttccttgaagaaatggctgattgcagggctagtgttgggaatatatgagtctgggacaccttgttgtgccagtaaaagaagatgattagcggggacatgtccaaaaatcatcaagccacctttaaaaggccctcattggccaaatctgggcaagctgaactccaagatcttaactcactaaataagagaagcagctgtaagtccatactaatataaatacataaatggggaaaaagggaaaactttccttacagtagaattccaactaattaatttaaaagaaactaataaatatagaaaaaaatgatggaatcacaaagtcagcatttggtaactatcatgataattgattcacagaataattaacgcatgctaaaaccaggaggtcaatggttgataagaagcaggatacttatatacacctaaagtgttttcctacaaaatactattaattatgaagggaaaaatagtggagaattctggcagacaccaccttcactaagtgatcaaagttaatataaccagtaaggttgttcctgctatgttaccgtaagaacacaacctcacttctgtgatactgctccaaaaaagcataagctaaatctaatcatgagaaaataatggacatacccaaattgagggacagtctatagagcaactggcctgtactattcaaaaacatcaagatcatgaaagctctgccaccccccaaaatcaaaatgattgaaagataatttcagattaaaggaaaataaagacatgtgacaatgtcacaaattattgtgagctgaattctagcctaggaaaaagccttttttcctcttttgctatgaagtacattcctaagacaactggcaatatttcaataaggtctataaactggataatagtattatatcaatgttcatttattttgatatttgaactatacttgattaagagaatgtccttgttttctcagaaaccacatacatatttagggggaaattggtatcatggctgcaacttattccaaaatgactcagggtaaaaaaaaaaatccctacatctatatatgaatgtatctttctattgagagagaatgataaagcaaagaaagtaaaattattataacatctgtgaaattaggatgaaggatatatggcagtcctggaagctgttctataaatttgagattatttcaaaattaatttttttaagattaatgatactgactagcttttagcagcttgaaggtttaggacatgtcatattcgtaattttctaaagcacatctatgtgccatgccaaagcaggcctacagagtatcagcaaaacatcaattagtaagacatcctgtcagcccacagtccatacctacttcccactcatccttgactatgcaataactcttacgaagtaattaaatctttatttctttgtgaaaaatggccttgggaagagacctaacagttggttccagtaacatgatctaaaagaaagataatggttcctagccagaaagtagacattttggacaaatgcgagtgtggcctgtcaaatgctatggggacacccatttatgatgtgaataaattcaccatgaactctatacggaaagaagaaaaaacaaatagagaaaatatttcagccagtactttattctgtgaaaaaaactgccttgacatgtaataggtacaaaggttggtgatgttaatttatgttatgaggatatactagagaaacatatgctttttgaagaaaatatgagcaagccaggagcatacataagcattaatgtgaagaaatagatgaacaagtataagaaagagtcccaaattacataatgccatggaggtatctgagaacctggagatttattcagatcccaggacatacctgttgtgaacattggtgtgtgcatcacacaccggggcctgttgcggggatgggaggctaggggagggatagcattaggaaaaatctctaatgtaagtgatgggttgatgggtgcagcaaaccaccatggcatgtgtatacctatgtaacaaaactgcacgttctgcacatgtaccccagaacttaaagtataattaaaaaaagaagagaaattcaatacaatagactcaatatttataaggaaatttcgtgaaaggacatcaagaattgttacaggctttcgttccttgtagcacttagtatatgtacgtatctaatcctgattgaaaacttctggcccttatcttaaattatactaaattggctgctaaaataccaaaattaacaaaaattataaaaacaacaaagaaatgctttaaattaaacattaaatctctgaagactggtatatcagataattatatactaatagctgctggttttcttttcaggaattttaacatattcatagcagcagttttgttattctaaataattaaaacagtagagaactatatttctctatccaattagagattagctagttcatgtatttaaaaccactacatatacaaaaacaaagccaacaatacaaccttgtactttagaaacaggcattatgtaattaatctttgctctctgtctagcatatgaacattttccccactgagatgccttattttgactgttcccaaggtacttggaaatcttttcataaacaggcttagcattgaaattaattcttgtgttaaaaaccaatttgcacccttgaataggcaaaggcaagaaaagggtccagagccaaaggaaatactttataataagctcaggacatttttactgttgagaaactcaataataagctgttttgccctatatcctcacctgcgcatttttacaagccactgccagcgctgaatgattttcccgattttattttatcgatatatcttttataaatttactaattcactatcatcttcattttaggccattagaaaatagagacagagataatactctggcaaatctctgtcctagatacaatgagatgcaacttttggaagtattcattattggtgatgtacatatcttttgtctaaagttgcttacaaaagttttgtaggttgagcagaccatcagtgaaaaattactgaacacacaacaccaatatatgtacatatgcctattttgaaattatatacatgtactaaaaacttgtcactattttaacttgtcaatattttaaatttgtatttaaagtttccaaatcatttaaaaattcttacaatttataaattttatactacaaaattctcgtctttaaagtgtacaaatcagtatgttttataagtagtacattcacaaggccgtacaaccatcaccaccacctaattttaagacatttttatcactcccccaaaaaaaccccacactcattaacagttacaccccattccactctcctctacaccctattattctaccaactggctctatggatttgcctattgaagacattttataaaaatgaaaccagacaatatgtggccttttgtgcctggcttctttcacttagtgtaaggtcttcgaggttcatctgtgatgtagtatatgtcagttcatgcctttttacatctaaataatactccactgtatggatacaccccattttgtttatacattcatcagttaatggacattgggttgtttccactttttggctattctgaataatgctgctataaacattcatgtacagatttttgtgtggacatttgtttttaatatttgggtaaatgttaaggagtagaactgctgggttataggctaactatatttaacttttgcagaaatgccaaactggctttccaaagaagcagtaccatttttcattcccaacagtaatgtgttagggttccactatttacacatccttgccaatactttattattattattattattatggccatcctagtgaatgtgaagctgtgaggttgtattgtgggtttgagttgaatttctagtgactagtgatattgagttttcttttatgtacttatcatccagttgaatatcttctttagaaaaatacctgtttagctgctttgcccattttttattttttgagttatttttatttttattactgaattgtaggaattctttacatattctgtacactagtaccttatacatatgatttgcaaatggttttctctcattctgtggggtgttttcacttccttgataatgttcattggagcacaaaggctttcaagctttcatgtttgatgaaatctaaattatctatttttatatgtttgcttgtgcttttggtgtaaaatccaagaagccattgtcacaatgatttatgcctattattttcttccgggaaatgtatagttttagtttttacatttaggcctttgatccatattgagtgaatttttgtatatggtatgaggtaggggttcaacttcttttttttttttttttttttttttttttttttgcaagtggatatctagtttttctagcaccatttgctgaaaagactattctttctccattgaattgttttggcaccaccttgctgaaatttaattgaccataatcataagaattatttttagattctcgactctattcagttgacctgtaagtctaactttatgtcagtagcacactattattgtgggtttactgcaagttttgaaatcacgtatgtgacacctccaatttgttcttattcaagattgttttggcaatgctaaatgccttgaaatttcacatgaactttcagattagcttgtcaattttttcaaaaaggtagttggggttttggtagggattgtgttgaatgtataggtaaatttggagagtactgccatcttaacaatgctaagtctttcaatccattaacacagagtatttatttatttatatcttccttaatctctttcaaggttttattattttcagcgtaggtatcttccactacctttattaaatttattcctaaatatttaattcttttgatgctattttaaatcgaattgttttcttaatttcattttcagtttactcattgctagagtataaaagtgaattgatttttgtatactcatcttgtatcttgaaacactgctagactaatttattatctgtaatagtatgtgtgaatttcttagaatttcctgcatacaagatcatgtcatctataaaaagaggtagttttactcttcctgttcctttccctttaaaaaatgtatatttttcttgctcaactgttgtggctaaaacctccagtacgatgttgacaaaagtgaactttctcatctcatcactgatcatagaggggaaagctttcagtctttcaccattaagtatgatgtcagcttatatgtgacatctacacataccatttacatggctgaggaagttcctgtgtattccaagtttgttgaggtttttttgttttgttttaattatgaaagtgtttgggattttgccaaataatttttctgtgtcaatgagatgattatgtgtggtttttgtcctttgttctattaacatgatgcattacactgactgattttcagatgttaaaaccaaccatgcattcctgggaaaaatcccatttggtcatgatgtataatcctttttatattgttggattcagtttagtagtatttcactgaggaattctgtggtacattcacaaggaatattgatctgattgatctgtggctttcttttcttttcttttgagacggagtctcactctgtcaccaggctggagtgcagtggtgcaatcttggctcactgcaacctcagcctcccgggttcaagcgattctcgtgcctcagcctcccgagtagctgggactacaggtgcatgccaccacgcccagctaatttttgcatttttagtagagatgggtttcaccatgttggccaggatggtctcgatctcttgacctcgtgatccacctgcctcagcctcccaaagtgctggaattacaggtgtgagccaccatgcctggtccttttcttttcttataatgaccttggtattggtatcaggataatactggactcttagaatgtgttgggaagtatagtaatacattgcttaatgagaatgtgagagaaatgtgtcattgggtgattttgtcattgtttgaacatcataaagtgtaattacacaaacctactacacaaatcatatagtctactacatacccaggctatatggtatagattattgctcctaggctacaaacctgtacagcatgatactatactgaatactgtaggcaagtgtaacttaatggcaagtatttgtgaatctaagcatagaaaaagcatggtaaaaacatggtataagagatcaaaaatgatacacttaaccagctgggcacggtggctcacgcctgtaatcccagcactttgggaggccgaggtgggtggatcacgaggtcaggagatagagaccatcctgactaacacagtgaaaccccatctccactaaaaaaatacaaaaaaaaattagccaggtgcggcgatgggcgcctgcagtcccagctactcgggaggctgaggcaggagaatggcatgaacctgggaggcggagcttgcagtgagccaagattgcgccactgcactccagcctgggcgacagagcgagactccgtctcaaaaaaaaaaaaaaaaaaaaaaagatacacttacatagagcacttaccatgaatgaagttgctctgggtgtgagtggtgaataaatgtgaaggtctaaactattactgtacactactgtggactttataaacactgcgcacttaggctacattaaatttttaaatttatttaaaaataaaataattgtaccatgccatgggtatgactgtgacatcatttggtgataggaatttttcagctccattataatcttacgggaccaccatcatgctgcaatctgttgttgactgaaatgtcattatgcaacacataactgtattcctttctcctatctatttttggggaaaagtatgtgaagaattggtgttaattctattgcggatggtagaactaattagcaaagccactgggccagggcttttctttgtgggaagattattgattgctaaattaatctctttacttgttattgctctatttagaatttcagctctttctagaagcagttttgggagtttgtgtctttaatacaataccattaatcgtatgtatcaatctgactgggccaagaggtgcccagtttaatattgtttctgagtgtgtctgtgaggggttttctggatgagattagcatttgaattcgtggattcactaaagtagattgccctccccaatgttgctgggcatcatctaatccattgagggccagaggagatcaagagacagatggaaaaagaattcatgccttttgattcttgcttttctgcttctgttggaatctcggtctgctcttacccttttactaccattaacaccattggctcctctgattctgaggccttcagacttggatgggaattacatagccagctttcctgggtatccagcttgcagattgtggaaattctcagcctccgtaattacttgagtcaattcctcataataaatcttttcatatatatatatgaaagatagatatataaatatataatatataatatacaattttatatattatttatatatagcacataaaatatatatctatacatatatttataatatataacatataagtaatatataaatatatcatatattatctatatataaatatatcatatattatctatatataaatattttcatataaataaaagatatatatgaatatatattatatagatggatatataaatatacatgtaaattatatatttatatataatttttaatttatattttatatattatataaaattatataaattagatataatatattcatttttaatagataaatattttatttaatacataataaataatatatattcatataatatatattatataaatatatattcatataatatatattatatataatatatattcatataatatatattcatataatatatattatatataatatatattctatataatatatattatatataatatatattcatataatatatattatatataatacctattcatataatatatattatataaatatataaacatatattcatacatatatctttcatatatatgaaaagatttattatgaggaattggctcaggtaattatggaggctgagaagttatatttacataatttctctctctctctctctctctctctctctatatatatatatatatctcctattggttctgtttcttgagggaaccctgactaatacaatgtctttaaaggaatttgtccatctatctgggctaatttgttggcatacaactgttcatagtattctacactccattttatttccgtaaagtcagtagtaatgtcccctcttagtttctgattttggtactttgaatcttctctatttgttacttagtcagtccacctaaagtttgtcaactttgttgatcttttcaaaaagctaacttttggtttcactaattttctctatttttttctattatctcatttatttcccctccaatctctgttatttattttattctgcttgctttaggtttagttttctcttctttttctactttcctaaaatgtaaggttaggttattgatttgagatttcttattttctattaaataatataaatgtttatagttataaatttccctgtaagcattgctatagctgcctctcataagtttggatatgctgttttcattttcattcatctcaaaatattttctactctcctttgaagtatcttctttgattctttggttatttagaagtatattgtataatttccacctatctgtgaattcccaacatttccttttgttatttataatttcattccattgtggtcagagaacatactttatacaattccttaaatgcctgtaccaaatgagtttcttatactttactgaggggctctgtgtatgtgtgtgagggccacaggccttacatgctcaggcatgcagtttataactctgccttaggcttcactttctgcttccacagagcctcaaggtcagccagaggtgagagcttagggccttctcaatcctttcctgagcacgtgcattgccctgggccgttgcacacagccctacacagacccatgacctttcagattcccagggatatgttggaagtttctagtgcccactaggggatctccttcctcagcttatcctcttaagatttttagtcagcttcttgctcactcaactgttactgcctcttcagtcagctgtgatgctaaataaatgttgctgattgtttttgataaataccaggttttttaaaaagtctacttgcactgagcaaggtctgagtcaggtgaaataaatataagtacttagaatgggagtttaaagggaagtgccagacaggtcaaataatgacaatgtgagaactgtgggacatgggagccttaaccctgatctgctccctccaatggctgctaggctgctggttttcaccctgatttgagcagctgttggcttttaagattatcatggagctgagaagagggagatgggtatatggcaagttaaaatgccacaaagcttgctattcttaccaagattcagctgtttttcttgattaaacactccttggattgttacaagcctttagttaatttccccatccaaagaagttgattgtgacaacttttgtcagtatttttgttgcttttatgtaggactatatttttggagatccttcctctgccattcctgctgatgtcctaatttcttacttttaagctaaaaatatacagacttggaaagtctattattttctacccacattccagtacatcatccagtgcaccccatttgggaggctaccagtataaaataaaaacttccttcaaaatactcaattcaggtttatattctatctgaaggtcatatcatgaccttcacatgattaggatgagtccttctgccttttccagacctcctgcagcagctccattctcttggtccattggattgaaactcagaattagctgacacttcccttcctctcctgcttccacatcccctcaagtcatccctcataatcttacccacacatgatcctccttttccattaccagtgcacctttgtctcttgcttgccaccatctctaccctgtttaccaacagtaaatgaatcttcatataaacgtcagtttgatgaatttgctccaggggctcagagggtttccaccaacctcttcttgccttctggataaaacctagccttcttagtgtggctgtccacgttttcacaatctggacccaacttgaactagaagtcatacaacttgggttctgattccagcttagtttgtaatgatacacaaagatatagagcaaagatatagagcacagagatatagagcaatattgagtgcccactatatgctgaacccatagttcagggagctatagataggtaaacccctagttacaatatattgtagccaagaactaggtagaagaatcaattaagaacacatctgaggctgcacatggtggctcacacttgtaatcccagcactttgggaggctgtggcgggtggatcacctgaggtcaggagttctagacaggcctggccaacacggtgaaacctcgtctctactaaaaatacaaaaaaattagttgggcatggtggcgcacacctgtaatcccagctactcgggaggctgaggcaaaagaactgcttgaacccaggaggcggaggttgcagtgagctgggaccacaccattgcactccagcctgggcaacaagaatgaaacccagtctcaaaaaaaaaaaaaaaaaaaaaaaagacgtctgcgaaagtgtctttgaaaagtataaaaaattgtatccagtagataaagaagaacaaacaactataatacctcataaagatgattgttattattaaaacaactatatataaataaaaataaatagaaattacaaagatgctcggtttttattacctatttagtcttggtgtcttcatttgaataatggtttgggcaacttaatgagaataaatactttattacaggtgaacattttgtggggtaccttttataaacagagttctataatcacactgtgaaaacattaatgattactgatacctcaccttcataataaaaaacaatgatatgagaaaaaaagcagttacttacgctctgcttttaactgtccaaggatggaattttctcctctgcacatggttctgaaaatatgtaaaggagaaaataattacagaggtttcaaaacaaccaatcccatgcagtatctgtaggtttaatcctaacacaagtaaaaacagaacaagtgcttctatgagaagatgctacatatatatctaaatgctaaaaacagttacatgaatatcacttttgtaatgctactaatagggacatgatagttgttttgaggtaggtaaatggaaaagttataaaattcgtgttagatttcagaaagagaggctattaaaaaaagaagggtcatgaatgaactttccctcttacaaaactgggtaacagcaaagataaatttagaatgcatcagtagataagaatacttagagaatcacattgctctcagaggtgaaaagggcaagcacttagcagaataatttacaaattaaactattagaatggactgtctttaaattcagcaaaaccactaaaaacgaaaaatatagtctcaaataaaggactctgctaatgattttgtttcttaagactctgataatcactgatgaattataaaatctgacaaaaccaaaaattctatgcttcatctgcttgctctatgagagtaataaagagtatacttatgcctgagaaatgctattattaaagatgatgccagcaaatagagatgtttttgcataataaaaggttatagtttttgtttctgaacaaaagccaaatgtgttatttcattcagctggttcgaaggcaagaaaatagtcatagaaaacaattacaattaacaatattacaaaaataatattagaatggcgaatgaaattgataaaattcaattaaacattatgtcagagccttaaatacttgaaaagctttatcattttataaatcagataatattagaaatgtgcaaatcttcagtccaagtatataggccaaagcacagttaaagctctcttgtactgtaactaggcagaagcaccctggaggaaacaaacaaacaaaaatctttccttgaaatcctggcagataaacagatacaagcttgaaacatcagtaagaaaaaagaggattaaaaaaaaatttccactacaatggtgcactcgaactgtgcacagatcctccagcaggagcatctggcgagggggcccaagcaggagggcatctaagtctccacccccgatttgaccaaggccctgacccctaatctgctttacttaccaaaggttctatgtaaagtatcattcgtcctctcccacctttcagaagggtttgattagaaaggtgagaaactacaggtggttcagaaaaataagagattttggttaagtgaccctgagagaaggtcagaggtgcatttccatccccatctatgcaggctttctagcctgtgctcccccaacccaccagctagcactttccagcccttttcacaatgctccactggccaaatctgaagcctcaagaggaacccaagtgtgcccttttaaataaatataaaaactcagcttttaaaaatatcaagcacaaaactttccctaaaattttaacaaagatgtggtagagaaaacaaaattccgggaatttatttactaacagaggctatcattatcaaccttgttgaaggacttgctacctaaagaatcataaccaaacacaagcaaatcttaccatttcaggcatttaattttttctctatttactgcaaagtacatgtaaagctcaatagctatttacccacttaaagataagttttaatcaacattatacatatatagaaatagacagtaactatacaagaaggactaatattttagttcttttatgtttgccatgtgtcttaggccaatcatttatcattgtaggctccatttgaattttatcaactagcaaacgggccaagatttgaaagtaaaataaagtgttcatttgttccccactccaccgaatggatgtggagaaacactgccattcccttcatcagcttacatgatgcatgaccgaaagctcaaaatagaccatttagagttttggcacctgtagttgaagtgcatgattgcctgtagagcatttcctccgccggttgaaatgtctccttcgaaccctggcagaagtggtatcacgacatatacccggtatttctggttttccctgcaaaggtcagatgcagagaaattcacccaaaaaataaaaggtagtatcaattttagatgacagccaagcagttcacatggtttttgagattgagtgaatggcttcctacaacacgttctgtcacatttcaggacttgggagggtgtgctgttggactggaagacagaagctgtcatccaggctatcgcttcatagcctgaataacaagctaaacttggcagtaaagtagaaattgtacccattgtctctctacagcataatcgcttgtaggacaaaatgcagtgtaagaaatccttgcttggatcccatggaaagaggcgggtaggggaggctataacaaagttttggaaaaagaacttaatagttaacacagtacctagctagagccgtggaaatagtagacattcagttaataattgttgagtaaatcagttctcatagcctagatcgcaggggcaaaaagacacactggacccattacattttccaaaacagaagtcatcattatctacttagaaactctgagttttcagctgtaaaatgttaccctaggccctttaagaattctgagtggccggccgggcgtggtggctcatgtctgtaatcccagcactttgggagtccgtggcaggtggaccacgaggtcaagaaattgagaccatcctggctaacacggtgaaaccccgtctctactaaatatacaaaaaattagccgggcgtggtggcgggcgcctgtagtcccagctactcgggaggctgaggcaggagaatggcgtgaacccgggtggcggagcttgcagtcagcagagatcgcgctactgcactccagcctgggtgacagagcgagactccatctcaaaaaaaaaaaaaaaaaaaaaaagaattctgagtggccagtatgtatatttaagtcccctgcacatacaacacaatatttcatgtcccattctctcaagtgattaatgacaacctttgaaagaaaatgaattctactcaatgatataacaatagaagaagaaagtgtagctttctctctttgacgggcattcagaaaatcagaaatttgaagtatgctccaaataggtaccatttattcagaatcaaaagctattaacgttcttgtctctatttataggatatacagggagaagaaaaagcctcgaaaggaatgtgacatacactgtgatcaatgaatctcgctgggatatccgggaggactatattcacacaaaggtgttgtcattggttaattttcaagtccgatcctacttaaacttctcatttctaaagtgcattttcttctaaacaactaaatttttctttcatgtgaatattatcagtactctttgggggatcagattttattactgatgtctctaaagtcgatgtcagggcaagtggaaagagaagttcagggcagaaatgactaccaacaatgaaatttggaggcctgtgagtttggctgccatgctaagaaacaaggatcttgagtaggttgttgtaatggcatggattattcactagatggcaaacatagtttgagttggaaagaagacattaaaaaatgtaaactgttcaagtttgctgcttggtaagaataaaaggctcacatccctaaatggtgagcaggatagcgaaaaagaacagacaaaaaaaaaaaaaaagaaaagaaaacctaagctattaagctatttccccacagccaacatttaaaagtcaaaaaattaaactggacagttaaaaatggatgtcatttggcctcaactgccttttcagaattcaggattatactgccttacagtataatcctcccatcaccacagcccagtgacaggagactaccaccctttgttcagaggtacaccttcctactaataaagcttggctcatcagccttctgggcctccagtgaatcccacttcttctaggtcaccttattggctatttcctctgccaagccacttggctcttccagtcagagttgttttattcttgcctcggcactcatagcacatggccaggatgtctgttctgcactctttctgctttacacgatagtgatacacacatctgctctctaggctatgtgataagctcctttgaaacacaggatgcctgcccacatatctttctggttttggtagtacccaatcaaagacccttgcacatgctatgcactcggtattatttgctttaggaggatgggatcaggttggaaaaatgtttctggggaagtttctggtagagaagaggttaagctgaacaggaattttttcctttaaattaaattacattttgtttgtaaagtgtatataatatattacatacatttttttctttaaataaaattatattttatgtctttaaattaaattacattttattgtggtaaaatacatgtaatataaaatttgccattttacccttttttttttattttgagatagagtttcgctcttgttgcccaggctggagtgcaatggtgcgatctcggctcactgcaacctccgcctcccaggttcaagcaattctcctgcctcagcctcttgagtagctgggattacaggtgtgcaccaccacgcccaggtaattttgtacttttagtagagacggggtttctccatgttggtcaggctggtctcgaactcctgacctcaggtgatccgcctcggcctcccaaagtgctgggcttacaggagtgagccaccgcgcccagcccccatttttaagtgtacagttcagtggcatcaattacatatacaatgttgtacaactatcataatgatctattcccaaaccttttcaacatcccagacagaaactcggtgactatccagtcataactaccctgtttttccctgcctgcaccccttggaaacctctaatctgcttgtctctatgaatctgctggttctggattttgcatataattagaatcatacaatacttgtcctttatgtctgacttgtttcgcttagcataacatcttcaaggttcacccatgttgtagcatgcgtcagaattccctcctttttaagactgaataatattccatggtatgtacatatcacattcatctgttaatggacacttatgttgtttccaccttttggctattgtgaataatactgctataatactagcatacagtatctgtgagtccctgttttcagttctttggggtttatattcaggaatggaactgctgggtcatgtggtcattctatgtttagcattttgaggaactaccaaacaggttactttcaaatgagtaacatatgctcatagtacaaaatgtaagaggtagatgattatacagtgaaaaaaaatctctctcactccttcatcctgagggcaactcctgttaacagtttcctccatgttcttttagaaatagtgtaagaatttataagaatatatgtattttttccttctacacaaatattagaatactataaacacttttctgaacatgatttttatcatttaacagggtatcttggaaatccttccacataagaacatagttactttttttttttttttgagacccagtctcgctctgtcgcctaggctggagtgccgtggtgcgatctcggctcactgcaagctccacctcccaggttcatgccattctcctgcctcagcttcccgagtagctggcgctacaatcgtctgccaccacgcccggctaattttttgtatttttagcagagacggggtttcaccgtgttagccaggatggtctcgatatcctgacctcgtgatccacccgcctcggcctcccaaagtgctggtattacaggcgtgagccaccgcacctggccagaacatagttactttttaagaacagggaggtaatattctaccatgcatctatactttaatatttaaaccagttctttactgataggcatttaaattgcttctaattttttttctatttcaaagtaactattttgatatttacgctgactaacaaaagtaatttttcacatttgttggaaaaatcttacaagtggtattgctggtctttgacacaaatgtttgtgatgatgtttgtaagagacagttctattttatctttttttttaagcaaaaatgattttacaagggagatctcatatgtatgatattgagaaatgtcctataaaaatattataaaacattcttgcaaattttagtttgtaggaatcagaatattcacattttcttgtttttaggactctcttagctccataacaagccctttgctattttacaatatggtagctcataaatttcctgaatgatgaaaattttaaactgcgttcagcaaactagtggaaactatttagattttcactgctgtagaaaaaagggctctggaatttcaaacgcaaaattgtggttgaatgtaagccaaagcacagaagattccatgggacactgtgtccaatctgcctccttgatccaatccacagaggacaagagttccagctgctgaggaatccaacgtccttcggaaatactgaatcctcacaacatgggggttgtggaaatgatagcattcagcttagggtaagaatctgagcccctagtgtataaaatatttatgatcttaaaagcaatcttgcttttggggctagtgggcactaagccccggataactacccatcatgccagcaatcacttcatccacattagttcaaagcaatttctaccaaacagcattctcaggcttcttgttaaaagtttttcttcaaaattcactaactcttatggcagtgctacgtataatagctaaaaattggaaataaatgtccaataataaaggaatggttaaattatgttgagccagtcaatggaatgatcaccttgtagccactaaaaatgaccgctatgaaggctcagtagcacaatacttctggtactgtgttaaaatggccccaatgcaatgttataagagaataaaaatgtggcaggccaatgctataaaacattaaatcatttttccctttaaatgtgttaacttcccccactctgtgaccggagaaacgaagcaggcattgctcccggggtggcactctcacaagggaagcaggacacaaaaacatcaacttcttttagatttggggaactggagagattctctaagctgaggcaggagtgtagagaaataagagcaagactcagggcaaggaatcagtcctttggcctcaagctgagttcggggaaaaacaggatagaccccactctcttttcaatgtgaggatatgagagccaggaggatctgtgccttgctttcaggtgaactccagagaaatgtggagcatgtcgttcagcagctatgcgatgtggcaggagcagaggagaagtggtagagaggcaggcctgaaaggtgaaggctgacgtccccaagctacgttaagcagatgccagaacaggccggagggagatcaacatcagtgtctggaagcccctttccaaagatccagggccccatagcattaagatcaaggacgggatgtggagggagaggaggcaggagtagaaccctgatgctgaatatagaagggaaataatgagaaatcactgaatttggccacatttatcaggaagtgccaaaactaaaactaaaacccctcctattgtgtggaaatgcgcttgagctagaaattcagatgaactctaggaaaagaaaataaattacaattcaacagaaaatagtagtgtgtgtgtattagccaggcgtggtggcgggcgcctgtagtcccagctactcgggaggctgaggcaggagaatggcgtgaacccgggaggcggagcttggcagtgagccaaaatcgcggcactgcactccagcagcccgggcgacagagcgagaatccgtctcaaaaaaaaaaaaattaattttaaaatttttgtgattgctataaagctgtttgtacctttaaaagcagagtacgaatgtaccatgtagatgggtcacagcagtgatgtacctctactttccttttcttgtttttctctgctgcataagcccctcctccttcacccacagtccctcctcagcatgaaggacagttaggagaagcttgatctgctcacaactgggtctcagggtctggcaagaaggccccgaggaagcttgatatgcttcgctagtgacaagacactttatttttttgagaatttgagatttatagtttgtatttcattactgtaaacttcaagagctgctataaatcgtctcgttgtagattttgcagcagtgaatactgtcagaaataggaagaattgtggttagggcttagggtgtgtgtgtgtgtgtgtgtgtgtgtaaagagaattttatactatggtggtatcaattatgttggaattggatctgtagcttcttggtcgtttgggacataaccccttttattttgtgcttggcaaatcctttaaaaggagaagatccttctgggcttcagtttcctcatctgcacatgaaagaactggctaaaatcatgactagtccactagaaatgctggccctatttagcactgactttacctatcctctatgtgacttcatagattatgaactattatatattgtgcacaaacacacatcagttttctcattggttatcttttgaaaatggcaagctttcaaacataagaatgctgagggattccccagcatgtttgacttagacttcaccctgggcttgatagtctttggcaagcctagccctgagtggcccccaaatgaggttatatagaaccttatactaaactgttcccactatggcccagacggttttcattgtcatttttaagtctccttcttccttcctctcttttccagggcacatgctcaggctcaaaatgagtgctggcccctgccctgtgctaatctttacatttctctatctgctgaggttaccattttatacaatttttagaatagaataaaagcatttacatgacctaaatcaaaaggtctcctgccacgatctgttgtcatctgtgtcccaaggtaacctcttctccagaaatcgtacagagcttgggagttatcccacaagaaaaaatgtgaaaccaatgattggcatacttagataaaatgtgttttggccaggcgcggtggctcatgcctgtaatcccagcactttggcaggccaaggcgggcggaccacgaggtcagcagatcgagaccatcctggataacacagtgaaaccccgtctctactaaaaatacaaaaaaatagccaggcgtggtggcaggcacctgtagtcccagctactcgggaggctgaggcaggagaatggcgtgaacccaggaggtggagtttgcagtgagccaagatcgcgccactgcactccagcctcggcgacagagtgagactccttctcaaaaaaaaaaaaaaaaaaaggtactgcagttgaattttctttaagacaaggcttctgaaacaagcccaacatgtcttttcagtttggtacaaaattataggatatggtaattatggacatagatttttctttaaacccaagaacttttaatctatcaaacattgcttttaaaaaataaaacattcatctgattttttttttctttttgtgacagggtcttgctctgttacccaggctggagtgcagtggtgcaatcatggcgcactgcagccttcacctcccaggctaagagatcctcccacctcagcttcccggatggctgggaccacaggcatgtaccagcacactcagctatttttttttttttttttttttttttttttgtagagactaggtctcactatgttgcacagactggtcttgaactcctgaactcaagtgatcttcctgcctcggcctcccaaagtgctagaatcaaaggcataagccacagtgcccagctcattcaattttttatatttcaaaataaagtatttttcatagatttctgggaggcttaccattcgaaaatttctacatcccttgaaatgggggaagctttgtagcttactggtaaaaagcacaagttgaggtcctacagacatggtttgagtcctactcctatccaaccatagctgtatgacttggctaagttatctaatttcactaggcctcagctgcctcatctgtagaatgggagtaattacacaaccaatcccataaagttgatacaaagactgaatgaggtaacacaggtatagcactgattatgtggaaagactcagaaactatttggtaacatttttattcaattatatcaattgctgatttcaattagaaggcttgcatatcttcaaataacaacaaagtaaatagcatctaaaattaaaacaatactaaactaaacacatattatgcttcagaatacattttgttttactttatattttggggagagtgttatcagatcaataacagggaaatcaaaaattgattcccaggaagagtcagctataggtttctggcagcaaacctctagacagagtgttgtaatcgtgtgcctaaacaagtcacatgatgaacaacagccagtcgtgagaaaccaaaacaaatttttcttatccagaagtagccgtccaataatttaaaatacggaacatttaagcatcttttaaattaaaacatttctttttctagcataaatactaattttgaaacagctgatttgaatatgatgcctctttatccttgcttcaatttacagtgaacaacatatttccagatgatgaatatcatggaaatgctataataagttcttacatgaactggtgctttacagcttacaaactactttcacatatattcatataagctacgtagaacagataatattattcgtggttggtgaagaaacagcgtgtcagaaggacaaactgacgtactcagaaggtcacatacctgtggataacagagctggagagaatccaggtctccagacatctggtcccccaataatttcagatttcccagtgtggtatttcccataccacccacttacaggcaagcagtagctcttctacagttataagaagcatgaggggcactttgggaggccgaggtgggcggatcacttgaggttaggagttcaaagctagcctggccgacatggtgaaaccccgtctccaccaaaaatacaaaaaaattagctgagtgtggtggcgggtgcctgtaatcccagatactcgggaggctgaggcaggagaattgcttgaacccgggagatggaggttgcagtaagccaagatcacaccactgcacttcagcttgggtgacagagcaagactgtctcaaaaaaaaaaaaaaaaaaaagaacatggtaagtttgaacaatgttcaaaattgttgttttaatgtagtttaatagcatatttttaatgcagtttaatattaaaacatagaagcattaagtcaactgactattttcattgtgtgtgtcaactgtttgttgctaacactataaaatgcactttctcacttcctgactttctaccaaagcagaaaaattatgcatgtcaagtttccatgtgcaaagatctgagaatctcctcagaaaccattcattcatggcacacagtgtttaaaaatgtgtctacctggatcagttggtcctatcttttggcttagtcaaacatggcataaaacagtaaattttagactgtggattatgattttttttctctctgatcgccaatcacatttgagctgtcaaagaaaggtttcaagtgggttgggcagctggcttcaactctgagacagttttacttattagagtgaagatttgttttttgttttttttttattctgattcccccggctgttctgaggtcagcatggggtaaacatgagtctgaggctctaggtcatgtcagaacatgaaggctttgcaaaacttatttctataaagaattatggctgttgagaaggaaccagaggaagtgagaggaactgagaaattgcttaggggaattgttgtgaggctggattccaacgctggcagaaaaatacttagaccagtccagggagttggcaatttgaagactcagatttctccagggtaggagggacctggcagagggcctgtattctttggtgaggcctggctgactgcggactgtcatttccctccatctgctttgggctgcattctattctttttcaaatagccaaaattatacttgttgctaagaatgtgactttggcagggaagttctgagtctcagaaaagtagagaccagagaagtctatggagagagaggggtaagtttgggatggcacatcatggcacctaattagtgaaaaggggtcaccccagggtggcaacctgcaaaatatgttgtttctttcattttttatttatttatttttttagagatgaggcctcattctatctcctaagctggagtgtagtggtgagattatagttcactgcagcctcatactctcaggcttaaggaatcctcttgcctcagcctccaagtagctagaactacaggcacaccaaaacatctggataattttttatttttttgtaaagacaggtggtctcaaatttctagcctttagaaatcctcccgcctccgcctcccaaagtgctgggattacaggtgtgagccaccacacctgcccaagataagctttttaattctgcctttaccttgcctaacacaagctcacagaacacaagctcacagatttgaaattaagtgaaaatatattttacagttgcaattaacatagggagattaacaagaatgcagagacgccaggggtgaggggaacataaaatatgttttgagaatgtgtgtgtgtatccactgaaagtctaaatgtgtgacatatgtaccattttgaaaatgtgtctgtcaaaaaaatgagactattgagagatcagagctaaatgacacaggtttatttgaaatttgatgaactaatttcccatttttcacaaagcaaacttgaaattgccagtctttaatgtgctctgtcaaactccaagtgtaagatacaatctgcaacaggtgctactttaccataatttttaaagtcacagatcccttttcctttcaggagcagctcataagatcactaggaaatgttctatcagaaaatatcttgaagtttcttgtagccctaaaatactataattttatttatttatttatttatttatttattttgagacagagtcttggtctgtcacccaggctggagtgcaatggcatgatctcagctcactgcaatctccacctcctgggttcaagcagttctcctaccgcagccacctgaacagctgggactacagtcatgcaccaccaagcccagctaatttttgtactattagtagagacagagtttcaccacactggtcagactggtctcaaactcctgacctcaggtgatccacccgcctcagcctcccaaagtgctgggattacaggcgtgagccaccatgcccagcctaattttattattttagaagtccagatttttaaagacaaattactacagtaaagaaaaatattctttcaggcttccaaacacttaaaaacacatctttggaacagtataaaataccggggccaggccccgatccaggaaattatgatccagtaagcctggaggtgagtcaagctctctgtaatcttgcaaaagtcagtggtgattttgatgtgtagtcacaggtgagatccactgtacacactgcaggatatgatggatgctgtagtgtgctgcctagatcccctcaccatgggatcaagacatccatcccatcagctactgagcatgtaggccacggaatactcacagtgaagtcctccaggtatgaaaagtatggagtcctccataggtgaaagggacttgcctcactcaaggtcatccccactccctagggtcagcctgcatccaatggctggtcaataggggaagggaactacaggcccaacacatttgcctcagcttggggaagccctgaatgggtttttaatcctaaccatcaatgcactagagtcatgtggtgtgaggggaagcattgggttgaaagtccaaagatttaggctcaaagctgttttttgcctattgtggttagtggcctagacaagtcacataacctcttgaatctcagtttttaatcctaaaaatgggaacagcaacaacagcaataataacaacaataacaacaacaaatacatgacctactctcaagtgtagttgtgaagattcagtgagataatgtagttataaactgtgaatcacataaaatgctgatagttactgttataatatgtccttaagtataaaagtccccaaatattatgtgaaaaaagatatcaaagtaccacatgacactggaagtaaaaagtgttttaattcccaaatgcatatgcacttattcttcactgcgtgcattcaatgacttaaagtaatgaaatataatggttttgcttatgtgtttgttctgctacttttaaatggagctgaaatcagccataagaagaaattgtccctggtgccaagacaattcaatgtggaaagaatagtctttttaacaaatggtgctagggcaactctatatccatcaacaaaagaataaaaagttgggcccctaactcaccccatatataaaaagtaacaaaatgagtcaaatatctaaatgtaggagctaacactataaaattcccaggagaaaacaggcataaatcttcatgatcctagatcaggcagtgatttcttagatatcactatctatattccttagataccaaaaggacaagcgatacaaggaaaaaaatagataagttagcttttatcaaaataaaaaaaatttctgtttcaaatgacaccagcaagaaagtaaaaagacaagccatcgaatgggagaaactaggaatcatatatctgatatgagacttgtatctagaatgtataaagaattcttacaactcaaaaataaaaagtcaaataccccagtgaacaaatgggcaagggatttcagtagacatttctccatagataatacacaaatggccaataagcacacacaaagatgctcagtatcattagtcattagagaaattcaaatgaaaatcacaatgaaataccatttcttaaatggtatttcacacctactagaatgactataatcaaagagagagataataataagtattggcaaatacagagaaactggacctctcatatactatgggaatataaaatggcagagccgctttggaagacagtctggcagttcctcaaaatgttaaacatagagttagctataacctgacaattctacccctagagaaatgaaaatatatatctgcacaaaaactagtaaaggatgtttatagcagcattatttataataggcaaaaagtagaaacaacccaaatgtccatcaactaatgaatggataaatacaatgtggtatatccacatcatggaatattatctggcaataaaaagaaatgaaatactgatacatgctataataatagataagcttcaagaacattatgctaagacaaatcagtcataaaagaccccatattgtgtgactccatttatacaaaatgcccagattaggcaaatctatagaaaaagaaaaatcagtggtagccagaggctaaaaatagaaggaatgggtaatgactgctaatggggtttctttctgagtggatgaaaatgttctaaaattgattaggtggtggttgtgcaactctgtgaatacactaaaaatcactgaattgtatagtttaagtggctggattatacagtatgtaaattctatctcagcaaaccaattattaaaaaaaaaatcccatgagctgaataaatatgacatacggtaacaagaatttaaatataacccatagcaaaatattatgtctgttttgcttttttaagcgaacacagctcatagtctgctattaaataaaacaaatcacaaacctcatgtgtgggaaacagactggccaggaagaaatttttgtgccttggaagaattcaaattccctagaaagggcagtcaaaaatctttagcaactgactcagactaaaggcatcaataacctattgctggctgaaccaaatttaagctgctaggaaatgacagtactttaaaaatgggctttgcaaagtcattttagtaataaatacaagaacatctgcagcgagaactctcagccaaaggctgttacctgtgagctttcaggatcctctgggcaatggcatcgcctatcttgttgaacacaactttgtcatcagcacagcttatgaaaaactggttctatgagaaataaacaagacaatcatgttagtctttattttcttagcaatatacgtaagaacaatactgtaatatattttttaaaatgtttcacacagcagatgtgttctgatcactgaaatcacatcaagaaagtcaacgacacagaaaaaaagccgcctcatctcactcagggtctcatctgattccaggtcatatcacctgtaacacttaatcaagtggaaagttacactatattatttcaccatgagaattccttataggtgattttctaaattacattctcagaatacttaggaacactgcaaatttaatcaatggggaaactagtttttttcagattcacatgttgtataaatgcttatgattaaaaattctatattggcaaacattctatctcatgctaagcttgcttttttaacagagtagatggtaaagcctggtctagttttctccaccctttctccattatttcctggtatctgctttcaccttgtcttgtttgtctgggtctcttattatctctgaacttctattttaagtagcctcaactctcttttgtatgttgcatatatataagccagttaataaaataaaaaatgtttttttcctctaagtacttctgctatttatatatctacaaaatagtctttaaaactgttactagaaaacaagttacaacattatcataacaatgcaaaatattttgttgctgcataaaggaatgtgaaaaatttggtgcaaatattactaatgttatgtgttcaaatagaatagattgttataacacatctgtaatttataaggacaattatcacaaagtaatatttgctaatcatctcaaggtaaagagatatatatgtaacaactcgtaattatcatccctttgtggcattatcatttttatgactatataagcttttatacttaagtgcataaatctgtaaaatgcctccagaagacaaacttacaggaagacacggtgcagaaagtcttttgagaatgtgattccccttagggcatcagacaatcaaaatctcattggcaaccaaaccatgtttctttttctgaattcatattataaagaagcttagcatgcctcagcagctgtaaacacagactggctacatgtcatgtcctttacttctccttttttggaagagtcggatgaatgctgactgcttatcttgactagaggagtgtcaaccaggtctatgtcccaactatgtatacctacatggcgttactgacatcatttaatactactgtcacattaaaaagaaaagctgattattttattttttattttttttatttttttgagatggagtctcacttttgtcaccaaggcttgagtgcaatggcatgatctcggctcactgcaaccttcgcctcccaggttcaagtgattctcctgcctcagcctcccaagtagttgggattacaggtgcccgccaccatgcccggctaatttttttgtatttttagtagagacggggtttcaccatgttggccaggctggtctcgagctgctgacctcaggtgatccacccgccttggccccctcaaagtgctgggattacaggcatgagccaccgtgcccggccagaaaagctgatgttaatgctactaaaaagagatgaagcaaaatgattctgggcaatagatgagccagccttcacatctttccatctctatggtataattgtttaaattaataatactaatagcattactaagctccagactttatgcagagttcgctcattttccactaatgtcctatatctattccatgatgccattcaggataccacactgcatttagccagctaatatattatatttaacttaggtttctctagccaggctcatgaaacaaataaagctccaattcttccctgcttgtctctaatgaattgttgctgtgcagagcgggagagggccaggacccaaggggaagaaaaacagggctagaatggttttcctcagttaacccattcccctatctacctttaaaaaattcaatgggaaagaaaagactcaaataaggaaggaaattatgctatgatttattttttccattattgtgactttttattttctcagggtttttcaagttctctgaactatttttatattcactttgaagagtaatttaagttcccaaactaaactcagtgtccccagattttctcatatgctctaaaaattctgggatgaaaaaaagcttcctaatcaatagtagttcacacaggattgaagaaggtggtacctgctcttaatgttctcacatcttccttttccacgttcttttccctgcactctccctactccgccatgcccaaaccagtggcatccagtggtctctattttagcaactcacccctgtgtgtgctctcctgaaatagaacttgcttcacacttaaaccctccaacccaagcgaaaacaaaacttacctatccatgttggggtatttctgtctaatactattacaatgagttgatgatgcattttaacagcaaagatttgtgagactcccaatagaatcttgagttaatgacaatgcagagccagttccaggtatgcttgggaggtcaaaattcaggtgatatgaaccagagcttctccagcacttttcacgcctcaaaatatacttattaatatgaggggtcctaagtttggggaccctgaaatctctgcatgatatttaagggaaggcagtttctcacacgaatttacatgagcaagacttacttcgatatagatatagtgcctgctgttctctatcacatggacgtaagcggcgtggatggactcttcatggtactttataccagcagaccaatcagcagcagagcggagcaactacaaggcagcaatcagaaatgaacaagtattagcaatggagaggacatcagatatattaatacaatgaagtcactcctttttcttccagacgactgaatgattacagtggcttgagtgtcatgtgtgaaccaaaggagagtagtggggtggggaatgctgctaaggaagaggggagaaagggggcaactggtccttggatgtagtccataaggaaggtcctcagctggaaatcacatcctgaatataccctctttcatccaggattattttcattcaaaactggaaaccacaaattgtggtttctacaaagactatttcagaagtacctcttctgatggctgtgagtatggtaaccatttgtattcctttcctatgacagtccctcaattataccagaatccctgttgttctggtgcatttattcagagcacccatctttactcttaaaagggtactggtttggaccatatggtatggccatcctagctctgacttaacaatgtgattattccttttcccctaaatagatattgttcagattaatacattctaaaaggtaggtcatttggcatgtgatcttcattctacctttaatagctgtctgttccatggcacgccactttagtctaaactttctaatggcataataaaggaaattaatcacaggaaagagaactggggctcagagaagcaaagaaacttgcatggtgtcacagaggtactagcatcagcatcacagcttgaacttgctttttgtcattccatatccgaagtttttctactatgccacactgttttgccacttcatcacatgtgtgtggcatgccagtcaatttgggattgatcccatcacctcagattaaacccatcgaagtggagctcctgacttttttctctaaaccatttcccatttcaaataccccactggccaggggcataccatcattctattagtctttggcatgcctcttctccttagcgtctatattcaatctcacatctacttcagtttattctttggaggatttctcagatttgcctctttctcatcgctcacattgcctcgctctacgcagacactcacctgtccaggctgtattactcgagcttcttctcgctcagacacctgaatataggttatatacactgatgcagagcaggactgtctaggttcaaagtctggctcaactatttactggctgttgatcgtgtttcttaacctctttgtgcctcagatttttgttctataaaatggagttctactttatagggtcatagagaggattaagtgaattaccgtgaaatgtgtagcaggaggcctggtatctattaagtggttataagtgttatattaatgagcattagaagatgtgtttgagctgtggcaggtcatgtcagggatgctgcagagcagactgtggctgtgcacagaagaaaggatgagagaacatggaaagaaggtgttctcaacactcagcaaccattggtcatcacttttttccaacattctaactagcattgcagtatgatgttggcatatagtaggtgcttaaacaatagcatgacacacagaagaattagtataaaaataatacttgctatttctggtttgaaatgaatattaaaactgtcccttataaggtcaactgatattgaaaataaaaagaatgctcccatactcattaggaatatacaaagcgatccaatacataatcagttctatgtctgctgtatataaaaggcctggaaaaattcttgttcaaatcaataactttaaaattgcaactatacggccattaaatccaaaactcacacttactaaaaatcgctgactgtgccatcctcagtagtgttatttctttatccaatatgaggtatttattacaaaatatcgccaatcaaagcattaaaaaaattatcagatgaatatgtgcaacaaaatttcaaaatttaattgtcaacatgaatatattaaatatcatagaagagaactcataaggaaaatttagataaatattatccacactggaaaaatatcatgattttacatcatctccaaggagctgcattattattcatcaggtagaaaaaacaaaggttgaagaaatagaagttttaattcttagtccactcaaattaatgtttaattttgttactaaggaacatagcactgaaaatgcaggctactttgagaagattctcatgctatcctgatgtaattctatacaactctggaggcaacgtatacaattgcagattacactggaaagaagggaacctccaggattttttttttttttttgagacggagtcttgttctgttgcccaggctggagtgcagtggcatgatctcagctcactgaaacctctgtctcctgggatcaagtgattctcctgcctcagcgtcccaagtagctgggattacaggtgtgtgccaccatgcccagctatttttttttatttttagtagagacggggttttgccatgttggccaggctggtcttgaactcctgacctcaagtgatccacctgtctcagcctcccaaagtgctgggattacaggcgtgagccaccacgcccggccggaatctccatgatgtttaaatgacttgtccaaggtgtaagagaatttacatataatttaaatatcatggaggttcagtttcctccactgtacaactgagacctctccccatcccctaaagctgctgtgaagaaaaaaatggcataacaaacacaaagtgataataatggtatgtggcacttagtactagatattctatatacagtatgtccacctctgtaaaaagttataggcaaagtttataacccacccttgctggtaacatctgagtttttccctcgaatccaaaaaccttatactttctttcctttctcactctcaaaatttgctctgactcaatgaactcattcacataagattcaataaattcattcacataagatacacatgaggagaattacatcaatgtcagcttgcatatgaagtctaatagattcagagtggcttcctggacagctgggttaagaggcgattcttgaaagcaggtgcactggggaagaattctgagattgatcctcaatggctttcatggaaggggacgcctgaaggtcacatatttgccattttttctgtgaaggataatggtaaatgtttctctatctgtaggcatttaagtatttaaaatattaaagcttcaagccaaaagaagaccattttatggccaggggcggtggctcacacctgtaatcccagcactttcggaggccgaggtgggcagatcaactgaggtcagcagttcaagaccagcctggccaacatggcgaaaccccgtctctattaaaaatacaaaaattagccgggcttggtggtgcatgcctgtaatcccagctactcgggaggctgaggatggcgaatcgcttgaacccaggaggcggaggttgcagtgagccgaaatcatagcattgcactccagcctgggcaccaatagtgaaactgcgtctcaaaagaaaaaaaaaaaagaccattttatatatcagcctgtgggagagcataataagaaaaagcggagggggctccctgatacctgcaaaaccatcaagtatgaggggtttcctacctcctgaggggcttcagcatcatctatcccattgcctgagtccaagccccgtatcctttacttacaataaaaactcattaattaaaaaatgtcatcatttgtggctaaacttgaaacatatctttcaagcaacacatgaagaaaatcacttgggattgttattcatttactactattctaattagttaaaatctccctatcaccacaagaaaaatggaaaatacgaatttccttcttgctctgcctagaccattgaactacaggcagggaaccctgaggttatataaaaatcaacttaactgctttaaatgcttgatggcctaggaagttttatcaacagtcaaataagtcaaacccattgtattcgtctgttctcatgctgctaataaagacctaccagagactggataatttataaaggaaagagttttaatggactcacagttccacatggctggggaggcctcacaatcatggcagaacacaaaggaagagaaaagggacatcttacatggcagcagggaagagggcatgtgcgggggaactgccctttataaaaccatcagatctcatgagacttattcactatcacaagaacagcacgggaaagacctactctcatgattcagttacctcccactgggtccctcccatgacatgtgggggattattacaactcaaggtgagatttgtgtggaaacacagagccaaaccattatcacccattttgattgatttccttttgttttattttttcacctttttccattgccactgagatttccttttgttttaatatttactctcttcattttcttcactgacttcaccaacttgtcttgcatttctgttttaaaccaatgtaactgagataaccctcaaactgttccctcacatgcaaaaatatagcttatcttaccgtcccaaatgtgctgggaatcaaatctaatctatacttttcaaaccacgagtttgaatacataattttaaaatatataaaaaatggcatatttctgattttatggtttaacctcaaagctgtaacttggactagtcattttcttcgtgctacgtcttattttttaacctaaaatatagccttctctttaaccacaatccctaatcaccttccatcctatgggcccaagtcaaatgtatggattaaataacagaaatttctttctgaaggaaaacctttggatctttcttagtatttgtcccaaattcccttcctttctctcatcataatgcttttattccctataaattcagcacatatatgaattcctttttatttccctgagattccaagtcaatcatggaacaaagactatttaggacaaaagcactttttatatgtttcacaagcagaggccaactgtgtagaagctcacaagtggtatgcattggggagagaagggaagcctctgattgtcgggcctttttcttccagactgtactgagaacagcaggcaaggagcatcaagaaattgacctagttcaagaacctgtctcatcttatcaagctctttcttttcatagccacttttctagttgagtgtcagccattcatatcacagtgtgcagttattcacataggatgattcctttcctgaacaaaagagaaaagttaattttgaggctgaaggacagaaagaaaagataattattgaagaataggacttaaggtgaaagaagtcctaggaaacacagtattagttgggtgttcttgggagccagaaagaagcaaaaggagagttagggatggatttggggctgtggcaacagaaggtgatacccaaaggcaaacaggacatgaaactttgctctgctagagccccagcagttacaaccatcctggtcttactggaaacagtatccatagctaattaacctcaggcactgaagccaaactgcttagaagcaagtcatccccaccacttactgtttgtggttttgagatggagtctctgatgcccaggatggagtacaatggcgtgatctctgctcactgtaacttctgcctcccgggttcaagcaattctcctgcctcagcctcctgagtagctgggactacaggcccatgccaccatgctgaactaatttttatatttttagtggagacagggtttcaatacattggccacgctggtttcgaactcctgacgtcaggtgatctgcccaccttggcctcccaaagtgctaggattacaggcatgagccaccgcactagacccccactagttaccgttattttaacctctcaaagtctcagtttcctcatctgtagaaacaggctgcacaggagtttagcttacagactgctgaatgtatatgagataatgcacaaagggttagcacagtgccaagcacacagcaaatgccctgttcatatcagctcttctagccaagacccacagtaacactcacaaacgtgttagtccatgaaggcctggcccatacatggaaaacaactcccatggtaaataacttccatggaaatggacaaggtggattccttttacccccacctgctcactttatttttcacctatctactttattctctcacaccattctgggatacaaaacattttgctgtcctttcagatctaacagatccttgggaatatcctttggacatttattccaagcgtgaaaacaattttttttcagtggtataatttggatgttatttatactttcttgaaaattttctttttttttccttcctctctccctctctcctttttccctttcctcctttctcattctttcttccttcctttctttgttcctccctcccttccttctttccttcttttcccataagtaggactgaagacattattccagtagagttatttccatataggcaggaattctcagcatgactgtccaaggaatggtttctactatgagctttaaaaaggattgttcccatgtgttgaccccatgttgatgctgacacggcattcagcattttctttcagcttaatagacatgtcaaatatcctctgtctttataatatatcttaaatgccattaagaccattctggaactgagtttattctagttccttcaccttctctgtgtagaagcagtttcaggaccatctctcccacttcctcctgctacccatgccttttcctgccatgtcttctctgagtgctcttggcaggcttctgagaaggcccagcactgaggggaaacatccaagattcttttaaaagtacagtggaagctgctgaagtcagctgtcaggtctagataactttttcaggagcagcaattcgtgctggtgggcaggcatccatactgcctgccgtagctcccctctccctggctggctgtgtctccccctctggaattgccagtggcgtgtgaccaatgtttctgtattaaaaaaattaataactaggtgcccttctccagaagaaagaataacttgaattttatctattatttactttattatgtcaaatactctttctccccattccaatagatttatggcataaaaatttctatctagaacaagcttggtgacctacccagagaaatgttaacttctttgttgcaaactttttttgtttttgttttttagacgagttttgctctgttgcctaggctggagtgcagtggtgtaatctcggctcactgcaacctctgcctcctgggttcaagcgattctcctgcctcagcctctcaagtagctgtgattacaggcatgcgccataacgcccagctaatttttgtatttttagtaggacggggttttgccatattggccaggctggtctcgaactcctgacctcaagtaatccacctgccttggcctccgtaagtgctgggattacaggcctgagccactgcgcccagcctgttgcaaacttttgaaacactagcgaaagcttgaaggctgtttttgatggaactcaaactggtatactcttctaaatgctttgcatggattaatttaaccatcaccacaatcctgtgagacagatactgtcatttatgttttttaaatgaatgaaacatactgcagagtgaagtaattttcccgaggttacacagctcatatgtcacagagctgagatgttaacacagtctggctctagaatctatcccttaattgctaccttatatttttcttcacaattaaataagcttgtggcttctaagttacattatgaacagtcaactatgttaaaatcttgttctcactcatatgtggaagcttaaaaagtcaatctcatgcaagtagatagtagaatgatagaaactagaagctgggaagggtttgtgtaggcgggtacagggaatagggtggagataaagagaggatggttaatgggtacaaacatagaaggaataagttctagtattcaatagcagagcaggttgactatagttaacaacagtgtattggtatttcaaaagagctggacgagaggacatgaaatgttccaaacacatagaaataacagaagacttgagatcatgacactccaaataccctgaggcctctttaataaaatcaatgcaaatttacaaatataaagctgagaacaggtctagaaaaggcctgggtggctgagggtcctaaagctaagcaagggcctgaagctgcaaggaacatgagttcctgaagggagcaattcattccctacttacagccttaactccagccagtctgtaggagattttactttaggcactgagatggcaaaaagctaattatagaaatagcaggttttcaggaccagaggaataaaataaattataatcttataatcttggaatttaagagttcatcagtgatgtcctagtttcttaactcttatccttccttttaatttttgtcctatttatcactgccatgtggctaaatgtacctatgatgttttaatttacttagatattttccttttctctcaaagatccatagaaacaagtttaatgatcaaggtaaaaattctgagcaatggcttctatttctatttagtgataagtgtcattctaactactttaaaaattaagaagtgtatctgtggtggccatttgagttttattttgtgagggatcataactatagcaggaggattaaatagaaagtcattaacacctgtactttgaatgatacctcttgtatgaaagacaatgaatgaaaattttccctttaaatgtctgaagggactcagatcagattcataccaaacataagtctttcagatgacaaaactgggctcagggaggggtaatggcatgctgaggccacatgctgctatacaatcttcataccacaccaccttgtgtgcttttatgatttgttagcgtgaaaatgcatgttattatatttagctggatatttccagcagcactgcctagcgacacttttatatacccattttatatatccattatcatgctgcaaaatttatattaccaagaactagatgtactacaggagctacctgagtcctttggtgatctcaattagtgccctggcccatcagtcatgacacagttcctatggttctttggagactttgtgacactaaactatctttaactttttcctctgtcccaaattttcagttagttcctagtcgtgatgtccctttgtctctttcctcaaaaatacctcctatttgttccttctcttcatttctagtttaggacttaattatatgtcagaattactgtaatagcctcttcacttgtccccttgctctcattatctctctagtctaataagttcttcatgtgtataaacatttggtctcaaggtatttgtttggaaagatggaaacagataagaatgcataaaacaagagattctctgtcaaataagcttgggaaatgcgcacatcatattccttcttggtggttttataatacactgtagcataaaaaaggtgctaaggagtcctgtattaaagaattctgcaaaaccttatctgtccatggaaatctttgtggaatagttatcagcatctcacaggtaaattcagtttggaaaactctctcctccattaatcttcattgaacattcctgcatcatgcttcttgcccaatcgaaaaaaaaaaacatccaaagttcactagcacttctaggaccaggtccaaattcactaggacagcactccaggtgtagcccccaccccgcccccgccctggccttatgctgtctaacttcatcagtgcctctctaagagcgaatgggttactgcagtcagtccttttgtcttctgagcaagcaggactattccttagagtggacacccagttctgtccctctggatttccaaactcttacagcatgctggtccttactgtcacaccagcatttactcagagaccataccttgcactgtaactgaattattcatctcagctatctctccccagctaactaagtttccagaggcaaagaactcctttgctgtctgccctctcgacacccaagtgtgctttgatgacttcaccatgcaaacggacaacacttagtaaacatatgttggctgaataaatgaatgaatgagtgagtaagtcttgttaaatatccttggctttgtagattcttgagtccaggccacctgaacatgtgagggattaacatatgagcttatcagatctagtctcatttcttttcttttagtttttatttttattttttttttttgagtcagtctcgctctgttgcccaggctggaatgcaggggtgcaattatggctcactgcagtctccacctcctgggctcaagcaatcctcctgcttcagcctcctaagtggctgggaccgcaagcatgtgccaccatgcctggctaattttttaagaactttttgtagagatggggtctcactatgttgcccaggctggtcttggactcctaggctctcctcctgccttggcctcccaaagtgctgggattccaagcgtgagccaccacacccactctagtgtcatttctcacacaacatcagtgatgcggaaaaagcgaacgaagagaagcattttatagagtctctattgacctcaccaggcagcaggatgagactatgtgagtcagggctttaccaacagtgaagtggaaaatatatgcatatgcaacgctatgctaaaacttccttcattgattacaaaaatacttaattcccagcaatccattttcaacagatacttattaacatcagctaactttgaaaaattgaccaccacgtcaataataatgcaagttcaaatcttaaattcttattttcctaataacaagtttcttattttatattctagcattggtaattttttctcctctacgtagaataaaattaaacaggttcataaaatattcatcaacttacatataaatcatagctatctctatgcctctgagtttaaattagttttctttttagcctgggatgactaatatttgctgccgatatttctctcaagcagcttatctttttttttttgagatggactcttactctgtcacccaggctggactgcagtggtgtagtctcggctcactgcaaactctgcctcctgggtttaagcgattctcctgcctcagcctcccgagtagctaggattacaggcgcacgctaccacgcccagctaatttcttatttttagtagagacagggttggccaggctggtctcgaactcctgacctcaggtgatccacccgcctcggcctcccaaagtgctaggactacaggtgggagccaccacacctggccttttttaaaaaaagttctattatttgatctacagtctgaaatgtcttatttcttatatacacatacctccaattgcacacgatgcaaaataactgatttaggcacttcatttatataatcacattccctaggatccatgtctgcattatataagtccctactgatggtccctactgatgatatgtagcagtagcagactgctggactttacttaaacaattcttctgatgcccatattgatgacttcaaacaaaaggcaatgccaaaggtggcccatcctacttctgtccccacatgatctcaagatatttgagctgtagttggtaaaggaagcagattgggtaacactggaccagactaggatttcaagctccacctctgttgataactagctggccggccctagataggcctcagagccccactaggtctgaattttcttatttgtagtttgagatggttaaactggatgtggtaaactgttgtgactctattaagcaaattccttattccattaaaagggcctctagaagacatttggttaatcaggaactaaaattagactgaactacaactagcttcctagctgctaagtttcagccacattcctggtgcttaggcagtatcaggtccaggtttactgggtatcatgttgctagggtcacttcagaaggaattacaggaatagccttggctgtggccttttctaaggacatgcatttattatatttataagagttttaaaaagagactgaattgaatccatttaacataggaaatataataacaagtattaaaagatccatttagttttgctttagaaaagcagtcattgaaaaatctgaagccaatgtaataggcccttggtccaataacagtaattttactcagtagcattttgtcaaaaagaaaagccagaacttacttacctgtacgttagcatggacagacccaggcacttgatatctcaactcatgggctgttgtttgagactttggaagcagaaaaggataagaaagggaccgatattttgatttcataatctaaaataaagaaaaaggataaaatattcaaatgagaaaaaagattcattctccctactttgtgattataaaagaaattcatgcccaggtgcagtggctcacgcctgtaatcccagcactttgggaggccaagaagcggggatcacttgaggtcaggagttcgagatcagcctggccaacacggtgaaacccccatctctactaaaaatacaaaaattagccaagcatggtggcgggcgcctgtaatcccagctactcgggaggctgaggcaggagaatcacttgaacctcggaggcagaggttgcagtgagtcgagatttcatcattgcactacagcctgggtgacaagagtgaatctccatctcaaaaaaaaaaaaaaaaaaaagaaaaagaaaagaaaagaaattcaggttaatttgaaaaagaaaaagaaaaatgttaatggtggacatttctaagtgaagggctacagattatttgtgtttgttttctacttctcacagtcctgtttttaccttttgtaggggaaatattgttttatatttgtaaagacaggttaaatataatctgtagttacagaactttataattgcaaaaatgagactattgttttataaactaattttttactgattatgttctagatatcttgtcacagcaatatagtgggatatcattatttttaataacttcatagtaaaatggtataaaagaatcatttgtttaataaattcctattagtaaggatttctgttatttctaattttatttgaattattagaagccatatcaaaataaattaccttattggattatggctttagtttgaatacccggaaatagtttttctggatcaaagattgcatactttaaaaaagacttattggtgttgtacaaatttatcctccctggggtagcatgtatgagcacaccacaaaaaccaccccaaacctaactacaggtatcagcagagacttttatctttgccagtatagcaggttaaaagtaacaccccatttgtttattcatccatctcccctaaatttttgttaaaaaatttcaattagaatgtccactaaatttttataatcattatgtgaatgaaaaacaaagttagactctaagtggttgataaaactaaattctttttccaaacgaccaaggggaatcatgactcattatcccttcaagtaaataaagtgaaactttaataacacctgaatatgtactttttttttttttttttgagacagagtctcgctctgttgcctaggctggagtacaatggagtcctctcagctcactgcaaactccgcctcctggattcaagtgattttcctgcctcagcctccagagcagttgagattacaggcacccaccaccatgcccagctaatttttgtattttagtagagacaggttttcaccatgttggtcaggctggtctcgaactcctgacctcaggtgatccaccagcctaggcctcccaaagtgccaggattacagtcgtgggccaccgtgcctggcctgaatgatacgtacttaacttatgaatgttaggtttgaatgttatgtcaagttcttacaagtaatgaggacacaatctggataaaaggaaaatggccccaccttcttaatacttcttggtttgctcagaaccagctctcagaatcctgtaccaatataaacccagtgcaattccagtcccatccaactggatgggactttaaagctcaagccctctcatctaaaccaggctcctatccccctataacagccctgcaaatgactaccgagcccaggctactaaatgcttagtcaacactgtgtccaagatgttaacaaggttaaaatcaggacccacacagcagcacctgtccctaggcactctgaattgtctatggtgtggacattcgggaatgtttccctttttttttgcccagatgcccaggcacccggacatcaatgcagccaacagcagagcagtgacacagttgtggccacaacagtctcttcttgctaccagcctcctctaaacctcttctctagttaggcctgcctctcttcatgtggataaatcatgatagcaacatccaagtacttttgtgaagttccagcgctggatgaagtgacgtgccacatcacgagccgccttcccgtggactgcagaggcaatgtcatgccagggcatccggggcgtggagtacctgtcaatgaaatctgcccgggtgcaccaggcaaggatcagtcattaacttcagtgttggggcaaagtctctctgactccaactatgaaactaaaaggaaacgtgggttagtgcccactaggtatatatttcttggcttgcatagaacaacatttttataatcaagggaaacagatttcacattcagggacatagtctcccaggcacttccccacatatgtttccgtttcacttaggattagataatcactagacatggcaagatgtgagttggtacaaattatctaaggctgtgtatttgatattatattttttattttttatcctgttgaaacaatggcaggcaatgccatctctatctcctcttaaacatataaacccagtgataacctgaaaatatgccattctaacgctggaaatgcaggaaataagcagaatagaagatgatcaaagggagcctaccatttcctgaaaaattactgattattgcccccaaaatatgcctataaaaatctggatttttcagacagttcagctctatttcatgttcttttcttattataactgaaaaaaaagtccttaagcacatgctaatgactaaatctagtctccaaagttttaaaaaattttcaaaaatcaacggaagcaaaacaaaaggcatttagatcatgcacatgtatacttgctgagatgttcaaaggtaaaagacaaaatataaccagcaccccaccattatgatactcaccagcaaaaggtttatcaagttgaacccagtctttgaagacgaaattgcagtagtcctttccatgccagaatctggtttccccatgcagctctcccacacctgtctgtaaactacggatggacccggtatctgtgaatgcagcaagaccccctcagagactgtggttcaggtgagtcccagaaagggaggctcaactctcatttattaaacacctaaaagcttcttaatttcttaagacacaactagggtggcatctgtccattctattacaggctgtgggctaacaaggttttacagtccttacaagtttacttttagtgggcagttagggctacaacaagattcatcattaaacaatgaaatttgaccttctcaggcagttgagtaacttatttccaccacctaccagatcactggaagaactatcacagaattaactgtgaataaagaactcacaaggtggcactatgagagcagtaaagctggtggggggctttcaggggcagagtgggaagggcggggaggggagaggtggagaaacctgagacgcaggggcaataaagacaccatgccacttctttttcctcaaccaacatggtgcacacctgatgcataattcttttgcattaaagcaagaacctcaaatttacagatagcccatgttccagccctggaattaattagctaagtgacactgagcttcagttttttagatcataaatccattatgcgtaaaatgaagaatttggcctagataacagctaaaatctgttgcgctttaacatttatatacttcaaatcatagatggcatttataaaaaatatggtaacaacagatgaaagcttatgatataggtgcaaaagcagcaatctactatagcatttcacaaataactgtgccgagaccattgacttacggctaaatacaaagacaatgaagtaaaaagatgcagaattacaaatcacaaacgcagcacttggcacaaaagaggcatttaacaaatagacactgaatgcaaaaatatgtgttgaatgaataaatggtactgcttgcagtagccagtgagaggactacactggtcctgccaccaacacactgtcccagaactgtctttgtaaaatgcactctttgcttaaaaccctggaaggttcacatactgcctataggaagctcaagtcctaagggcttagtgtgcatagaagactcttcccaaactggtgccaatctatctttctagtccttgtttttccccacccaaccccaggccccatgcaaatcacgtgtttcactgtattataacaggtgtggactgccatgtctccatgcagttggcacattattacttctacctgaaatgctcctttctccctcttggcctgatatcctaatcatccttcaagagccacattagctatcacctgccatctccccataaggaagaggcagtcactagcactgctgtcatcccactaacaactgccccaacacctctgactctgtgacgcaattgtatcaggatgctcccctgcccgcatcaatgcctcaccagtctataaactctttgggagtgggaaccaaatcttctcactgccagtagctccaagcacccaggcaatcaataaatatttgcagaacaaatgtttttatgtaatcaccacacacaatgctaatattctatctcaaactgaatcattaacctttcaaaggctattaaagttttctacagaagaaaaatgatttaaaatgccatagattagcaaaatgaaatcatgttaaaaatagacttctattgacttctcccagtgatttattttcctgctttatgagactgaaaggccaaagtacgggtaggtctgtttgctcatctataggctctttattgtttacatagcactttgttaaaagaagaaaagagggtgagaaaagaaacaaaagggatgaaaaatgagataaacaatatttcaaatttcaaatataaaatacacatatacaatttgctttcatcaactgcaaaactctaagctaaggctttacataaacacatatacactcatttaaaaattatctttcacctaacaaccagttatgataaggaaaataaaggaaattcttagtctcaggaaattatcttggtactaattgaattcaacctgctcataattcaaatttgtttttgtttttagccatggcctaaaaactattccacataaattagggttcctcctcagtacaaatgaactattaaggcaatagagccaaatactagttcctgtgaaaacagtagctcagaattacatgagtgtggtcgagaggacttatggcatcaacaatgctgatccaagggggtctcgttaggctgctatctggctcccaaatgatttcataattgcacctgccttgtcttttggcacagatttgtcaggccaattttctgcatcctcctctgtcagtggctcagattctggctactaaagtttatgagaagggggacttcttgttccttgcctggtgtcctctggtcgtgccacatcctcctccttctattctcatctctcggcttccaggtctccatttttctaccatttctccagcctatccttgttcttctttcctagctcctcctcactaacaaggtttccccctttctcctgtctttttgttttctttttcttcctcttttttttttttttttttttttttttgagactggagtgcagtggcacgatctcggctcactgcaacctctgcctcccagggccaagtgttcaagcaattctcctgcctcagcctcccgagtagctgggattacaggcgcacaccaccatgccctgctaatttttgtatttgatagtagagacagggtttcaccatgttggccaggctcatctcgaactcctgacctcgtgatctgcctgcctcggcctcccaaagtgctgggattacaggcgtgagccaccacacccggcctctcctgtctttttctatacaatttctaaaatgtgcacctgcaaggatggcttctgttttggactccaaatctaaggtcacttccagtgcctcacttgacattgtttacctagttccctccagaactttaaaattatgtctaacactaaaatcatcatcattccataaaatcaagtctttccttgagatttctgctgtctgtgtgtagtaactcaagctcaaacctcggaatcacctttggctcctttattcttcgctgacttctccacccacctccccacggcttcccagatcatgatgaaaatctgctgattctgcttttggaaaaagtttctcccatttacttcgttcttgaactcactgacacaaccttgtcagactccctgtgtctctactataaacgctataaagcctcacccttaattgctccctgcccctagggattttccaacatttaatggaagaggtgcaatgtctcagtctgattttcaaagtcctccgtaaactgctacagatatatcccaccagctcaatctgcacaaatcagcccttaaccacaattccaaaactccaaaagttctaacaattcaaatgttttttcatagctgattttcacagctcatttcataactcacaggtcagcaaaatctgacctgaactgacaagaggttatttattatctttattgatcccacttggtgttgcacaaacataaatggtttgcctacattccaggtatttcctggatcctgctgggagtgtaatatagtagagggtataggtattgtattacctttctaaaatccagaactttctgatttctgaaatctgattccaaggattttgtatgagagattatagacctatatgtatttaccacattctacactcagtctgagatgccgaaataaatacttttgcatttcctatatctgggtcttaagatgtagtatctacctaaaatgcctgtttttctacctttttagtctctacctaccgaatttctacatatgttcaaggccagttccaatacaggcactgaacaagttatattttaaaaaatattttggttttcaaaattttttggaatttagaatcgtggttaagggtttgtagacctgtatttcgtctgtggatcaatgatgactcttgcagtaggagtatcttccctcaatgaattactaaaatattaggtttgtaaaatatttaaaactcatgctcacctattagataacaagctatttaacagcactagatgaatcttacacatcctatccattgcattcctaagaacagtttagaaacagcttaatattatcccttgtgacgagacattcaaatttgaaaagcctgtctcaactaaattgcaaaaataatttttccctcacttacctatttaatattgcttaaaaggaaaagatcagcacatagttgctgaatagcattaggagaaacacttaatgtagatgacaggttgatgggtgcagcaaaccactgtggcacttgtatacctatgtaacaaacctgcatgttctgcacgtgtatcccagaacttaaagtataatacagaaagaaaaagaaagaaagaaagaaagaaagaaagaaagaaagaaagaaagaaagaaagaaagaaaaagaaagaaagaaagaaagaaagggaataaaattcaacactttaaaaatagtatcaagcaaaattctccctcttagaacataattctgaatgaaaaaaaatcttgaaaatgactgagtgattttgaaaaacatatatttcagatatgattcctaaccacgtttttagtgcagtttttctatataaaaacccatagtgatgttcactccacactgatttctgtatgacaccaggaggtttaattcaacaaggagcccaattcaacatggtcatatgcggtcaagtgaaattgatattgcagagaggctaactctctttgcattctcaggaaaaggaagtcattaactcaagttcatattcagttttaaatttctaacgaagagtcactccatgcttaatttgggtttcaagttttataaggcaacctgagtttttaaggtattacatgatttaaatctagagccttgctctttaaacttccttcatttttttagtagaacttttcttttttgaaaacaagttcagaaggaactccaataattaaaacagatacaagtgggattgttctggttgaagaggtaccaatagctgtgggagggtcctggggttcacctacttcaatgttctcctcaaagccttttaaaaactccaggatccaaggaatcgactttggaaagcactgctctagaaggaccccatgatcctttggcttttctttttaggtaaactgttttcattttaaaaaattaaatttgtatttatatttgactataaaagtaaaatgaaaacagtaccaacaatgtgggaaaaaaataaatcacctcacgctccatcttcctaacaaagatagcatcattgaatgtcctttgtcagctgccttcacgaacatattttgatacagtggcaattgtcctcaaattttccttgctcttcccatagccacctcatttcagttcatggaaattccatctttccagtggggccaaagatttggagtcctctccatctctcacatcttgtatctagttcatcggcaaatgctgtcagctcgaccctcaaaatatattcacaacctgcagagtcaccatttgccaccctggtctgctctgaagaatgatccttggaaaatgtaagtcagccctcgcctacccttcgctcaagaccatccgatgacttcctatctcactcagggtcaaaatcttacagtggtctgcaagacctcacataacccaccccagcccacctctctgattttgttcttatcatcctctcctagcccacttcactacagccgtattcctggaacacacccaacccctctacctcatggcctttcatacttgctattccttctgtcggaaacaccctctctcagtttcttatcctcattcttctctttctttcgatgtcagctgaaaactaacctcatgagagatgtattctccgatgagcctttacaaaatagtaactcttctcctatgctcttcctcccggatcatgctcaactattctccgtgataattatcaccacctgaaatgtgtttgactctctatttgtatacacagttcccatccttaccctccaactagttaattgcacttcatctgttttattcaccacatctctagcacccagaatagtgattggcatataacagaaactcaataaacacttatttaattaaataaataaatcttctatgtttatttttgtatccccaactacagttgtaatcattgcccaattccataaaagagatgaaccatttgttaccattcattatgttcttcaccatttccctactctttgacgtttaggttgttctctctctctatctctctctctgtctctcaacaatgctacactagacatatattcagtttatcagtgaggggttgtaaacagatgtcaagggtacttttcatcagcaacaccatacacatgtatgatcagtgtctcagatcaccactgtggatatcacctctgtcaacctggggtaggcgtgagttacttactggactcagcacctcactcacatcttttccacttgctgtcaatcctattgccagcaacactatcagtcataattcagatccataatcttcatgggttggcaacctcctttcctccacttcatttttaacttcagtaataaagcagcaaagttacacattgaaacgataaggcactacctggagctgtttccaaccctttacctctaatatcggccactgcatgcactcttgacctggcttcctagatttcccagaggcctcctacttcccaggactttgaagctttgtcatgcacaggaattactgggagttgtccctgaatccacacatacacccagtactaggtgtatgctaaataaatatatgtctccccatatttgttcttctccatttttatttttcaaaaatttaaaaattgtttttgtgtgtgtgagagagggtctccctctgtcacccaggctggactgcagtggcatgatctcagctcactgcaacctctgccttccaggctccagcaattctcccacctcagctgccagaaaagctgggacaacagatgcatgccaccacactcagctaatttttgtagagagggggtttcactgcgttgccgaagatggtcttgaattcctgggctcaagcaatcctcctgcttcagcctcccaaattgctgggattacaggtgtgagtcactgcacctggcctcttctccattcttaaatatatatcgatgctgttatgatttatagacacaaatttatttaacagttacactgaagttttagttcattgtgtgtagttgattattgcattttttaaaatgcagcgtagctggaccaagcttgtccaacccacagcctgtgggccacatgcggcccgggatggctttgaatgtggcccaacacgaattcacaaactttcttaaacattgtaatttttttttgcaactttttttagctcatcagctatcattagtgttagtatattttatgtgtggcccaagacaattcttcttccaatgtggtccacggaagccaaaagattggacacccctgccctagatgaaagaatgctgggaatcattactcaaagtctagcataatttttcaggttcattagcacctgcaagccacaggtgactcacattcaggcatgtgagctagactgtaactctcatctgctaaacaggacatgagagccctggccttaggttctagccaaaaaagcataacatagtaatctttatttctgctaaatcacaggtcttaattatgggcactgggaggatgataaattggaactccattgggcaggtcatgtatcatctctaaccctgagtttcttcatctgtaaaaaggagatgacaatatcactaccaagcactgcaactactcagggcagtgatggatagagtctgtgcaaaataaatgttagcttatgatcttactagtgtcatttattatgatgattacttatccccatatctgaccagcggccaaatccttctttattcccaccacaagttaaacttattagtcattcattaattcctcgagtatctggagtatcttcttaccaaaggctatcagattgtaatttctgaaaattcacacagcatgacacatccacccaaaggccttcaagatttttaactggccaggagcggtggctcacacctgtaatcccagcactttcggaggccaaggcagacggatcacttgaggtcaggggttcaacacaagcctggccaacatggcaaaaccccatttctactaaaagtacaaaaattagccaggcacggtcatgcacgcctataatcccagctactcaggaggctgagctgaggcaggagaatcgctaaaacctgggaggcggagggtgcagtgagccaagacggccctactgcactgcagcctgggtgacagagcaagactctatctcaaaaaaaaaaaaaaaaaaagatttttaaccaaataaaattccagctcccaaatgtgaatgtcatatatcttcttagtcttatatcaaaaactgcattttagctaaataatgcattttacacaatttgaaagcagttggtgctttcccattccagcacctttgctcaactcacctccctcacttgcaatgacttcctatcacctaccccaattaaattacttccaggcctaacccaaatgtcccctcctcaaaaagtctttctgcatcatcagagaggaattcctccctccttccatagaacttccatgacactattgaattgcatgtgccatgcattttctcttattaggtctgttttgtctttgctgctataagttcttagggagtagggatcttggatactacagaatgctttgcacagagcaggctctcaataatatacgtagcataaaaattgcaaacagaaagccaatctggaaacacattcactatgcccatgcagcagacaacacaaccaaagctcaagcctaagggagttctgccacttcacaaattacttaccagcatgaggtctagtgagtccttgctcagactcactggacgggtgaaagagtttgaagtggggttttaaaccatggattaaattgtgatgacttctatagtgattaaaataacctagagaaattaagaatttttttacaaaaaaatacaaatatcaaattttctaaactggaaagcaaagctgatcatttttaaaaccaggcagggctataacatcagtcttaagattctgtgcaacagaaaattgtagggctttaagatggatttcaaaggaatagtaaatttacaagatgtagaaagtctgatgtttgacgaaataagcttgatatatttctggataggaagataaatgtaatttcttctaagaaaagtttataaagtacatctaatacctttttcttttatggcttggcatattttagaaaccctttgtcattctgctaccattagaagtggtaatcgtggtcgttatgacttttgtgtggataaaacaataaatctgttctaaaatgaggcaaacaaagccaccaaatggcatgaggttgaatagaatgatatagcgacctctcaacattgctcattctactccattacagaaagacagattttaaaaacaggtatgtagtgtctggctatggaagaacagtgggtagttaagataaattctagtcaaggccatgacttactggaggtgctgtcaatgctgctgatgctatctgcgtcgtgcaggtggtgcctgtggagctgcttgtagagactaaatttggagaactttcttggctttcctattcctttcagttttgaatccacatcatcaatactcttctggatgggtaggttttgaacaggctcatttttatctttgagtcttaaggattccatagactccattgcggcaggctgagaaaaatttttttttaaaaaaagacactgcataagacatgctgcagtgtggttctttaattcaagtagagctgaagtataaagtttacaaatgatggaggttctataacagacatgcaataatgtctgaggtcagccacagggtagtggtggattcttgtgaactgtttaaaaactaccaaaggaatatgaggagttctgctatggtcttttttcagtaggccaaattcttgaaatttcactccaattaaacttttaatctcaaatacaattacatgggttacattcagtgttgagctcctgaacttgttcctctaataaacattaagtaagcaaggcttcctctgtcaatcattttccctgttccttatgcactaaattgctatttttgcataagttttgcactattttccagcagtaaataagatgaagcccatcaaattttttaataagtgtattcatattctggcagccatttagttgaaatagcaagcagattgatatacactttttttaataagtgtattcatattctggcagccatttagttgaaatagcaagcagattgatatacacatacagatattttggcagctctatttaaaaggcactttgggaagttattcacttctggctcaaattccctctaaatgaccccagactgacctatcctgtttttgtatatctttaagtaggaactttccaaaaactgtggcagatacttaaggctttttactacctaaatctcaattgccacatatttttgtttatgaatcttatttctgaataaaaaataaatcttaattaaaatggaaaacaaagctgaatatgggacagccaaaattccactgaatctgttttcttttcttacaagagaagaacagactcagcaatgctaagttacagctagctaggtggggaagctggtgtttgaaaccaggtctgtctcatgattgacttaaaatgttcttttcccctccaaggagacaccatctcttattcaatgaatcaatcagtcatgctactaatacaaacttatacaaattatgttcgtgttatacatttccataaaggttaaatatacttactgggagggaacccagagacggtcctgaagtgacccgcttcacactgcccacgtctgtgagtctgtgctcattgtcgtcccaccttccataggccaggtcaatccctcccacaaaggccaccgattggtcaatgatgacaagcttctcatggtgagcccacaaatagacggtggatgacacatgatccgggtgtctcatcaccttgagagggaataatccccactgataatatgcttttgaaatgtccttcctgtcataatgaaataggtctgtgttctccctgaaaagcattttctataattcaaataccaaactgtacaacgtatacaccaaagaaaataattttattctcagcatttagcaaaaagaaaaagaaaaaaaaaagactcctatttactcttcaagctcccacgcccatatactatattttggggcagccgccatttagcttgaggtctggcaatacattagaaaacagtcagctcaatttgaaagctggttcccttccccctgtaaggattatgttaaatctggtactaaaaaaaaagctaaaaatatttaactactatttatctctggaaaaatgtgtaatgaattatattgatattttatcagtcattgaattgaaatattaagcatatgaatataggcatatagatattttggcagctctttatttaaaaggtaccttgagaagttagtaacctcttgctttcaaaattatcccagtctgacctatcttattttcatttacctttaggtaaaaagattacaaaagctttggcaactactttcctcttttccttccttccctccttccttccttccttccttcctttctttctttctcagagactcactctcactgaggctggagtgtagacacgtgatcatagctcactgcagccttgaattcctgagctcaaacgatccttctgcctcagcctcctgagtagctgggactataggcgtgtaccaccatgcctggctaatctttttgttttttgtagatatgggtgtcttgctatgttgctaatgctggttttgaactcctggcttccagccaccctcccacttcagcttcccaaagcgctgggactacatgcatgagccaccatacctggccttactgttttcttaataacacattttttaaaaattgtagtaaagtaagcataacataaaatttaccatcttaaccatttttaagtgtacaattcagtggtatcagggtaatgagttagagagtcttctcttctcctcaatttttgaaaaagattgagaaagattggtggtaattcctcattaaatgtttggtagaattcaccaggtccctggcttttcatctgggggagatttttaattactgatcaatctccttaccagttaaaggtctatttaggttttctatttcttcatgatttagtcttggtagttttcttatttctaggaacttgtacatttcctctaggttatcgaattgcttacagtaatatcttagaatcatttttatttctgtagaattggtagtaatgtctctactttcatttctgattttagtaacttgagtctttttttttcttagcccaccaagctaaaggtttgttgattttatcttttcaaaaaaccaacttggtttcattgattttctgtattatttttctatcctctggttttatttcccactgctccaatctttatttccttccttctggtagttttaggttgagtttgttcttctttttctagttcctcaaactgtaaagttaggttgttattttgagatctttcttcttcttgcaagtatagctgtaaatttccccctttgcactgctttctctgtgtcccataattttggtatgttgtttcattttcatttgtctctaagtattttctctttcccttgtgaatttttgttttatcattgcttgtttaacagtgtgttatttaatttccacaaatttgtgaactttctagttgtccttctgttattaatttctaacattatcttgtggtcagacagatgtttgtatatctaccttttaaaatctattaggacttacttagcagcctaacagatggtcctggaaaatgccccaagtgcacttgagaagaatgtgtatcctgctgttgttgggtagaatgttctgtatgcccattggatccagttggtttactgtacgttcaagtcctctgttttcttacttatcttctgtctggttgctctaaccattactgagagtgagatgttgaagtctccaactattatcatagactgtctttttctcctttcaatcatatatttcgattatctgttattaggtacataaatatgtataatttttatatcttgctgtattgaaccttttattaatatataatgtccttctttgtctcttgtaagcatgttttgatttaaagtctattttgtctgatactagtttagccactcttgctcttttttggttactatttgtgtgaaataccctttccatcctttcattttcaacctatttgtgtctttgcagctagagtgagtctcttgtagataccatatagttggatcatggtttcttaaaatccagtctaccaatctctgttttttgattagaggggtcaatacatttacatttaaagtaattatttgtaagatacttctgtaattttgctactattttctactacatgtcttatagcttttttgtctctcatttcctgcattactgtcttgttttgtttggttgattttttgtagtgacatgtttaaattcctttctcatttctttttgttaaatagctatatatttgattgctattttctttgcagttaaatgtaacatcttaaagttgtaacattctaatttgtatttataccagtttaacttcagtaacatacaaatctctgctcctttaacagctcttccctcacagttgttggtgttgcaaaattacatctttagtgggtacttgatagaaatttggtgaatgaataaataatatatataaattacgcaacctaataaatcattctttgggagaaaacactttcattttttctaaccaagtgaaacatacaattgttacatattttaagcctgctggaggtttgttaattcattatgtcttgatgtacctcaatgactgggttatatttattgataggttttagatattggcaaaatatcaaagaactttttcaaattgcttttcatgtttatttactttattagtattttatactaggtgccattgattttttaaggcattttaaatcctagaggagatctctttgctgctatcagtgatcaggggatgtcacagggagatcacatctaagaggttccaggataatgagaagtgtgagaacttgatagagctcgtgaatatcaaaacaactgcaggaaacatgttcttgtctaaactctcactttcaattatcagagtcagagaagcagaaatgtgagatctgcttacccccatcaatgtagggaagataagaaagtacagtattttgctttatttctgaggacacaatgctatttgatcaaatatacatttgggcattctatagattattactgcccagaacaaaacatacctgaaaaaatcctatagaataataaagaaacattggttatcaagatgaacctgaatacctttatgttgggatgtagacgcatcaaagtcctcttggtgtattcactattgatgccaagagcgagttccacctctttgtagagcattatgaagatcctcactccttgttgctgtcacaggagaaaaccgatggaggaatgagtatctctggagggaagttacaattcattttctttttcctttgcactgtactttctttcttttttttttcagagtctcactctgtcacccagcctggagtgcagtggcgcaatctcggctcactgcaacctccacctctcgggttcaagcaattctcatgcctcagcctcctgagtagctgggattacagtcgcatgccaccacgcccagttaatttttgtatttctagtagagacaggatttcgccatgttggccaggctggtctcaaattcctgacctcaagtgatccacccgcctcagccgctcaaagtgctgggattacaggcatgagccactgcacctggcctgcactgtactttctaacttcttttataaacaagtaagataaaattttaatgaaaaaggcaatacaaggaagtgacacataagtgcgtatattgagacacaaatattaaaaataaaaatctatctcccttccattcttacaactggtcatatcaagaaagaatcaataactgattaaagatccaaaacattgaaaactttagtataaaatggacacccaaattcaattgattcatccttccttagaccttggatctaaaagaaaatagacaaggtcaccgtggcctatttaatcgagtcaaattaaatcaaaagtgccttgtagatgctaacatgctatacaaataatacaattatttaacaatattaataatcaaaaagacaatgtccaatccttttgtagttcatgagcatgatgattgtgtgttcacacacaagcgtgagatgtgccacactcgaaccttcttacgacgtctgcacattacccatctcatctgaaaaaaagatttaaacaaaaaccaaaagaccaggtccaatagctaatagtatagaaaaacactggtattttccattctagttctggttggtgacaggctttcaggctaggctaaactgccccttactggaatgctcctctccttctgcttgcccactcatggatccccctccaatgtatagttcagaatgtattacctccaggaaactgtggcttattcacccccaccttgtggattgctttttttactttttaggcttgaatcctccttatttttgtatagtttgcaccattttaatttgcattgtttgcacccagcagctctgaaagcattctgaaacattttgcatatatactggattatgtatctaaatgacacctggcatttaatatcgtagagattaaaggtaaaaattttccataatactttctagaatattacagatgcaggtgtatttaataaaccataataaaaaataattttgttacagtttatattaagattccatggtgattagtcattgtttataagggaaatttgaataaaaatctttaagatatcttactgggttgaacacacctactttacaagaactaaaactttttgtaatgctatacgatctaacataacataggagttaatgtttttagattctagatcacatcacaagatacaaaatcttagagcaaaccaaacacataaacatttctgtaatattgttctgccaatactaaaaagcacgttttggaccctaaattccttataataacacaacacttcaaaatactaacactctatttttcatggtgttagtaatatcttaaaggtgtatgtatttctggaggtgcacactagatttacattctggtgtgcattaacaagatttgagtactaggagaagactcattcttgctctaaaaaaagcaggatcaagaagaatatatatgtcatactatttctctggttaacagctggcttttagtacttgctaattatttattataattatgcaagtactattacaatcaagaatataaatacatatttcagtaaagaagtaaaagcataggcagaaagtgaacagattaattttaatggtctggccagagagtgctctgtaattaaccactgatgaagggctctaaaggaaaattacaatattattttatttttctcctctactgttcagttctatttttggtatttgaatattttagaattcagcactgaataatggttacaaaaaaaaaaaagcctttcactaaaagatataatacaaagggtaaaacccaaaatttcaacctaaatagtagaacattacacctgacattcttcatcatgacccatttattttaagcagatgaaattctgcttcttaggcttaagacattattactcatgaagagtagtagttgcaaattaggaacttggcctgaatcctacagttttctactcacctgcataactaatggatttttgaaataatagagatattaacactaatggaatacattactactctccatttattaatacctgacatttcttctatactgtcttttctcattgaaataattctaaaggaaatagggtagagactttgtctttttagcttaaagacaaatgaccaatgaggaagcaattaaagatagaaagttcatttgtatgtggtttataattatttacctacacctatagccacaataaacagttaattagtgacaagattcctgtgataataaagcaatgcattcttcttcttttggtcaaggtattgactattataaactctagccataaagggcaaaggcgaatgaatcattccttggggatgaaggcattttccaggttgttatagtgtaggcttatacaaaatgtgggaaatatttctgcaaaatgaaagccaaaggaaaaaaaaacctgatgatgttaattctgcaatttaaaaaatacactttcaaaacatcccatgctttagtgcctagtgcctttaaatacccttggggaaattactttttgcttaaagaaagggacggaaattattaataggagaagtagaaaaacagatggcctggagttgcctatgcaatgcagtgtttcttatctctggtgaactcagctgacccaaagtttccatagaataaatttcataaaacatgacttttaaaagatgaaagttctgtcctcttttctaattagttttttgtcaagtagagcagacataacactataaacagtagaaatctttaggagctttagatattcaaactacatgggaagacaatgaaaagaaaatttttatagtggaaatcagtgactttgtttcttagccaacttttcctccgattgctcaagggagcatagtgaaaatattttctaaatgcagccaagtttgtccactgcctgaagacagtttagcccaccccacccccccaacccaggatgctcactaatgtttttgtcacttgccaaggacttccccaatacaatatattaagaaaatgtaaagatgtaaagtaaaggatataaagaaatcacttcctcaccgtttaaaagcaggcagcattgggatataagagcacaaaagctcatgtgcctttttttaaaatccaattttgtttgaagcacatttttgaagctgaagataccttccctgcaagccactgttgcccaccactttgataagactcatttgattttctgtgtagagatgtgattattcctgtcatttctcagttctggacaactttcccttttattggtcactgactgcaactctacattgtgccttgtgatccaggacagaaaatcaacctgaagacaaattctcccattagtctaagtttcataggaaatatcacaagcttctaaggttgagatacacaaaattgcgtgtggggatttggctgccataagtatgatgcagcttatctcacctcttagcatagcaagtgcagaactgtggaaagccctgagatgctgatttctttgagttgtgaacagtctgcctctgaagattggcttttattattttaaatgatggcattgcagatcagaaggccaaagaaataggagaagttcaacttggttattaatcagatacataaaatattctattttttcttaagaaacagccatcataagagatgtttgccatacgttggctataaggcagagacagttcctaaattcctctcagaatatctgcacaatcagatagaagaaaataaaacattcattttaataaaccttgtggacctctgggacctgttaatgcaaaaaacaaatattatgtttcaacctcatactttgcaaagctagtgtgtggctttcagaaactaaattatttatgtgaagccatatttatgtgcatataaaatgtcaatttggagtgatccgagtgttaaaaaatttatgaacaaagtaataatatggtggaatgagattaaggaagagcaactccgctaaatgtaccaccaagaaatcaatctttaattgtattactatttctttaggaaattttaaatatcgctacccacagtttaaaaattaccagctccaagaagtggatgaaatggaaatgaagcactgttatcaggcaataacgtttatttggccatggtgttcacgagggacctcgccagggttcaagggccaaaaaagtaaagagaagtcacactagacacagaaaaggtaaccagacaggtatgccaagggcagtaaacaagcgcatgccagcaaacaagaggtggaagccaggcctgcaggatcttcctcctgagccctaccgaggcatttactagctttctcaagttaacttagatgtcttgtagacactgtatcttcaagtgatctaaactttagctttctgaatcagctcttcccagtttcttccactatcagagtcaccttccggacacctttttttttttttttttttttttttgaaacagagtcttgctctgttgcccaggctggagtgcagtggcacaatctcgactcactgcaagctccgcctcccgggttcacgccattctcctgcctcagcctcccgggtagctgggactataggcgcccgccaccatgcccggctaattgttttgtatttttagtagagacggggtccgacacattattttgatcagaccacccctgcttccccacaccgccctgccccgcacagtactgccccactgtctcccataaagtcaaaccactagcttggctcacaaagcctctgcatcccagctgcaactagcagttccagcttaatcccccatccggctatgctaacactcagatgtgatgaaccaccctaccgtgcctgacaaagtctttggcactgctgtttacatctactacacctagaaagttcttctttcccttttaaaaatgtttgtccatcctaaatgccccacatccttcatgttgtgtggagctccccaactggaccttttccattgggaaagcccaatgctttccctcttgccattaaatcggggcattgtttctgcatgcaactgacacttctgcagattttataagctccttcaacttaagaatcatggcttttatttatgtacatcctcatatgattagccaaatgccctgcacatagaaaacattcaataaatacatattgattgaaacctaaaacagtgaggtgctgattaaatattataagcaaaaatttactagtattagtacagattgctacgcaaggctggaaaaatgtactaaaatagaatcttgagggaaaatggaaaagatgccatttcattgagagaaacatagagaaagttactgcccattcaataggtagaaagtagtctggtaaggctaggactgagcccaagacatgagtccctcagcaagttcgccactggcaaggttcaaatctgattcatggtggcattcttagtgattaccgtagaagctggctcataggagacagtaaccgtatgatgaattatttaataaatatgtgaataatgttttcagaatcaaaatgtccaattctgtaactggaattctattgatgaaacaaactagactatccatcaaaatgatgttgtttggcagaatgtgtttcaaataaatattatcaatttcttttgctttcaatattagcagtgaggtctgactatatttgtggatatccccagaaatactcaagtaaatgcatggggaaaagatacagaaagaaaaggggaaagtgaatggggaaataaaaagtggaatgcagaggataggaaagaagaaatgagtgaaagctatgagaaacagaaaaatgctaaccccaattatttaggctccacacgttctgctagcatgtttaatgacagaataaaaaaaggttggccgggagcggtggctcaagcctgtaatcccagcactttgggaagccgaggtgggcagatcacctgaggtcaggagttcaagaccagcctggccaatgtggtgaaaccccgtctctactaaaaatacaaaaatacaaaaaaaaaaaaaaaaaagccaggcatggtggtgggcacttgtaatcccagctatttgggaggctgaggcaggagaattgcttaaagctgggaggcagaggttgcagtgagccgagactgcaccattgcactccagcctgggcaacaagaacaaaaccccatctcaaaaaaaaaaaaaaaaaaggttaagacagtttctgataatagcaaaaagttagcacttcctaatttggacatgctaaataataaatcccagatctatttttaatttaaactgatttaattttaagggcctattacattaaaaaaatcactagaaatatgaatgcagtcattagtgagcctaggctgcttcagttatttactttttatacctaaaaagcacacattcaatgttcacccagaatgtacagggtcaactccacaggaaacagtttcacatttttaccaggaactttaccaaaaccagagaaaaaacaccaccaactgtgactattcctccccctttaatattattctacaccacattagccccatctagctgaaaccattctccagatgagttttccttttgcttaaatgacaaaataatgaatacaattaaatgctatgctccatttcatcatttattattcaatgatgaaattttattataatttttttgcctataaaattagctgcccataactgattcaaaaataagaattagagatgctaacataatccatgctgtgaattagtctaaaatatttatgcactcaaaagcaataggaataaaatagaaccaaatgaactggaaaacattagttatcctactttttgtcaaactctaaagtgaaaagttatacgtgtgaaaggctttgaaaagaaaagcatttcagagacaacagacagttaaaaaattatatcagcattttctgggaaagtacatactgcttttcgtttaagaatgcagtccaacctccaacgatttccctcaaccactgggcgtttcaggaagatttctggactcagcctgaaacaatgaaaccaagattttaagtaactaaaacaaaatataaagttctgattgtgtcataggaagcaaaggcaatttcagcccaattcaaccccattatcatcctccattgtgatgggtaatccaaagctttactatgagtctaggaacaacttcgtatgggaaaaatagcctttagctatacaaaacatcaatcttagttctttctctctctctctctctctcccccctctttaactgtctctcatacccacatgctcacatatgcacacaggtactgttggttgcccacccacagccaatctccaacttcttccctgctctcagagcctctctcccaccacagactgaatattctagatacttgctttcccagactcctgtgcagctagagcacaacgtgacacaatcctgaacaatgagatatatgaggaggtacacaggggcttaatgggaaagtttttcctccctgaaacacacacacaaacacacacacacacacacactctctctctctctctccctctccctctctttcgctctctctccctccctctcttttgctctctctccctctctctcagagaaagccctgcccacacttccagctttgggatggatgttgtatgggagtatgatgcttacaggggtgcagcaatattgaaattctaaggggaagaccataaccccagaatcactaaatcactctgccaacctcaggattgcccaactttagacttaacattaaatgtgaaaaatacatcctcagtgtttaagccctctttagttgaacattctgttaccccaaactaaaagcattctaatagatacacagacacatgacttcctatacaaagaagcagcatctgagggaacctggggctttctggacaggggagaaggaaggtcggctgatatatgaaatttttcctaggctcttctccttcagtaaggcataaggcagctaaggtaagctaagcttcacaaggcagctaagagtacaatagagtcatttttcccctggggctgggttctaaagttagtttctgagttaaacatgtacatgatgtaacttccctgtagttagaaaaaagaagcagtagaaaatactcctttctccactgaactgctagacctgaggcagcagaggtagactatgtcaggatgaaagccttatggaattctgcactggagtattgccctcccaggcagccctctaagcatgtgaaatcaacagtgctttaaggagctaaagagattaaaagaaatcaattttatgctctatttcattcagttaaagaaaataaaaacccagagataaagtttctaaaggaaacgttattgggtaaaataaataaggaaacagacaaatggaagagtttggacagtgtaagtcttgcatatttaattgagagtaggaaacaaactcaaaggtaatctatgtccaaacaagcaaacaaacaaataaagcacagcaattgatcagaaaagatcaaagaagcattaaaaggaaatctgttttaaaatagtaaaatgcattgctgtgcactgctagttcaccaaaagtgagagatagccaacaacatatatacaattgcaattttttgatgtgtacattaaatatgggctcaaagagcttcggtatgggggagacttttaatgtcatactctgcaattaagtatttatcatcatttatttcatttaatccacaaacatgtgtacccttgtatgctaagcattctacaagatactttgaagaatcttaagatagctcttgaggagccctcaattttgaggataatgcataaaaagaaaaaaagattttgttatatcatgctataaaagtataaaccatggctgcatggcaagaagaaagcagctataacttaccaagcattattatgtaagaatctttacttacttgtaaacaaagttattgtttaatattacatttcattggatctaggacaccagtgactgtaggatgcatcgttactgcatgtaccactaagaaagaaaacatcatgacaactataactgtaagagcataagatgcatcctgattgcggagatattaagacgtacctctaagtaagtgtaccacttagaagatttaatgactttaaatgcttacatgagaaagacaaaaaattaaaaattaatgatcagactttcctttcttaaaagatagaaaaagaagacattaaacccaaagtaagaagatgggggaataataaatataagagtagaacttgatgaaatacaaacctgaaaaaatacagagaaaattcaatgaaactagatgttgactctttgaaatatcaataaaatttgtgaacttctagcaaggctaaaaataaatgacaaaaaaatgattgaaaggatgggctcacatgtataaacccagcactttgggaggctaaaatgggaggattgcataagcccaggagtttgagaccagcttgggcaacatagcaagaccctgtctctacgaaaaaatttaaaaaattagccagacatggtggctcatgtctgtagttccagctactcggggggctgaggtaggaggattgcttgaacctagaaggttgaagctgcagtgagccacgatcatgtcagtgcacttcagcctgggcaacaaaggaagaccctgtctcaaaaaaaaaaaaggagtgaaagacaggtaatcactatagggcctagaggcattataattatattaaatgaataataactattaaaaataactgtatgccaatatttgtggtaatttaaataaaataaacatattccttgaataaaatattttcataatgaaaataaaaagaaattgaaactgacttcatagctattgaaaaactgaatttgtaattaaaactttcctacagggaaaactacagactttgccaactttacagaatttattaaacatttacagaatttattaaatatttgaattttatcaaatatttaagaaagaaatgatgctagtactacctaaattctttcagtaaacaaaggaggaacacttactatcttatttaatgaggtcagcattatcctgatactaaaaccaaataaagacaatgcaagaaaactaaagaacatcccttatgatcacagaagtaaaaatatttaccaaaaacacagcaacttagaaaaataatactacatcatgatcaagtgggattatcctaagatataaggttggtttaaaagttggaaatcaatcagtgcaattcaccacagtaacaacaaaaaggagaaaaacgttattattcaacaaatgcagaagaaatgatgaaattcaatatccattaacaataaatactcccaacaaattagaaatagaaaaaaacttccgtagtgtaataaagggtacctataaaaaaatctatctctaacatcacacataacataacaaaactgcatgctttcctcttaagattagaaacaaggcattctcaccactttcattcaacattttactggtgatactagccaatgcaacaaggcaagaaaataaaatataaagcatacagattagaacagaagaagtaaaactgtctttattcgtagatcacataatcatctataggacaaccctaagcaatctacaaaaaagctaccagcactaataaattaatttagcaaggtcacaagctataaggtaaatacacaaaaatcaattgcatttctagttctgtatggaaaatgaattttaaaatataatttacaataatatcaaaaaacataaagtactcagtaaaaaatttaacaaaatatgtaaagacctatacatagaaaaatacaaaatattgctgagaaaaattacataagagctaaataagtggaagcctcaatatagaaaaagaagtaccacctaaccagtggtaagtttaacatttttctccctttgattccttgacttggagggaaaacttggaaacaggcattggcacagagagaacttcaaaaatcctctagttcaggcttggggagaaagcaaaggatctctggtagtgacagggttgcagtggaaagcccaaagttactaaaacctctgaggcaggggaaatctcctctccaatggagatgtaaatacacctggcttggctctggacatgggtgccatcagagaaagcacattgcagagcacagtaaataaaaacccatctttctggctagaagactaaaaagggaagccatgggaaactaaaaattggggagaggagctcagaaaagcagctccataaagttgtttctgatttcctggctcattcccaagctgcctatgcatggatttcatcctaaacatcactccaaagaggctgagaactgaactgaggaatagaccaccaccgaagtcccagaagggccactaggtggcacacatatggggcagatctgaatagcaccacaaaggcattaacaacaaaaccggcattaaaacaacactcataaaaggctggttggaactttaagcctgaactgaaattggtaaattgcctgctaaaacaaaaatactaacattctccacaggattcaaacaagactcaagagtcttataacataataataaaatgttctagaatacattaaaagtacctggcacacaaagaaccaggaaaaaaaaaaaaaaaaaaaccttatcttgtacagaaaagggaatcagcagatgtcaataccaagacgacatggatattgaaattatctacttaaggctatgtcagatattataaaaatgctctaataagggtgaacactcttaaaatgaatgaaaagacaaaaaagtcttatagaaaaagatataaagaagaaccaaataaaaattttcaaagtgaaaaacactattaccaaaaacactagaaaaacaaaagcaaacaataaattccccaaacctcacaggataggctcaataccagaatggagatcatagagcagcagtccccaacctttttggcaccagaaaccggattcatggaagacaattttttccatgggtgggagctgggggtaaggataatttctggatgaaactgttgcacctcagataggccagcaggcaccagttagactctcataaggagcgggcagcctagattcctcacatgcgtagttcacaatagggttcatgttcccacgagaatctaatgccacggctgatctgacaggaggcggagctcaggcagtaatgctcatgctcgctacctcccccgacaagctctggctcacctcctgttgcatggcctggttcctaacaggctggggaccagtttggcttggaggttggggaccctgtcatagcggaaagagtcaatgaatttgaaggcaaataaataagatactatttgtgtcactgaagactcagaaggaggagagaaagaggaaagttcagaaaaaatgtgtaaagaaataatggctaacaatttcttaaatttagcaaaagatataaaactacagattcaggaagctcagagaaccccaaacaggataaacccaaacatcataaccaaactgctgaaaactaaagacagaaggaaaatattgaaaccactcagaggaaaaataacacattacttagaggggaacaatgtcttcaagagatggaaaatttctcaacagaaatcatggaggccagaatgaaatggaacaatcactttaactagaatgtacaaatacctcctacaactaaataagaagactaacacaatctccctctcaaaaaaaagggaaaagatttgaacagttaaaccaatgtccaaatagcacatgaaaatttgctcaacatgaaacgatgttgctgatacaagctaaaatcataataaaacactactgtataccctttgaaataaagactgacaacatcaagtgctagcaattatgtggaagaattgaaactctcatacattgctggtgaaaatgtaaaatggtacaactttggaaaacactacatttagctcttagtattgataaaatgtggtaaattaaatctatcttctaagataggtgtcaacaaactatagctcacaagccaaatgttgcccatagactgttttagtatggcctgtgagctaagaatggtttttatatttttaaagagttgtaaaaaaaatatgcttcagagaccatacatgatttgaaaagcctaaaacaaatttactctcttgctctttaaagaaaaaggttactaaccatttttgaaagtcagtggctttaaaacttttaaacttttggaccataagctgcagaaagaaatacattatacacccaaaccaacaccgggtcagtcagtctatctatctatctatctatctatctatctatctatctatctacaactgatataaaagtttccaaaattagtagcccttattaccacttacattgtaccctttctttcttttcccttccctttcctatcctatgccattctttttttttttaaatgctggtcacaacttaccaaattattttaatacacaattactaaagaggctcaacccatcatttgaaaaacactaacaatattaaaaccaacttaaagaatgttgcatttaaaaccaacttaaatacttttaaaacatgtattcttttacctggaatagtctttgtttgtgagtcagttagtaatgcaatgctgatttattttctttataacctttgtctccggcccaacctttgtctcttctgtttctctaccctttacaaacaccctcttttaaaaatctctgttcattgtttttcttttgtattctcctgttttattaattctatttctgacacatttaacatactgactccatacagagactggtagataaccccactctctcagatctacgcatactagtgtttggttaagtttctgaatgctcctttttgcaatatgcttgtacaacaagaattttctttacttgtttgagggaagttactgtgaaggttttatttctaatgatgtgttgtaataaaatggtatcctagtgcagtcgtgaaaaataagtaaccccgattcattctcttgctgaaagtagagaggaaaacattcagagttccatctctttatatgtttaattgaatcaacctaaatgaccatcaatggtagactggatgaagaaaatgtggtacatatacaccacagaatactatgcagccataaaaaagaatgagatcatgtcctttgcagcaacatggatggagctggaggccattatccttagaaaactaacacaggaacaaaaaaccgaatactacatgttctcacttataagtgggagctaaatgatgagaacacatggacacatacaagggaacaacacacactagggcctttcagaaggtagagggagaggatcaggaaaaataactagtgggtacaagacttaatacctgggtgataaaataatccatacaacaaattcccatgctacaagtttacctatttaacaaacctgcagttgtacccctgaatttaaaagttaaaaaaattttggtgttcagacataaagcatgaaaatctaggctcaatagaaaaattatttttagtctctctcacatcttcaccaaactttcagaaatattttttaaagaatatagtactcactggcacaaatttattatcacaagtgttcataaaatattcaaccaaagaaatagctcctaagcatgaaacattttttcctcctagtaactgactgaaaagacaaaatttggtaacaatagaaagaccagaattaagctcctccacaagcatgagcatgctggccaccacataccctgtctatcccctctagatcagtgattcccagccgacaaggatcttgcatcctctcccaaccccaaccagggaacatctagcaatgtatgaagatattatggtggtcacaactgggaacttactactggtacctagtggatgccgctaaacaccctacaatgcataggacagccccctacaacaaagaattatctagccccaaatgtcaacagggcaaaggttaagaaagcatgccttataattatagattccagacaaccgaagcaaaagatgtgtttgcattcttgaattagatattgatattgcccacaaaacctagaattagaagggaataaattatgatgatatattaacagttcctataaggtaccttttggaagaaaaccggatagagtaaaataaggggtaattcaggcaactactactaagttcctagaaggaaaacacattttagacatttccatatccatcgtagccagtgttggcatgtgtaatgggttttaactttccaggcagatgaatgattggaactgaagtcagactagaatgcctacaccaactacaggagtaaatttcccaagagttaaatgagtttccgatatgaggcttctggtgactttaataagcatagcaactcttatggatatttttttaaggtggtcacaaagttgaaaccggatgtatctctagaacagctgaccaggcctagtcattacagaggatatttttacggtaacaggcaagtggaactatttcaacatcaaaaggacaatttagaagaagtatattcactggccctcatgacagacataccaaaattagaaaaagacatccaaagacaccattacctctataactgtacttgcattacagtataatctttactgacatgaaaacttggaagtctgcttccaaatgcaaatataaaacctaattgttcaaactaagtattttatgaatattgttgaggccaaggtttttgaaaaggcctttcactgaaggcttagtcaactggttgagaccctggccaaaccatccacagatacagctgattttcataatgtgtaattcttgaacagcactataccactgtacatttctaaacatagagacttccagaaaaaaattcccagggacaaatactaaccaccagtctgtgataaaaatctcttcatttgcctcttccattgcatttgccacatcttcaaaatatcctttggcattaacatacctgaaagacaagtttattgttcctttttgttattaaaaaagaaaagaaaagaaacttatcttatggtaaagcaaaacatggaagccactgcctagagtctccacataacacataaccaccattgactttgtggacctggaaaacaaggattgaaaataccaagtttcctctgctgcctaggaagggcagtaagtgtaagcagcctgatttttctctgcttagagaacaacaaatttattgagcctcatcatcataaggagccagattaattttcctatcctgttgaacttacatacagtttttcttacatacagttctgagactgaaaacaaactagcttccaatccacgggtagaaaaacatgctaagcatgactttatttaaaagaaatatctagcaagtaaatgctttttcctaaattaggggtaatgacttaaataaaccttccatttgcatcattaaagaaatgtatgaagttagctttaaaattcaaacttcaaaatctaaagctagctaagctcactgtgaaaaatcttaaaagcaacaattgaaaaactaatctataatcaggtagtcccataattatcacaaaaagagaagcccttgttaagtataatgcataatctttcacagttttgaaaactgattccaggtgaatttaggccagtgtaatattagatgctatgactgccttgacaggcttagagaaataataacttaccatttagctaaagcattctcttggatagcagcatatgacccaaatcgatgatctttgagaaagttggtgccatgtttctggatgaattcttctatagcccctccccaccaccgagcatgtctatagctgttgcattttaaaataagtgtcctttaaagaaaaagccaaatattgaaaagactggtcactctgttctatctcatgctcttttttatttggtaatataccaaacacaaactgaaaatttgaggcaaagaacatcaagaaagcaggcatttaacattttttggtagtatttctaaaaatatattcaatataacaaaaataaatgttcaggttacttattcattcactcatgcaaacatgcataaaggtacttaccatagacctagagctgtgtgctaggccatgaggaggataaagaaagaggggtaaggtgaggttctatttttaagtattagttagagagctgttggctcccgtacagcagcggtccccaacttttcttttttcttttttttgagatggagtctcgctctgtcgcccaggctggagtgcagtggcgcgatctaggctcactgcaagctccacctcccgggttcacgccattctcctgcctcagcctcgagtagctgggactacaggcacccgccaccacgcccggctaatttttttgtatttttagtagagacggggtttcaccgtgttagccaggatggtctcgatctcctgacctcgtgatccgcccgcctcggcctcccaaagttctgggattacaggcgtggtccccaacttttttggtaccagggacaggcttgtggaaggcaatttttccacggatgatggggagtagtttcgagatgaaaccgttccacctcaggccatcaggaagtgatatgattctcgtgaggagcgcgcagccgagatcccgcgcatgtgcaatccacaatagggttcgagcttctgtgagaatctgatgctgtggctgatctgacagaaggcggaactcaggtggtaatgctccctcgcccactgctcacctcctgctgtgcggcccagttccgaacaggacacggactggtaccccgagggggttggcgacccctgctctagagggcacttccccttgtgctccctagtatccattccctcagcttctggaaatatcatcccaattgtgcttcatgacagccatcccttctcttcaacaaagctaagcaaaatggcatattccatctttctggttccagaaggtggttctggcatgactatattgtgagttttctatttcactaatcataggaaaactgttctttttttttttttttttttgagacggagtttcgctctgtcgcccaggctggagtgcaatggcgctatcttggctcactgcaacctccgcctcccgggttcaagtgattctcctgcctcagcctcccaagtagctgggattacaggcctgcacctccacgcccggctaattttgtatttttagtagagacggggtttctccatgttaggctggtctcgaactctcaacctcaggggatcggcctgcctcggcctcccaaagtgctgggattacaggcatgagccactgtgccagccttttttttttttttttttttttgaaatggagtcttgctttgtcaccaggctggagtgcagtggctcaatctcggctcactccaacttccgcctcctgggttcaagcgattctcctgcctcagcctcctaagtagctgggactacaggcgcgcaccatcatgcctggctaatttttgtatttttagtagcgacagggtttcacaatattggccaggctggtctcaaactcctgaccttgtgatccgcccacctcggcctcccaaagtgctgggattataggcgtgagccaccgcacctggccaggaaaactgttcttttgcaataataatcaattaaacatattgataccagaaaaaaaaggatactcatgtacatttgttcatcgattcctattaacaaatggacatgagtatcctttcaggcattcctaagcaaatgtgaggacttacttgctcaggaatgccaggaagggactctcttgcttccacagaatttggtgtgagtgtgggaggtggccatcttgctaccacaagggaatcagtcatgctcaacatggctgattagttctctttggtataagccagtttgctttagatttttctgtcactcataactaaactatcctaaactcttacagagttataaatgctaaaaaaaaaaaaaaaaaaaaaaaaattcagagtggattacagaaagttttttcttaatgccaagtgtcagaattctgcctactactaagagggaaaaataagttatccaaatttgaagtttgaaggaaaacagagtgttggagccagctgtatccctgccatgtaggcagaaatctaccatcataccaatgtaagaagactatgcgtgaggagggaggttgcttttttgaggaaatgcaatgatcctgatgagacgcagggaagggggctgtgttcacagattctaaaagaattatttataaagattagccatgtccaacctgctttcctcaatatgtcagaggtagatgctggcttttgtctgaaagtcatgaagacagggagaggctgctgctgctgggctgtggagacaggggaggagagacgtggtggagctgagaggagtgaagcatccccatcgcgtgtggtggagacacgggtttctagggatggagacgagagggcacaggaggtgcctgggcttgacctatcctgcaagcactactccaattgagctaaaaagcctcggaaaaacagttatgagaagactttacagaagagatgagtaacaagataagacattatcacaggatgtgagtcagtatcaagggggaaaacaagaactattccaaacatggacataagaaaagcaaagggaaagaggcaagaaaaaaatgctgccttcatagaacctgcaaggcgtattagggaggaatttcaaataaaggcaggaaaataaatgcccttcaaaaataagtgggggaatttggccttatttgataaaatcatgggggggatcttacaccaggaaggaaggtaatgaaacctggatgtgaatggcctcatttggcaatgacatacgggtaagtgagggtgggaaatgcagatgaagtggccaataaagtaagggaccagtgagaactgtggccagacttctgtggctcactgtaaaacaggaatgcaggaggaaggtgtaatggcagcaccattatatttccagtcacaatcttaaatgttccattctcatagaatatcatcaggaaggtcagcatctttttatacacacacacacatacacacacaaacatgtaaatcagtaagggaatatgaagctatgttggtaactatgtgcacagggagaaatgcatatatattcatatacatgatggtgaatgaactatacagagacaaatggatatatatgtataaagacacacatacatggtataactacaatcttccagaaagatcacatacacatgtactcactaataaaatctataataaatgtacatgagtgtcctttcaagatatctttcttggccaggcggagtggctcaggcctgttatcccagcactgtggaaggccgaggcagacagatcacttgaggtcaggagttcgagaccagcctggcaaacatggtgaaaccccgtctctatcaaaaaatacaaactttagtcgggggtggtggcaggcgcctgtagtcccagctactcaggaggctgaagtgggagaatcgcttgaacctgaaagatagagtttcagtgagtgaaggttgcagtgagcagagattgcaccactgcactccagtctgggtgacagagtgagagcctgtctcagagaaaaagaagatatctttcttaaaatatgtgtgtaacaatttttataaaacaaatcactcttttggtgttttgttaattaaagaatattgatttataaagtaaaagtttcatttattttaaaaatgtgaactattgctctaatctatctgtttagtaaactggcaaattgagtagtaatttctgttaacataggcaaacatctacatatgggattgtttattcagactgttgcacacaggatactctttaaaatatatacaaggaaaaaagtggtttcattactattgattgaggatgagctctaaattacaattttctaacactttttaaactccttttttacttaaggttgagaaaaaaatgtttttaaggcatttttgtagaaatcttttttaaatatttgaaatgtgtaccttgaaagattatcaattcggattccatatttcgtttctgtctccttcttccccaccttaattttgaattctttgtctaccagcaggacgaaggcaatggcaccgctgtctggtttcatatacaataaaaaggaatctttcactattaaccatctgtaagaaggtagtaagtatttttaaaagttgcattgagtaaataaaacgagaagaactaatcattatgacaagtcttaagtaatcactctggcagactgtagacataattacattttctacacaggagatttattttttttaatcgctatgaaacaaacaaaaaaaacccaacaaaacctttctattacgtttttctaagaaacagtgtaccaagtaattcacagtaattcattagctctttaaacactaatggcaaaactggaggaatgtccctaatattggcaggtagcactcacaggatgtacgacaggaagggcaagactgaggagatgggatccatttacagtgaatgcaaatggtaacttcatcaggctgcatataacaacatgtattcctatttgcctgcaattgtagagtgatagactgaatcatttgaaaactgagaagtaacaaagtgggcataatagtgcataccagacaaagtaaagcactctaggcacttccacattatggaatagtaaggttggaacatctgaatataaactaagtaatactgtaaatatagcatgggaactcagtatttaaaatatatctataataaatctttactgaaattgggaattgcattatgttttaatggctttataacttggaatttaatgtagacagacctacattgatttccacatagtttcatttcattaatttttttttaatacataagttatctccttcctaataaaagggcatagagtggatttaggataacttatagcaaagaacatatgtggtatggttcagaaaaggaaaaacgtcaaggtcacagaaagtaaatacctaaaatacctaaccacaaaggtaaatataattacagagatgacacactcatgtgggtgtaagcttcctagtttttcttgtcaaatgaataaattaaagaaataagtggatttcctccaaaactaaattccaaacaaagtttctcatttgggacctaacatgatacaactgaacaacataatgaataatattcccaataacaattttcaaagcaaacacagaaattatacattttataagagttcttataacactcctcaatacgaataccaaggctatgatatcaaagggtaaccccgttttcccagcactgtttactgaagagtgtgcactttccccaaagaatgttcttgatgccctcggaaaaatcagtaggctgtagatacatggattaatatctgagttctctattctgttctactggtcatgtgtctgtttttataccaataccatactgttttggttactatagctttgtaatatattttgaagtcaggtagtgtaatgcctctagctttggtttgttttttgtttttgttttttgctcaggattgctttggctgttcagggtcttttgttgttttatgtgaattttaggattgttttttctatttctgtgaaaatgtcattagtattttgatagggttgcactgaatctgtagattgctttggatagtatggtcattttaacagtattaattcttctgatcctcttcagtttttttttcatctgtgtcttgtagttgttctttttactagtcattagatatcaaggtaatttgatgctgggcttttattgaaagctcttctttattatgccattcataaaaactcctctgatttcttccctttttcttttttgtcaatagatatatttttttcttttaacttttactttgggttcagaggtacacatacaggtttgttacatagggaaacttgtgtcacaggggtttggtgtacagattgctttgtcacccaggtactaagcatagtacctgacaggcatttttttctgatcctttccctcctcccaccccccaccctcaagtaggccctagtatctgttgttgccgtctttgtgtccatgagttctcgttatttagctcccagttataagtgagaacaggtggtattgggtttcctgttcctgtgttagtttgctaaggacaatggcctccagctccatccatgttgctgcaaagtacatgatttcatatgctgtggtgtacatgtactatccagtctactacagatgggtatttaggttgattccatgtctttgctattgtaaattgtgctgcagtgaaaatacacatgcactgagtctttacagtagaatggttatagtcctctgggtatatatccaataatggaattgctgggttaaatggtaatactgttcttagttctttggggaatcatcacactgctttccacaatggctgaactaatttacgctccaaccagcagcatataagcatttccttttctctgaaacctcgtcagcatctgtttatttgtttgtttgttttttaatagccattctggctggtgtgagatgatatctcattgtggttttgatttgcatttctctaatgatcagtgatgttaagcattttttcaaatgtttcttggccatatgtatgtcttcttttgaaaagtgtctgttcatgtcctttgcccactttttaatggaattttttgtttttttgcttgtaaatttgtttaaattccttatagatactggctattaggtctttgtcagaagcacagcttgcaaatattttctcccattctgtaggttgtctgtctactctgttgatagtttcttttgctgtgcagaagctctttagtttaattagattccattcgccaatttttgattttgttgcaattacttttggtgtcttcatcattaaatatttgcccgttccaatgtccagaatggtatttcctaggttgtcttccagggtttttatagttttaggttttacatttaagtttctaaggggtccagtttcaatcttctgcacatggctagccagttatcccagcatcatttattaaggaggaagtccttttcccattgcttgtttttgtcagctttgttgaagatcagatggttgtaggtgtgcagtattatttctgggctctataattctgttccattggtctatgtgtctgttttcgtaccagtactgtactgtattggttactgttgccctgtagtgtagtttggagtcacgtaacatgatgtctccagctttgttctttttgcttggcattgccttggctattcaggctctttgttggttccatttgaattttaaaatagttttttctagttttgtgaagaatgttattggtagtttggtgggaatagcattgaatctgtagattgctttaggcagtatggccattttaatgatattgtttcttcctatccatgaacatggaatattttccatttgtttgtgtcacctctcatttctttgagcagtattttgtaattctcattgtagagatctttcacctccctagtcagctgaattcctaggtattttattctttttgtggaaattgtgaatggggttgcctccctgatttgactggaaagcaattccattcacaattggcttgattgttgttggtgtatagaaatgctagtgatttttctacattgattttgtatcctgaaacattgctgaagatgtatatcagctcaaggagtttttgggcaaagactgtggagttttctagatatagaatcatgtcatctgcaaataggaatagtttgacttcctcttttgctatttggatgccttttatttctttctcttgcctcattgctctggccaggacttccaatactatgttgaataggagtggtgagagagggcatccttgtcttgggccagttttcaaggggaatacttccagctcttgtccagtcagtatgatgttggctgtgggtttgtcatagatggctcttattattttggagtatgttccttcaatgtgtagtttattgagggttgttaaaatgaaggatgttgaattctatcaaaagtctttcctgcatctattgagataatcaggtagtttttatctttagttctgtttatgtgatgaatcacatttatcaatttgcatatgttgaaccatatagagaagattcaaaaccaaacagagaagattcaaataaacacaattagaaatgacaaagaggacattaccattgatcccacagaaatacaagtaactgtcagagactactatgaacaactctatgcacataaactagaaaatctacaagaaacagataaattcccagacacatacatccccctcaagactgaaccaggaagagactgaatccttaagtggaccaataatcagctctgaattagaatcagtaataaatagcctaccaaccaaaatacaaaaacaaagacaaaaagcccaggaccaggcggattcacactcaaattctataagacgtacaaagaagagctagtaccgttcctactgaaactactctaaacaattgaggaggaagaactactacccgactcattctatgaggccagcatcatcctaacaccaaaacctggcagagacacaacaaaaagaggagacttcaggccaatatcctttatgaacatagatgcagagcatctcaacaagattttgctttctttctcaggaatatataaatcaagtaaggcatctatcaaccagccttctaggagtcagcaccatctgcacagggatcaagtgcctgccctgaagtcagcctccctgggctccaattccacctgccactcactgcttgtaagaacttcagtaattgagcatgatgtcaaaatctataacatgaggataacataagacatataacatgaggacctaacagcaacatctagttcataagtattcataaagaattaactgagataactcatgcacatgcttagcacagtgcctggccccaatacatgcgaactattataactaatcttgttctaaaccatgtgagattaccgtctgttttaaaaagatacctcctgcctgtgttactacttgccatggcattcaaatgcagataagcccacttgagccagccctccccttctcagcctcatctactattgtctctcacaatgttagtcaatgttggttcttctttagacttgccagtcttcttctttgggctctatcgttgctgttcctctgcgtaaaaactgtttcttctaggcaattccatggatggtctcttcttgtcaatcaaacctctccttaaaaatccctctacaagcaggctactggattcaaaaaaaagctgttctccaccatccctgcctcatcacccccaactctcctccatcatgttgtcttgatttagcttctttgtagcacatctggaagtatttgtcttcttgtttattgtctgtctcctacagtacagcgtaaggtccctgggaacaggaaatgtggctgtcatgtctactactatctgttcaatgcctagaactatcttctagcagcccagagcaagctttcaggcaaggccaccatctcgcctaaataatggctgcatgaatggattccagagagtaaataaaaccatttagacactatcactgtctaaaaattttaattattggcacagctcatagttcactaaagtaaacactaagtaagaaagtgctaaggaattaaaagtaatggcaaaaaccacaattacttttgtaccaccctaataaatgctaaatttatttgttaacgtctatacatctctttttcttaagacattatttgacataagaaacttaacttacgaccaggtgcagagaagtttctcaataaatgtgctgtttaagcagatgttttagattgtaggatctctgtttgtctttttttaaaactcatctctcagataaggtcattatgagacctaactgaaaattcaatttccttgtttgccttactacaatttgtcaacgtagaataaattaacaagtgatcagaatgtatttttatgggtacaaatgaaaaaaagttatgaaggagtgtcatctttaaaagtaagtctcatttagacattaataaaatagtcgtcttggccaggtgctgtgcctcccgcctgtaatcccagcactttggaaggccaaggtgggcagatcacttgagctcaggagttcaagaccagcctgggcaatatggtaaaaccccatctttacaaaaaatacaaaatttatccaggtgcggtggtatgcacctgtatccctgctatctagggggctgaggtgggaggatcgcttgagctcaggaggtcgaggctgcagtgagccgagatcataccactgcactccagccttggtgacaaggtgagaccctgtctcaaaaaaaaaaaaaaaaaaaaggccgggcgcggtggctcacgcttgtaatcccaacactttgggagccgaggcgggcggatcacgaggttaggagattgagaccacagtgaaaccccgtctctactaaaaatacaaaaaattagccgggcgtcatgccgggcgcctgtagtcccagctactcggagagcctgaggcaggagaacggcatgaatctgggaggcggagcttgcagtgagcggagatcaggccgctgcactccagcctaggcgacagagcaagactccgtctcaaaaaaaaaaaaaagtcttccactgtgagaaactttctaaattatatgttatcatctatatatgctttctggtattttaaatcccaaaaatgtgactcaggaaatatttattaatatggaaccagggctttaatcttcacagaatgatttacacaatttacagtgatgacacatttcattccagggaggatcgtatctttttagattgtcccagttgacttatgatttaatccaaagtttaaaaagagggggcatatttattttgtgtaacaaagcctttccctcacctttcctagctgttgcttctcataagggttaaatccaaacgtcagtttttcagggagcctttccttgactcccagagctaaagtcaccctctgcaatccccagatccctcacaaaccatttttcccctttaaagctctcatcgctacctgaatttatacaatttacattaattgtcggcttagtgcctgcatttcccctctaacagaactccatgagggcagagacttcatcttgttcactactgttttcacaggagtatgccaccatctggcatacattaggcactcgaaaaatgactgaataaaccagaccatggcttccattccttgagtagacgccttaggttgggttgtcccagaagtaaactctgagatacggatatacgtgtataaaagagtttaagacagtggcaccaggaagcaccaattagggaaggatagaaagaaagagcaaggaaggaagccacagagagtgtattttcatgctttttattgtgggcagctgtgctgtaagccagctaaggagttctgggagacagtgtagagactgctgcagagtcaccccaactgaggaggatggggctggactccgatcagttcttggctgatggctgctcctgggagctgttgacacttcccagactgctgtgcacacagacaggtgggttctgacagcctacagaatttttggtcaaagaatcacaaatgcttaaggttacagtctgaaaactgtggttggcatgtagcagctgatttgggcaaagttaacgactagggaggagtggtcagaaggaatccccaagtttctaaaagttagagaagtgtatttgaaggcaaatactttttttagtatattatttcccttcttattttagtaaaacttctctcccagcgacagatcaagactccatctcagaaaaaaaaaaagaaaaaaaacttttttcccttacaaaaattttcagttttctttagtttaatcttctgatcttttccttgtaatttcttctgtcccttcaaatcccagaaagtaaaggcccagcttaatggtatttttttgttggtagtatatcttaaatcggtgtgtgtaaaggtggatgccagtattaattttatatattttgaatatacacatagctcaattccacatttaaacataaacacatttatcattttcaatttgggggaaatattatatacagatataaaatatttataattgatttcttcagtgttttaatagtttttcaaaatcccagtacattgttattgcaacagttactgtctattatgtgccaaacttgggggatacagataagaatcagatgagaatattgttcctcaaggagtttttagttggtaagacgtaagatataaaataatgttttctgtctatattacgcttaccatgataaacatttttcagaaatataagtgtaaaattatcatccctgaagtctgcacaattttacttaagtttttgttaaagtgtacagttcagtttgatttttggtatattcacaaagttgtataaccatcaccactatctagttccaaaatatcttcattggcccaaaaataaaccccataccagtatcaaattagtagaaagcaacctccttcccattccctggaaaccctttatctacttccgtctctacagatttgtctattctgaaaatttcttataaataagaatgataaaacatgtgcctttttgtatctggatgttttcatttatcctgttttcaaggttcatccacattgtagcatgtatcagaacttcatatccttttccatttaatttttagatttttattcagatgtaattcacatatcataaaacgtaccttttaaaagttcacaatgcgatggtttttagcatattgacagagttgtgcaaccggcactaccgtcttatttcagaatattttcatcaccccataaagaaactccatgaccatgaatggtcttcatttctctttttttaatgtatttttaatttctgtgggtacatagtaggtttatatatttatggggtatatgagatactttgatacaagcatataatgtgtaataataacatcaggataaatggggtatccatcacctcaagcattatcctttatgttacaaacaactcatactcttttatagttattgtaaaacatacaattaaattagtattgactatagtcacctgttgtgctatcaaatactagatcttaattatcctatttgtttgtatccattaaccatccccactatccccctccacactgcctttcccagcctctgataaaatctccatgagttcagttgttttaatttttagctcctactagtaactgagaacatgtgaagattgtctttctgtgcctggcttatttaactaaacataatgacctctagatccatccatgttgcaatgacgggatctcattcttttctatggctggatagtaccccatcatgtgtatgtacattttctttatccattcatctgttgatgaacacctgggttgcttccaaatcttggctattgtgaatagtgcttcaacacagatggaagtgcagatatatctttgatatactgatttccttcttttgggtatatacctagacgtggaactgctagatcatatggtagctctattttgagttttttgaggaacctccaaactgttctccgtagtcgtcgtactaatttacattcccatcaacagtgtatgagggttcccttttctccacatcctcaccagtatgttattgcctgtctttttgataaaagccattttaactggggtgagatgatatctcattgtagttttcatttgcatttctctgatgatcaatgatattgagcaccttttcatacacctgtttgccattggtatgttttctttcaagaaacgtatattcagatcttttgtccatttttaaatcagattattagatttttttcctatagagttctttctggttgttaatcccttatcagataggtagtttgtaggtattttctcccattctgtggtttatctcttcactttgttgactgtttcctttgctgtgcagaagctttttaacttgatgtgatttattccttttatggctggataatattccactctataggaataccacattttgtttatccattcatcaattgatgaacattagaattgtttccacttgtaaggctattatccataatactgctattataatactgctatagaaaagttctattgtagacatattttttcagttctcctaggtgaatccctggaattgctgggacatgtggtaactatgtttaacagtttaaagaactgccagactgttttccaaagtggctgcaccattttacatttccattaacaatatctgcggtttctctacagaaaatattctagtttctctacaccctcaccaccatttgttattgtccatctctttgattatagccatccttatgggtgtgaaattgtatctcattgtggatttgacttacatttccataatgactaataacgttgagcatcttttcgtatacttattggccatttgtacgtcttctttggctggccaatttgtgcgttctttgtccttgggttttcatgaatataatctgtacactttgcctacaagttcagctttgggtagaatatttaaatggatgctggaatttggattttaaaatataattaaaaatttgttctgccattgcttttaaaggatttataatttaaaactggtatgtaaaactagcccaaatacccagtgtattaaaacaaacaaatacacaaaactcactaattcctacctttttgaccatctgtagcaggctcttccctgaccacagcaattcaagcctggtattctgtgtcctccagatcttttcattatcataccttctctgaaagagacagaaaattaacccatcaccttcaaatttcccactcccacttagctcgtacagcctcccaacatgggactaaataaaccatctcattctcacatgactttcctccctactctctcctcctcgctctcaactagctcagtgccctgttaggccgggtaccctagaggcgaaccctaaaatacactggtgagatatagccccttcagcattcggggcagtgtgattctgttgtgcactacacaggaccttaagcatcctgtctcctggctctaaatgttgagtgttcccgttaactcgtcattaatgggtgcagcacaccaacatggcacatgtatacatatgtaacaaacccgcacgttgtgcacatgtaccctagaacttaaagtataataaatatatataaatataaaaaaatgttgagtgttccctcctcaacattgtgacactgtgacaaactaaaaaagactccatgcatttccacatgcctgcacagggatggtccacctgctgttgagaccatggtgcatctcacccacagattccaggacatctctgtgtctcttcacacccagttctagcaaactagttgagctagttgagccatgccaaaggaagcagagcacagctactagttttgaaaacagtatatcttaattctgaaaaatttgacaagaaaaagcaataacaaaggctaaactttaaaaaaaactttttttgaaacaactactaacaatgctcttaactagaacttgaaagttaagctctttatgttttcaagctctaatattgtgaaggaaaattataaactttcatctggctataaaacatattttacatagtattattttaaaataatcatcaaaatgagtagtaaacatttaactttataagggattgtaaaaggagatcttatatatttgatttttaatgtattctcctacacatcagacttgctataggtattgaacacttccactgttgggttagaaagaatctgtgctgtaagcacgtgacaaagacagtggagcagttgctaccgttgtttatcacaggagatgctctgatttgtatgaataattccatcagttgctctaactactggggagaagagaagctagcagtaaagccaggaggactccatcaccatggcatgctgctacgttaagtgtgaatgcaaatcaatttttcatacttctcttttaaggtttattgcaacttacatgccctttggtcccaaatcatggatgaaagacagctggcttatatcaagaaactctgtctgaaaagaagcaaaaaatccatctttagcaagcaaaacaattcaaatttatgcattaaaaaacatgtattaggtatagctgtgtgtatatactgtttggtgtgctccacagactacacagatcaataataatggcattgcactaaaagagtgcagattaggagtatataaacaatgaagacacatcctactagatcttctaaatctgaagagagagatgtgtgccttaatacatagagataaaatgctcaagaagcttggagagagagagagagagagtttattctcaatattctttcatgtttgtttttgttgcacgggatggatattgtgtggcacagtgtacactcaaacaataaaagaatgtgagaagcaagtgatattggtgcaggatctggaagatggactggatttgggcccacagtgtgaaatgggagatgaatggggggctagaacagaaggtcaaaaaggttataggatgtacagttgggttacagtgaataagatgaaggaaaagaataaaaaattaaacaggctgaaaagagaatggggagggctttgaacatcaggcataatgaaaagaattatttttaatgagttgaagaggaagagaattttaggcccaccttcactgtattagaaggttaaaaactgtaaatattataacaacaactgtggctgtgtttactgagtgctaactatgagttggtgttatgctaaccatttttcatgcattatctcaaacccctttgaagcaggtgctacttttcccattgtacagaagacgaaactgaggtttagtgtaagggtaagcaaatattttctgcaaagagccagacagtaaatattttgggctttgtgggcatacattccattttgcatctacttcgctctgctgttgtagcacggaaatagccatagacgcatacataaacgaataactgtggctgtgttccaataaaaccttatttatggatataaaatatgaagataatctaattttatgtgtcacaaaatattattcttttgattttttttcaaccacttaaaaatataaaaactattcttagttcacagaacatacaaaaacaggcaatgggcaatgggcaggatttggtccacgggccctagtttgcaggcctctgttttagagaagtcaagtaagttgtccaagatcacatagttaagaagggattaactcagtatggttaactcattatgaagtcagaccaaagtcagcgccctcaaaaccaagctggaagagcaaaatgtcattcaacatttatctaattcaaattgagttccttgcatattctaggtaggtgaaagctagatgtaaatgtggaggcatagaagggaaaaacaaatcaacattacataatgtttagcatatgcagatttgcagatcgttttgaaaagtgaccaacaataagatcagttccttaggccatgtcaatagcagccttgatagaccaacaaagactaaaaagatactctcccagcattaggaagcagacgggagaccagatatggaaaacactaccctcaatgaagttctgtgggatgaaccacactagatacatgtgaaagtagttacagagttatagaatagtggagggcaaccacttcccagctgacatgacatcacagaggcaggggcatttgatctaggtttgtaaatgggattagtaaaacaaaagttttccatgtaagttttatatgtgattggacatatctaacactactcttgtaaaaaaaaattacaaatatctcaaggcgtccatccttgtaaggttcatttaaatgcttgcatttttctcttttcttggggttatttgcagaaaataggtctttaaaattcaaaaggacttaaatatctttttaaaatcctaagtcaaaggtatcttcatacagcattttttaaattgagaatttaaaaagtcaaggtctcagtcaggcatagtggctcacgcctgtaatcccagcattttggaaggctgaggtgggtggatcacttgaggtcaagagttcaagaccagcctggccaacatggcaaaaccccatctctactaaaaatacaaaaattagccaggtgtggtggtgcatgcccgtaatcccagctactcaggaggcagaggctgaggcaggagaatcacttgaacccgggaggcagaggttgcagtgagcggagatcgtgcccctgcactccagcctgggcaacacagcaggactgtctcaaaaacaaacaaacaaacaaaaaacacctcaaggtctttacatttcatttcttatataaaacagtgattcagtatcatgcatttttatctggtttgtgaaaatgcttcttaattggaaaaggtaatcctatgggttattggaaatgattcacagattgccagccataaaatccaaaatattttaaaatcctgagtcataacttttatctctggagagcagacaaataatgtcagtcctagtttacatttgaagactatagtctactacagaggcataactaacttatgcaaagtcccagaacaaccgaagggaagaataggaaatgaaaacaaaaatcaaggaagccactaatctaatgcctggatattttcttatttacatagctgttatcatcaaatagttgacaacagaaatattctctgaaatcattcagaaatcataacttttggagtatatcataacaaaattgctaagcgtaaagaatctcagctaagtagacacattaataatgtagaaaattgaaagttacacattaatatgaaatttaatttatcctaatggcttagtaaagtttgactggagagagatttccagaaggaaccaggcctattatacagaaaaaaaaatctggcaataaacgtttttctaatacagagttatcaaattgaaagtaaatgtgtcagggtcaactgagaggcaaacctaactaataaaaattgaaatttaacaaagatgatgttgtccaaacttcttagtacatcttcagtgataagaattccattatccatttgggcaagtgattctcaggaataagaatttaaagatcaatttagcctaacggcatttcgcagggcttattccattgatcttttgagtaatgtataatcaatacctttttgtctttgtttttttggcaaaggaatttgtaaaatatgaatacaattgaaataatgttgcaatgcaataatgttcttggcactaggtggaaagtggtctcaagtaaaaaattccaacatgatctaccaattggatactaaaaacgttagagaaacagagaagcaaaaatatttccatgccaagagacaagcaacaagccctaggggtaacaaaaaatcctgaaaattacttggcaatcacgtacacactgccccttccacccatccttgtattgtaagagaagggtgactttcagaggctccttttatttaccaggtagcaaaaactcaagtaaatggccaggtgggaaattatcagatacaaggaaggtaagagcattgagttgggcaatgtccttgtagactcaggtactccaggaaaggcagggaacaaagaggacatctaatctatgaaggaaactgggaggctgggcaaaggcctaaagtccttctcaacgctaagactcaatcataagaaagaaaatatttcccttaatttgaagatgcagctgttcaaattagtatagcttttccctgttggaatgaaaacactgtgtgcacgtttattctttacctactcttcccctcaagttaaagttcattctacaaaacaagggagaggtgaactcagtattattgatctgtgggatgttttacccaaggatttcaagctaatcaccttcttggggataagaaatctgagtcacataagttaaatgatttacttcaaggtagagatacgatcctatcaccttagggcccttctcttggaaattgtacaatttgttccatttctagattttaatctcaggtatgaaaaaggtacatttattgctccttattcctctgattttaattccctggaagataagcattttccagttactaattaaaatgcctagctagtgagttctctactacagccagcactaatacaatttcagaatacaaaaggaattcttgtttgagatttttttgtatgttattacacaactcagatattgctatttttttacatatttatgcttagggtaaagaggaaatacatttgtccccattttacaaatgagcaaagaaaactgaacaaatcaccaatggtctctgaggcaactgtctgatcatgactacactaaaacactaggatgctctcctttgcagaaccacaagaaggaaaaaaaaaaaaagaattaaaagcagaggaagtcttcataatcatgggagagaaggtctgagcacaaacccaaccaatggctgtataaaagtgagaggaaagaactgtccatgtctaatttcagaggctacttaagaaaaataatgtcagtgcttagaaccctaaaccaaattcctttggggaaaatcctattatacaaacacctttataataaatctatctccacttttttttttttggcagagtcttcctctataacccaggctggagtgcagtggcgcaactgtggctcgctgcaacctccgcctcccgggttcaagcgattcttctgtctcagcctcccaagtagctgggattaaaggcgcccaccaccacgcctagctaatgtttgtatttttagtagagatgaggtttcaccatgttgtccaggctggtctcgaactcctgacctcaggttatccacctgccttggcctcccaaaatgctgggattgcaggcatgagccactgcgcccagccctgtctccactttttaaagtggtctaactttaccaagacatttctaagctgatcatagcattttagtttagttctcaaactcctgatgataagaatcacttgagctatttgttaaacacacttattccaaatacagatctggatggccctatagagattaagaacatatcctattcagtcccttgacctatgatccatgattctatctgcttatggacctgaattaacttaaaataggtttgttttatacttataaaagtataaatttattatatacatgttaaaataacttttaatatgctttttacagacagtaaagcattttttaacagatacttttttagtatttctcacaattattgaagaaaacatgtaaattccaatctcatttcacaaatatgaggcagaggtctacagatctagtctttaggccagactacatttaaagaaaaagaatgttagagaattaatgtatatcaaattgtatcctatgcttgaatcatattgaacaattcagctgttggagagaataatctcagtaaccatcgaaaatgagagggaggctgggcacggtggctcacgcctgtaatctcagcactttgggaggcagaggcgggcggatcacaaggtcaagggatcgaaatcatcctggccaacatggtgaaacctcgtctctactaaaaatacaaaaatttgctgtaatcccacctgtagtcccagctacttgggaggctgaggcaggggaatcacttgaacccgggaggcggcggttgcagtgagccgagatcatgccactgcactccagcctgggaaacagagcaagactccatcccaaaaaagaaaaaaaaaagaaaatgagaggagaatctattcacagtcagttgctaatgaggctttcccttccaaaggaaatgtttacaggtcactctgggatttctaaatacaacatggcctaactttgaaaatatttttatgactggaaaagtcattaaaaagaacactttttaaatctaaacattctttagtcaacagtagaatcccaaatgtagaaaagtacatgaaaagagaagaatgaactcaccaagaatggttacagccaaaagaaatagtaaaagtaaagtcacaggcaggcagaaaagtaaaagaaatggaaaattattgcatatggatactaatacacatttaaatagttgtctgttaaagaaaatagcatgtcggatttcagacaacacaacaggaggtatcatttttattaacaatagtagtagtatccttattcattgttatttcaacaatacaagttcctgagtcctagaagaaaagaaacccctgcctcccatcatccttctcttgagatcctctggtgcaacccaaattcctgttttcctgagaaaacccttctccaggtttatgaagacatagaagctccctcaagtccattgaatgccccagtgcaagctgctgctggaggcaggtagtgacctggatccaggtcacctgtgtgtaatgggacagctggatgtatatttggaccagactccaaaccatgtgctgcaaggcagcaggaaggcagctcctgtcatgagaaactcgcagagccaaatgctcttgcatcctctccaaaatacactaaagtctttactgtttcagtttatgtgtttatgtgatgccattctctaaactagcggacaaatcacaattgcaccaactctagagttctgcacatatataatatagatgcatacagcccccataaccatacaattcatacaaatgcatacatacatacgataaaccatgcattctcagttatccaggcctctgaataattgaaggctaaacctttaaaaacaccccacctttaatagtgcagagctacttgtttgctgacactagaaaacccactccctccctgcttgccagctgcataccccaagcttaatctctgtggctgcatctaagccccatcgcctcttctttctttacttggattcctcaagggttttttctttcctagcttttctcatgcttctcactttcacatgaaaagacatgcctttaacaggcatgacaaaccaatcagatggcaatcgccctacgcaccacaaaatcttcaggcattcaactccactcaactgttttcatcacttactactcaacagttactctttgtagctaaaaaatgctttttggcattatcctggaaacctgagaagagaagaaggttgatttctagataatctagcctatagcaggatttcaagttcatttaaatctattgttatagacatattaagttctactcaactttttaaaacagcgtcacaccactgtaaactggatccttgctgtaaaatcaactttgtattcacttaatttattttaatgcaaggacgaatgtaggtgtggatacaatcacttgtgttattaaaatgatccaaaatttagctgacaatttactatagtgaaaattactccaaacttaaatcactgactagtacttactgtggcatgatagtttctatacatgggcatttttagtatctttgtcaagtaatcttccagttgtttctgtaatgcaaatattttagataagtgttaacatggtcatatttatttttaaaaattaaacagtagtgacaatgatgagatcatcattttcatcttaacttctacaagttattcaattatttattaatataatcatggagcaaggaatcctgaatagcattaaggtgttatttccatatttctcttgaactattatttaaatatcttcttactgtttaactttccatatgcttaggtcttctataaactgctgacaagccctattatatgtatatagctattatagcaggacttgctataagttgttttaaagcatttgttgatattaccaaaaactttcatttttttttcaattctaacactgaacttactgaaagatacactacaaattttaaacagcttttcaggaaacaaaggtggagaaaggttaaaagactttctagtagaatgtactgattttaaatatgctaaactgtgtgtggaggcagcaggggagtagagggatataggcttggggcactggagcaacatatgtcaatcatattgaccatgatgtaaaatccagcatgcttttgctgaatcactaagtgtcattttcagttgaattcatacatgtgcacacagtaaaccaaaactatataattttatatgtctaggtatcttggaaaatatttggtccagatgcctacaaagattttaaacaagatgacaactacaaaggagaaatcaaacattccctctggaacataaacatttcagattacaaaacagaactgacagaaattaacaaacacttgttcattttctagtaaaaaaaattaattgtccacactctgcagcacccatcttggaagcagagcaggcagaagtgcccctcctctggagttttctgtcccagtgctgtgcctgtctgtactccgtcagactcttctcaggccctaactgctccatctatagtttaggaatgagattttacatatatttaagatgggctattacaaacacggaaacttatgtatggaaaatattattttaaaagagtagatctcaaaacccacaacaatgagttcaatctttgactcacaataagcccaaggagattctagcagggagaacagcttcttcataatgtcaaggcctaaccaagaacgctcttcctcttctgagaaaatgcactgtatggcttggggaaagaagggactgcctaactagttccagaaaagctaaaccagcctggggatcaatgagtggatgagaggagttgtagccaggcctacttcacccctcagtagatgctgtgtttctacagcactgcaaaattaggtttaaaaccacagaatagtgaagaaacttactcttctaccaaggaattgttcttctcttatcatgttttcagatgaacggggcaaactgggcatctctcgaggctcctctctgacgttttgcctcctaaacgtgtgtctaaaacacaaacacacagaatgcaaacacctactagattattctgtgactatgactttagtatgtctttcatgagacggcatatttttaagagactatttaattgaaaatatctaccaacaatagactagttagccgatattgtgaattaaatacactttttatttatttattttaaagattggatgtactctgtcacccaggatggagtgcagtggtacaatcatgctcactgcagttttaaactcttgggctcaagcaatcctcctgttgtagcctcctgagtaggtagaactactaactatcaccacgtgccaccacgtccagctaaatttttaatttttttatagggaggaggtcttgctacgttacacaggctagtctcaaactcatgacctcaactgatcctcctgcctcagcctcccaaagtggtgagattacaggtgtgagctaccacacccagacaaaatacactttccattcaacttgtatactggcataattaattccaaaatggttaccttctagtgggaatggggatgcggataaaggctttgtacttgagcagctctctgtgaaattcttgaaaatgcttgaatttcctcttaacttgccatttaaattccccatgtgttaattcaatagtgtaaagattaatacttggtacctacagtgatacataaaaatgtttgatattttagataacaacaaaaattccaaaagctttcagtgaacaatatttaactagtaacagagaagtatacttaagtccagcctacttattttgtgtaagtacttaagtaaatttgtttcaaaagcagccaattgcagaaataatattctctaaatgttcacttgatgaattacataagacaaactttcaatcacacgagacgattcctacaaacgctgttcctccaacatatgtgcgtgtatgcatccacgcacacacacacctgaaatgaagaactaggtggaggagacaatgagaaaggccctaattagccttcaggggtccagtccacaaatataagccgtgcaccaggcaattggcaggggtgagacgtattgtatactaacagcaccatcttggctgtttttgttcttcagaaatggcacgacatgccttctctccttctcttgtgaaacacattccaaggtccagccttgtctataccacccacccaccctaaggaaccaccagtgttaaggaggggtgggtggaaaaagtgactgcagtaatgagtatacagtgtatacttgtataatataatacatatgtattattattactaaatctttgtaataaacctataatgtaagcactgttataccctttattcagaagaggaaacaggaacagagaggttaagtcactcattcaagatcacaaggcaaagatgaattaaaccatgcagtctgcctctagagtctgtcatttacccccacatgttattatctttcaatctaaatgctggcaggtgaaataagaaaacaaagctcatcttagagacatttctgagggagttgtgctcagtggtgtatcagggagacatggacccgagtcacagggaaagcctaaaccagaggctgacaccaaaatgagtgtaagctgggagtcagtacatgtgcaggtaggctgggacacagcaccaggcaaaaccacccagaaagcaatgcagcgcatgccacctccaaaagacaaggaggaagggaaggcaaagcatgccctgacagctggttattaatctgtgcttcccctgaggcaggaggcagtggtggccttactctgccatggctagatcttagcctgaagggacaaaggtcaccaccctgcagcaattgtcctcccccggagacttaacaactgcaaaatccagccaggaacagagaaaagtagctaccctaacagcttcttctagtccaatccatttcaaagggcataactttgattgttgaagacattttactccaaagccttttcagcgttcagtgaaatatcacgtgaatgaggactaaaggatggttttctaggaaccaatcagagaggcagagtatggctgcagaattctctcaacagtattttgaggtaatggcactggccgatccagtatcccggctttttttcttaagagccaggtagcaccaacattttcatgctaaataaacattaggaaagctaaaattcttgttgacttatacctgccatgcaaggtggaataaatatgcatcaagagtccaaatgaaacagaaaactggggagagaagaagattaagagaggcactttgcaatttattaaactgttaatttgccttacatgcctttttaaaagaaagagctttggctcaaatgaagaaagaggaatataagaatgaagattaaatgggaaggaggcaaaaacttgacaggtgaaaatgacttggaaatgatagatacataaaaacaaacaaacaaaaacctacaaacatgatcatagctaagagggaggaaaatgaaaggctatgtactaattcacatatattgacaaaagaaaaaagggtgagtccataaacgctctgacccttgttgtagatgtgaagcgttccacttccagaacttgtgcttttattggacagccggagagatacgtctgtatattaggctccttaaatccttgagtgttataaatagcagagaaagggatatacactaaaaaaaaaagtaaataaagttaatgcaatatatgattagcataacttgtcttttacaggcattcttttaagaatcacgtgttaaaacaagtaagcctcttataaaatgatctgagcccggtgttacatctgcaaggaaaatcaatcatttgctggttacttcaaatttgtggtcttccgaccaaccgagataaactcttttcttccccgctcagatcatccgtctttaccttcttgtatcttgggatcgctgggagacacgtcgtagtctacctcctctccctcaaagtggagttcccgcgtgtccagattttctatgatattactcatgtcagcagcaattttctgcagtgcagaggtatttacccgtggctcgtttttcagtgacatgttaactttggacagagtaaaagcaaaggggctaggaaagaagaaaacggttacaaagacttagcattttgataacataaaatgctattccacaatttgaatccagacttagatacagcatatggaaacaattcagcctgctctgtgtgagcctcagttatccaaaacaaccttttagtttacgttcctgtttaacatttaaaggattcctaacttgtaaattaaaacagagtgcttaattgaaaacaagagaaaaaaaaaagaaaaaaaaaagcaacaccacattgaatgccaacatttctctcatccaactttattaacttggataagtaattcaagggagattggtttgggaaagcttattcagagaaagaaatagattatttgctgtaataaatacagctgaagaaagaatatcatgaaaaataagcaactctaaatatttcctaaagaaaatttagagtatttcacatattgaaatatatagatttagaaatatttttatgatagcataatatttctacattttctctgtaggtgatatcccaagcaaagtgtatattacctcttcaagaaaggagattttggccatgactttacgtgaggtataatgacgtatgtgtcttgaaaggaaattgattaatatacctattccgaaagacatctgaggtgctagaattatacttccctcctttctttttctttaaagaaaaccagttctatttcattctgacatttaataacacaagtcgttgcacatcagtacccagggcagaagagttcacatggatattatttttcatgtaaaatattgagattcaagctttgcacactgtcatcagagttggatgaaacatctgttttgcctgatgtagaaataatctgttaaaaccaggccctagaatggaaggacgctcataccagtaactctttggcacatgttcctttcttactgcaaatcacaaacactgagcatccaccacatgtgagatgagatgaatgaaaacgtgaaggtgaataaggcaggcccctgtgattaaggagcacctgatatgggtgaggaaaatgaggcatctaacccaaagttcacccctggcctcctccaaggtcttaggcttcttgagaatgaaatttgcccaggggaagacacttagctgggtctctcctgcaggtgctatcaaaaagctaagtggctatatgggaaatgctaagaaagtctcaggcaaacttacacagcccttattataactcaatgagtctcgaaaacctatacttttatgtctgggagaaagagactgtgtttggaaattcaaaaatgggagcgaaggagggaggttctggtttggccagacatataaaattcatatatctaagttccctggaactatgtaatcaatcatgtttctttctctatgttgcctgtaagaaagcttggagccaaatttgtggcctactatatagccaagtataggactatctcttcccttcaactttccctcccacttctaatttatatcataatagttaatagttactaatgtttagaatgcacctcgctggtgataattgtttacatacattgtctcatttgtcattaataataaatctgtgagggcttgttttttctattttgagcatgacaggagtttgccatcccctctttatagataaggaaactgaggcaaagaaagactaagtaacttgaccaatattttaaacaatctgtcaaggtcacacagctggtaagtggtgaagaagggactggaattcaggtttctctaacccaaaagttgatattctcaaccacgacctttatcttgctctctattctttgtagatatgtaagtgctttggaatagatggaacagttaatataaataagtaccctggggcaagtccatgtaagagcaaaccctaacaggaagaattggaaataatctcctgcaactcggttaccacaggatgaagccatttaaattcccagggtctttgtttcctctctataaattgaggaggttgagccatttcatctctagagttcttttaacacgaaaaccctaactgtagataagagatgccataaaagtattcagcctcccttataatttaattactttaacccttttcctatcccaagagattaatcagagtagttttgcatttgggtaagagaagcaggtagcagaatgttttctaacctggataacttaattaagatctattcagcctccattgaggagccattgcccttggtcaaaatcaaaatatgtatgtcctttcctcttcattcaacaaacacttaacaatgtgtcagattttactttatttaaaatacaaggtaatgaaaaatttagaggaaaagagacaaggaaaaacagataagaaattacatcatatcattgcagcttgttaatttttaaagacttcagatattttttattgattaaacagacttattaactttgccaactttcttaacatagtgaagaaaaacaaaggttactccaaataaccttccttttgaactatgtgctgatcttaaaaatgcctgttaattttaagaaatacaaagactacagtaatctacacagtgttacagagccaatgcaccaagctgaaataaatatctgacttcagatagagaaaaaagaagcatattcacttatgaaaaacttgaagagtgagacatgaaacaaagaaaacatcttatcatttatcaagtgtttattacatgctaaacacaattttagcacagttatgttatttaatactcacaatgaccctacctggtaggtatgattattctgagagattgagttaaacaatcgtccaaggtcactcaacttgtgtcagtgttgagtttataaagcagattttgtctggctctaaaatcttatggagttggttacagaggcccataattacttttattttatgggcttgaatgtctataaatctaaattcatcttttatatgaagtttaagtcctgtgacaagacatgtcctctactttagtcaccataccttggaagggatcatactaatcccacagtcacctcaattatgaaaacaacatatctcaacagcttcctgagtttcttcttagccttttacttttatggtttataatattttataagatcatgtggaacttcaatggacccaatgcatttgcagacttgttcatgcttttgtaaagactttactatttaataatagacaatgaaagaagtgatttgtctatctctacctttacttatgtccatgggcattgtgtgctgacttttcatccaaccattgtattgttggtttcattcttgaatatcaagctgcaaaactatctacgctcctatgttgtcaaatcttcatttatcagtcaatgttttctttcatctaaaataatctataatagggggtgagcagctgccacaggcacagcctatattagccagcaatgggataagggcttcagtgtttacacttgagataatgcaattgattttgttacctccttataaaattatactgcaagatcattatctctttcagtaccaagaagagatggtgcccatggagagataagagcagctgtgttttatttctgtttgcatttgtatctggaaagcaaataagggtttttttattctcgttttgaattatagaactgaaaatctttgcagggaagatttaatgacctccagttattcagtgatgaaatcagataattttctattcttgattttcaacaagattgggaagtagaacatcaaagagaagcagatactttccttttcagataacaaatagataaacattgccttagccaaaatacaataataatatcaactataattattgatattaacataaatatgaacattagccagtatttgctaaatatgtactacatgccaggttttgtacaaagtgattaatatcatgatctcatttaatcttcacaataactttaggagctgggtcccattgttactagcatttttaatgagtagcttagagaaggtagaaacttggcagggccacacagctgggaagtgatgaagctggtgatcaatttgatctgacctcaaagcccagctacttgccaatccagaggtgggactggggtgggaggaaagatgggcactgggagacttttacaattttcttcatatactcttaaaacttttttttaaagtcagggtcttgctctcttgcccaggctgcagtacagtggtatgatcatagctcaatgccgccttgaactcctgagctcaagtgacctgcctgcctcagcctccagagtaactaagactgtaggcatgtgccactacgcatggctaaaaagtaaaacaatttttaaaataaaaacaacccacattcactctatgaacatagttacgatttacttattgctccctttctaacataatatgcaaaaattcatttttttctagctgctattgtacttaactgagataaataaatgcaatggattcctaagccaaaaattatatcataatgtatgaacgtaaaaaaaaattatgattagatagtttaaacccaaactgagttatggggatatcttgttttcccattttttcatgatgatgaaataaattaaaggatccataatatataacctatgaaaacacatcatacagcaactctatatctggaactgacttgatgctctctgagatataaaaattataaatgtggattcaagtactaaactcaatctttagtaatataatacgacttggataaatattttttgagtttagctgactttgaataaagtaaatgatattaacatattttacattccagactatatattttgagaaaatacattttaaatatcctctgatgtttacttggatctttgactttttttttaaaaggaacattgcttctgcaaatattaatggaaggtgattatgtaccttggacagaaaatgagatgtcaatggtataagggaaagatcaaatgacctagaattgttctatccttactatgagtgtaacctgggcaactaccagccccagggttgcagtgtccctctgtgaaatgttccactcatgcttcctcccttgggaagctgtgaggagcaaatgtgatcatggatactcatctacaggcaaaaatcatcttggttgctagtgtcatctttaattctattaaaagctgacccctgaaaaaataatcttaggagagtttatcctgcttttcatctcttatttagctcccaaaactaacataccatcttgcaactgtctttctggctgggctactctaagaatgggtctctgtcattcaaccagtcctgaaatttctggactgtactacactaagtataagagaaaccagtaagccttcctctgcaaaaacaatcatggaaggcattagccagtcagacccagctaatgcttccttttccctgcatgtcttcctggcctcatccaacctgctctccctggctggttatgcaatccttccttggcatccccatagcgctctccacttttctcacaacagtggctcctgctccctttgaggtccggcatcctttgcaactttgatgaaatctatgaacccacaaccccagaaaaaaatgagcacgggctcacacacagcattttgcatatattttcataggttcatggttgcactctcaagacctttaagtgaagaagcacgtccactgagccgcaatcatgtgctgatgcactgacacatctgtcttcccactagacagggacactctttggggaggagggttagagtcatgggcattcaccacagacacccagccgagcacccactcaatacgtttgttgattaagtgacataatcaatgagctgtccatagagaaagctgtcagctccaggttattcagtaaatgacacaaagagatattattttccctcgcataccacagacacactcagatgtagaagccttctggttgaaaagcccctgagaggcgtgtaacatgttagaaacagattggctgccaacgcaatcacagctaacacagcaaactgctagtgaagcttcctgtgtgccaggcttttgctgagggcttttcatgcatcatgtcaaatgatcctcacagcaacttcatgaggagtactgtcatcattcccactttgcagacagtctgacagaggtgaagagtcagaaagtcagtaagtcagctctcagcctggctctggctgacccaaaagccatgcacctgctcctcttctgccttccacctgtgcccgtgccaagaaaaggagattccaagacatggaatcacccagccgcctttcctgcccataacctgtgagtccagcttgctattatgtctatggttctaagagtcagaagtctgactcccaaacacagcccttccactgagctccacatctagtctgatctcagggagcccagagcccagcaatcttccacttacttatccttctctcctggttttatatcacaccctccacgtggcctaatgctgacgctgcttttatccctgagatatacagactggtgctaaatactttggactcactgtgcccacagaatagaagttgaactcacgttctctttttttcccctagctaaaaacaaagaaacaaacaaaaacacatctataatgacataaagcaaaatggttacatagctcttaaaatttccacaatttctgccattagctaatctcaactagtaagtatgtcattaggatacttctgataatgatctatcccagccatttttaataataacccaagaaaaccaaggcagctttatgccatggaggcaataagaaatcccataagacatcatggtttccagaaaggacaaccttgtagacagctgtttcactatccaatactgaattaggatataactcacacgttttggggcattaaaagcatttcttgattctcatgacttttcctaaattctttgacctctttggacgaccttttaaaaacatcctcggcatttgttctctggcatgagctttctaatttcctttaatatatcctagagttaaatatttccctctttgcagtggtgtcagcttctagctcatctcagtcatatctttgaattcaaactttgcttccagagtcaaatacaaatgttaaaggaaattgacatctatttcaaatgttgatggttaagaaaatatgatctgtcatttcctgagtgcctgtactgaaaggcacgttacaggtattacttccaatcctcacaacaatctcactggggccatgggagcttactgaggctgcacagttgtgagtggtgggactggtccctgtatgcaggcctccagatgggctgggtccatctgcatccctggcctctgctcagtaaagatccccagtcacaactgctctcacttcttctcctaatgccaccaacaatctcagcctccttctgggcaagagcagggctttggcacagcctccatggcatgcagcacagcacgtgggctccactgacctccaaccagaccctcagaggcactggcacatccagatgtttttggattcagttgaagtgctgcaccagggacgtgttctcttgcttcctcaggagttgtacatcaggggggtaagaggagtacagggaagcaagtcacacagcgtgtgatactgagaggtgacaacgtgctagcagtcctcactcgctcttggcacctcctcaggccatggcgtccacgctggctgcgcttgaggagcccttcagcccaccgctgcactgtgggagcccctctctgggctggcggaggccagagccaactccttctgcttgcagggaggtgtggagggagagacgccagtgggaaccaggctgcctgctgcactcacaggccagcgcgagttctgggtgggcgtgggctcggcaagtcccgcactcagagcggctggcgccaccggccccgggcagtgaggggcttagcaccgggcaagcagttgcggagggtacgccgggtcccccagcactgccggcccgccccactgcgcttgaattctcactgggcctcagccgcctccccgcggggcagagcttgggacctgcagcctgccatgcccgagcccctcccctccgcgggctcccgcacagccggagcctccacgggcaccaccccctgctccacagcacctggtaccattgactgcccaagagctgaggagtgcaggctcgcagcgcgggactggcgggcagctcagcctgcagcctgggcacgggatccactaggcaaagccagctgggctcctaagttgggtggtgacttggagaacatttatgtctagctggaggatcctatatgcaccaatcagcactctgtgtctagctaaaggtttgtaaacgcaccaatcagtgctctgtgtccagctaatctggtggggacttggagaacttttatgtccagctggaggattgtaaatacaacaatcagcactctgtgtctagctcaaggtctgtaaacacaccaatcagcaccctgtgtctagctcaaggtttgtaaatacaccagtcagtgctctgtgtctagctaatctagtggggacttggagaacctttatgtctagctaaaggattgaaaatacaccaatcagcactctgtgtctagctcaaggtttgtaaatgcaccaatcagcaccctgtcaaaatggaccaatcagttctctgtaaaatggaccaatcagctctctgtaaaatggacgaatcagcagaatgtgggtgggcccagataaggcaataaaagcaggctgcccaagacagcactggcaaccagctggggcccccttcaatacggtggaaggtttgttcttttgctctttgcaataaatcttgctgctgctgtttaggctttgggtctgcactgcttttattagctgtaacactcatggcaaaggtctgcagttttacttctcaggccagcaagaccacgaacccacccggagaaatgaacaactccagacgcgccactttaagagctgtggcactcaaggagcaggtctgcagcttcactcctgaggccagcgagaccacgaacccaccagaaggaagaaactccaagcacatcagaaggaacaaactccggacacaccatctttaagaactgtaacacttaccacaagggtctgcggcttcattcgtgaagtcagtgcagaccaagaacccaccaatttcagacacaatactagggcaggttaagttgctggcagatgcatgcctctcccctctccttttggccttggctgtgctgagcacactgatacaaaacagtcgatctggatgatgttctatgtgatggagcaactggctgctttttgtgggaagctatggccagccaggaaatgactgctttgccttcttccctgcctctcttctcttcctctcttttttttttttttctcctctagaattataactactcccattcaaccctactatgcaaccttagaggctctatacaggaaacttgagctaggatagtgttagaaccaggattccaaagcccatgttttgttcattgtttttttctgaaccatcctggctcctgcagaaattcatttatgctgaatttaacagtaatttttaaaaagcagacttgcatcatgtttactatgtaccaggcagtgatccaggtggtttgcatgcattaactcaatctgtccttacaacagacctatgaagtaactgctgttcttagccccttttaagcaaggaaactgaaggcacagacaggtaagtgactgtaagggtcacccaacaatctgatctaatttgctattatttctgccttgattaacttgggcaaagtaactttaggtggtgctcaacttcctcacctaaaaactgaaaattaaaatatctgttttacatgaatatgaagttgtctgtgtttaggactttacaatagatagattaaaattttaaaaactcctctctcaacattactaaatgttagaaaaacaacatattctaagtgacatcacccagaagacaaaaactagcccaaatgccaagggcatttagatgaggattccgagtcaacgtctaagaagatttattcctgcccctgtaaatgacaaggcacattataaagatttgtatttgaagagaaaatatgggaggattactcctgacttcaaagcctgttaataagtttattacgtgtaagtcagactttgtacaaccgctggattgacttaagtcaaagggaaaattcttctttataaaagaaaggtagttaatattgctaaaaactgtggtcagacttctaaaattaacatccttggatgttaaatgaatactcagtttcttcatggccaagaacggaatattcatgcattcctttctttcacttcccttcaaagcaacagggaagcaacctctgttggtgtgagttttggcagtacagagagtgttttcaatgataacccatgaatttcacgtatgagaagaatggatctggcaaactcacattgtaatctcctccaaacactctccagtgctgattagcttttgaattctgtcacaactgctagtagacatagcacaatttcaattttttggccatctatgtaattactaaaaatgtttgttgaggcagtacagtaccatggtagatatgtgattttgagtgaagtaacttgaaatatgactctccttatggtgaaacaagttatttctgtctttctgtgtctcagattcctaatgtgtaaaatggaagtaatattgcgtggcttagagcttgggctatactagatgctaaaataatgttagttgttcctatgcccctagttattctaagagctatcagtaagacccctgcccaaagtccatatattcctacctgaatcatgtcccccctaagcacaggaactagcagcaacagttggatttgggaatggtctgatgttgtccactatagaaaacactgctacaaacttctggaaacaaaatgaatcaagctaatacatatgctccatttctactgaaaacacagaattgttaggtaaattgtaattgttttaagaaaagatttattcaaggttaacagcagtggcagcagcaacaaaaacaataatgaagaaaaaacctacagtgtctaagaatgaagaaactaaagtctgatgggcacactggaactgaagctgtagggcccaaagggttctggatctcagataagcatctgagattacagttctgttgcctcacataaattttaggagataagatctcagaatcatgggaggcagcagcctggaagtgacactcttacaaaaaaacccagagcttcagcgagctacactgcctatttaaaagggactaaataaccacacccagcatccctgggaagaaactacatggaactgtggttaactacaaaatgaaaaactgtacataaaaattatccaagatcacaatgtctagctttcagtaattgaggtagtgcttttattagatttaccatcccacagataattacatattctggaatatatatatgaaactgcaaggaaacctacatttggaagaaagaaacagcattgtttttgtataagggctggtcccagaccatgtcaacttgagtgactaaaactcggatagaaagtccatagatttccagcttgaagaaacaaagaacaaacttcacagcaatcacagcagctgaaaagtgaggccagaaatcctagaaaggagagagccacagagagggagacagccccaaattttgcataggctgacgcttgaactacataggcatgggatacattccaatgcaactcagctagtactaaaatgactttaacagatatttctgctactgcccaccacaggacagatggggtttggtgtttgagtccaagcaagttaaatgactggaaaacaaaactaaactcaacaaaaaatcccaactctggaaagaagtataaaggaattcagagtctctacaacatgtcagtcacaatgtcacctaaaactactacacatagaagaaacggaaagatgtgctccattgtgaagagtagagaccaatcctgacatgttgaaattagctgagaaggattatttaaagtgactattataataatgctcaaggatgtaaaggaaaatatggttttagtgaacgaataagtagaaaatctcaccagagaaaagaaaaaatttgcaggatgggcttaacagcagaatagcaatgacagaagaaagggtcaataaacctgaagacaacaatagaaattatccaatctgaaggacagacagaggggaaaaaagatttttaaagaaatgaacagagccttagtattgtatgtgataatactttaaaaatctaacaagcatataatttgaatcccagaaagatagggtaaagagaaaatggggcagaaaaaaaaatgtgtaaagaaataatgataaaaaattcattaaatttggtgaaagaaataaatttacaggttgaagaagttcagcggatcccaaacaggaataaatgcaaagaaaattacaccgaggtacattaaagtcaagctgctgtcatgtaaagaaaaaagacaattttgaaagcagccagagaaaaatagcttgtgttcaggagaaccacactaatgacgataaacttctcattagaaataaatggaggctataagattgaaacaacatcctaaagcttaattaatgtggttgaattagtaaacaaaggttgcttttcctcaaaggaaatctactgattcaaattcctaagaatttcttacagaacctgacaatatgatcctggaatctgtaacagagaaattataataggtagataagacttgccctatcaggtagatcaataattattacgaacctgaaagaaataaaattttacattattggcacagaaatagatgaactgaaccaagtagggaccccccccaaaacaaacctattcaaatatgagttcttggcatatgacaaaagtgaaatgaaaaaaataatggagaaaaataaactgtttaataaacaatgctgagactattggcaattcagagaaatataaaataaaattagttctctacctcaaagctccaataagaatagtttccatattatagtcccaaatatgaacaacaaatatttttaggattaaagagctaaacatgaactacaaacatgtaaacatttgaaatatagaagaatgttcttaagaccttagagtcagaaaggaataaaaagcacaaaccataaaggaaaagctataaattcaactactctaaagtttaaaacgttcattgaacaaatgggaaaattacacacacacacacaaaatttgtaagaacaccagattgggagaagacataagtagaatgtataaagaactcctataaaaacataagaaaaatgtaaaaaatacaaagaacaagggccaggggcatatacaggtaacccataggagatcaattctaaattgtcaataaaactttaaacatgctcaacctttccagtaatcagggaagtcgtattgaaacaatgagatactattttacattcattggatcggaaaatttttccaagtataaaattacaatgtattggtgaggaaatggaactctcatgcactgctgtgaattaaaataaccttttagaaagtaatttcatggccaagcgcggtggctcacgcctgtaatcccagcactttggaaagccaagacaggcggatcacgaggtcaggagatcgagaccatcctggctaacacggtgaaaccccatctctactaaaactacaaaaaattagccgggcatggtgatgggcgcctgtagtgctagctactctttgggaagctggggcaggagaatggtatgaacctgggaggtggagcttgcagtgagccgagatcgcgccactgtactccagcctgggcgacagagcgagactccgtctcaaaaaaaaaaaaaaagaaagaaagaaaattagacaactgaaaatatccatctatcagagaataggtaaatgaatgttttaaatggaatgctatacagcagagaaaataagtgcattagaactacatgtatcaacatgaataaatgtcaatacaaagtttggtgggaaaaatccagcttacagtttttgtttaggatttaaaaacatagaacaatcctgttaggttgtctatggataaatatatatggaagtatgacataaaaactaattgaggaaatgatacacaataactttagaagagtggtaacctttagcaagagaggtgggaggagaacgcagttagcaaggagtccaaaagggactcagtgaatttttatttctgtggtctctatcatacaaatctgacattttttctggctaaaccgaagttatctatttgcagctctttccctcttgctgagctgtaagctctttgagaactcagaatgacaataaatgaaacttgtggccagacttcccagttacatctccatggcaaacattaatctgtgatcacagcctactttctctgagcctgcacagacctcctagttcttcttaccccacacttcagaggctttaatatcttgccatctctgaaagaaatcaaatctgatctctctcatatctttagtatttgttgagaagaaatgaattaaatgagggaaatgaattacataaccagtgggcagtattttactatatgtgtgtatgtgtcttagaaagaatagaaattaatgcaactcaattcaattcaaaacctgtatggtgcacatatttggtggcagacactgagtaagaactgagcatacaacttttagactgaagaaaccaatgaatacaaaacctggtctgtaatgcctggcacacatgatgatctaggcattcatttggtccaacctcttcaatgcactgagaagacagaggctcagaagcatacagacaaaggattgatgagactagaactcacacctctgttgcactctgcttgcccatacaagcctgtttcaggggtggattatttctttataatgcagctttgaaccatgtctgaaatgtgtaagaaagacaaccagatgggctggataaactgcttttgtctgagctgcagccagactctgctcagtgggtgtggacaggctgccagcctcactgagaaagaactagtttggtctttgttcaaccgctgctcctatgcatagtactaaggaacagagatattctcaggacacctgaatcctgtgacgacattcccaagggtcagaagcacatgggttgcatcaatactaacaagaaatggcaagttaaaaggcaggctgccaaactttgacgaactggaaagagagtcggtgtgcaccagccagactgataagccaccttgctttccagtgcagccgctttgcagggcttcttaagcagcttctcaggatgacagtagttcactcaatggatatttattgaacaccttctatgtgctgagcaccatgctaggcactgagaatataaaataacctcatgcatttcactttaccatgacaagggaggctttaagggcagaatctctcaatgtccctcaccttatttgtgattttgactcctttcccaccaaaacattggaagaagacccctcctctgcctctcctgtctcccacctttgcttgtttccaaccgtcctctcattatttcatcagtcaactccctcatcaacttctcctgatcctgtgactttcccctattaccacttaaaacattctcaagtatctcaattacacatatgttcccttctaccgcttctctctccctgtgattcatagttgaggtttttgtattacgtttccctgctcagctggactgaaccaaacatgctccatgctctccaaactcagcctttcaataggctgctccgtctgcagctttgcgttcctccaaccccatctttgcctgattgattcctatcatccattgggactcatatcaggtgtcacctcttccagaaagcctcccctgacagcccaggctggtttaggtgccttttctctcagtgtttctatggcatccaagtgagttcattgagtacactcctttccacttggtctctgactcctctggaagactgagttttctgaagggagaggctgtctctaaatcctgagtcactggtgtctattgggttctcagtcactgtttctgaatgaatcaaatgggaatgaatgaatatgaataagacttagaactgctcacagtttgggcagcacaaggaacatgtgtgtaatgctttctgggttacaaagcattctgtacacatatctcttaattttcctaataatcctacaggggaaactattatttttaaccttcttttcattgaagaagtaataactcaaagtgattaaggtcatactgtgaaactgttggtctgagactcagtcctgacccctcaacttcatgttccctgctttttccatctcctgtaagttactgccttcatattcagatgtatacaattctccataaactatcctcatcaaaatctcatatctggaaaccagtcttctcaccttgtgtctaaccaaactacttattagaattgaagataagtcaattctggctaattttaacaaaagaagtaaagctagaaaaggaaataatacaaccagaacaatagagataacacttccatttttctccagtgtgatggatgaacataaatattagtgatattacatccttcttccaagtggcaaaacatctcaaatgtagggcttatgacaaaatgaccagagatttgccctgtgactcgctccttattaaaaccaggaaatctccatcctatctggtgagacagctgtgcaggcaacttttatccaaggtcacccttgagactcagctactactatatctccaacaaggtgttaactcgccaccagctccttctagacctcacaccctgttcatccaactgagagcatgcagtccatctctgactcttcatttgcccaaaaatctctgcttgtatgtccttcttttgcagtcatctggagaaattcaatcctgggccacacgaactatctgccttcttggcacttaccccaaggcttctaaacaggggctgcagaaacagcactcaactacatagactggtatttatggggctttccagctatgtctctcacccccttttcaaagtcaacttcctaagaaagttgtctacttcctccttctagttcatccctcctccttctttaacttgctgccactggcctccatttgtacactccaccaaacagctctctccaaagttcataaccacctgcatattccagaatacgaaggacacttccccattcttatctcacttaatctttctgttgcacaacccttgactgcatccttcttgagggtctctttcctcagcttacatgttctcacactcctctagttttcctcctccctctctgccaactgagatgaagtcttctttgatgctgttcttcttgtgctcaaaatttacatgctaatattattcagggtcccaggattattctttctcactcttctcagggtgatctcatccactctaatggttaaaatacatgctgatgtttcctttactcagggataccactagtgaatacattcctttcctcttggcttctgtctcccctaaaagactgggagctccctgaagagagaggccatctctgtattgcccatcactagcatctactgggctctcagtaactgtttccaactgcgatccttgtcctgatcttcagacctatctatccagctgcctaggaacttccccactgggtgatcccatagagcatctcaatatgctcaaaacagaattcatcatcttctaaccacaaaacactccctcttcctatgttttcttcttgaagaaaattggaaacatcatctacccagctgcataaaccagaatcctggaactcatccttagcaattctctttcctaactctctatatccaatcaattaataaatccagccaaattctaaatatctctcccatctgaccactgtattttaactccataaccatgatatgtttgaagaaatgaaaaaggtgcagtgtacctggacatagagtacaaggcaggtgatgttaaggcatttagactttacctttccacccccttctgccagagtggtcttgatgctgtggtcctagagctaaaaagtcttcagtaaaaataagtttgggctgccccaaatatgattttgtaggataagtaacatcacttttacttggttatttttaattacccagctaaactatggtattctatcacaaatttatattctgctaaacagaaaaccagctctctataaagttgctacagggaacaatgatttccagatgagtttcagctgtgtaaagtaatgccttaatgggaccaccagaattctgtctgtcacatttaagaagcaatgcaatatttaaggtaaacaagctaaactggatgtgtgtcgacggtgaggttcggggggaagaaaggatggaaggggtaatgaagaacatgccaggcttaagaatgcataggcatagttgacagattattgattcaccattaaaatggcattaatataaagtgaataaaaacatacgatgtaatcaggatgtgccttaagttagtagctgttaaaaagtcattgttatggtacttacatctgcccaaaactataaatagtggcaaaattcattaaagaaatgttaatacagaggaactaaagcatacacagtagaaagagaagggaacaacgtgctagcaaaaatctgcaaagacaactccgtcaatacactaaaaatcttgaattgttcactttcagtgggtgaatttcatggtttataaattatatcccaataaagatttttttaaaatcagcaatggcataggaataatgacctgagttgtaaaaatcaatcaatattcaaagaaagggcaggtaattttccttgatcccatggcagaaaaaccagaggcaaaaaccatttttacatttcttataacaaaaatagacaaattgcctatactaaaaagaaaaggggaaaagacattgtcaaaacacttaaagaaagcaatctaccgacgtctacattgaatattactttaattccactgttttcttctgaagactctgctcagtgagataattatgttttcacaaacacagaaatcatactgggaactattatcgtctttaaaaaactacaaaagtatgtgtcacaaagaaaactattgtaagttcagagaaagtatggaaggctcaataactagaaaaaacaatcagataaagaaaagagaaattctgggtcagtgatcatttcctttttaagacagggttccaaaaaaatgtagaaaagatggacacaaagcaggaatacccagctcctcaaaggcacacacacactcatgctgggcaattgttggaaaagacacgggatgcaaaatttttagtctctattagagaaacaagttagctcatgtgaaaacagagtccttttgaaatcactttccggatttcactttcagaaagatagatgccaaaagtggaaggcatgtatatgctcagaatttgatctgccagaataaaaattgattatacctgcctttgatatcattcagttctagttacccaagaaaaagtttcagctgataaagaaacgaaacaaaacaaaatgaaaacctgccctttgatttccatcttcagagatacctcgctcaaacacaggaactaaatgtaaatcacttggtcttaaaagtcagaacatgttcaattcactgattcagcacatggcttttacttaattaaagctggtctgaaaccagctttgtttccttatagctacccaatataagaaatagccaatgagcatgtggacagaaagggcactggccctggagtcaaaagttttagatcttagctcaactctggggactctcaaataaaccaattaaatctcctctgaaattaaagagctggcttttaatctttccatctctaccttaacatgccaggcatgtggtagatgttcaataaatgcttcctggattattactactaatagctaatagttagcaaacccttattaagtatgtacattatattaatcatcacaataaccctatagtgtaaattttcatattatttgcatgtcataacttcagaaactgaggtttagagggattggtcatgtgctcacgtgactcagctggtgggtggcagaaagatgaccgcagggcccaatttcttaatcaatgtgcactgccccctatctgaacttaactggacactggccaaagtaatcatagtgatcaatgaacaaatgttgctcctccatttaatctctgttttattgctcacctttccccaccatctgtctctctgggactgtcgacaattaaaacctagagatccttgctactgagagtgtggtccatggactagcctcgtaggcatcatccaggagcttgttggaaatgcaaaaccttggccacactctggaaacagaatctgcattttaacaaaacatccaagtgagccatatgcatatcagcttccgagacactggtttagactagatccaaagtaaaacacttccttcatgataggaggaaagaatgtccaagaaggaaaatatgacagaagcgttgtgcccagagagaacaaaaccagctggctttggctgtatcaggaccttccttctcctggatagtgacatatggatatttgtaagtcaggacctatgaagatccccagagaactggtgacagaagcaataactgaatctatagggagtgtatctatcattctacttctctctgaaatttccaaacctgtctttagaagcatgtatcatgtagcaaataaaaatacattaagtctttggcaaatacagaatcactcatcaggcaaagtagagctgccctgtggattgataaaactcaacatgtgtatgatattaccaccttccttcacaatccagcagttgcttcttgtcaaggccactttttccttttaaatattaacacaattttttttttagcacatatacaacactaaggctaacaaacgagcttaaactggatttaaatgagtttttttcagtaaggtttatggttttctttttaagcggtatgccttattcaggcagaaggtcctgcatttttggctgagaggtgcaggacagtagctgtcctctcacaagagagttcattttgctcaataactccacctataaaagtcatgcaaataatggaatgaagttatattttgatgatatccagatactgaagatactaattactgaagatactaatttttttccttttcattcaagaaagataattttacacttattctttgaaagagaaattctatggaattttcttcttctaatttaattccagaatacattctctcaaccctatgccctcatactagtaacttgatggttagcgggtaagtaggtagtagtagaagaacagaaagggaaatttggggagcagaaaagggagaaaaagaagaaaagggaaccttctagtttcctaatagaaaagctagagaattccattcctgaaaattaaagatattttacacgtttgtgtatgtacgtggctttgtgtttatacacataccgttttgtttcatgtagcataatcaaatctattgctaattgtttagttaatatttacttattcaaacatctttttaacatcttgcccaatattcaatttacattttacttagcaattagcttgtctggccacttgctgttttacttcttttcttaacaaaaacccaacactgatgttctaacagaacagtcttactgtcctttcggttattgtcatttctcttgcttccccaagggcagaagctctgctattttgcttgcaaaagcaagactgatatttcattgttgctacaaaagggtcaagatagagttatcgaaccctaataactccacctataatagtcatgcaaataatgaaaggaggttttagtagaagccaagaagtatatttgacttttttatttattcccgttttaaaaataaattacatttattttttaaaattacatttttacagatctacacttcctagaactaagagaatgacacagtatacaggtagaaattctttcttttattgagttttatcctttttgtgatttaaaatctagcaggtggtttcttttccttaatgccttcaattacacattcttcacactttctgctatcactttccctgccttcatctagtgataactagaataattagaatggatttcttgctaatcaatcatctaggtattatcttctagaaagtttgcaagacatccctccttcaaccaccgtggttctataaaaagaattgcttttaattctcaacactcttattctgttactgtcatgagacatcctctagtttcagagaatttctataaactgcctaaaataacctaggattttacaatgatggaaaaggaagaaagtgagcatgctcaaagtcagaggatgagagggaagcacagcaaagtctggggcagtgcaatccaaggtgtctggctcaaggcggagtccagaggccactgcaacctggagacacatgttaattaccaagggagcacctggcagggtaactcaccagcctgagtcagcctaggatgggagcttaagggggacctgaggaactccaagagagaatcacatgcatgagttttccacaagggacccaagttcccagcccaaatgagacaagcaatggatcgtattaaaagctagtaacaattgtgctgaagcaacctcttgctggtggcattgttaatggagacaccattctcaggcaaactttagtaggatatttgaagagcaacaaaagcatttatactttttgatcgggtaatcacactgtaaaaatatggggaaagggacatacacagagttgttccttgctaaataaaagagacaaaatttaataagataaatgtatacatcttcatttaagtttaaacacacgtatacatgtataggctggcagttgcctggactagcagctattcttgtgagaaagccctgggaattttggatcagccaacatcacagcagggctacttgggagggagcagagcaagtggtaggaacacactttatagtcaggcaaagaagggtctggatatccccttctacagaccatggcaagtcactcactttctaatacatccagccatccaacagttaaaaggcctttgaaaatgcagagcttcctaaaaaaggagatgcttcatcagcccctgagtttcctagagccagcactctccaggagagcctccttggtctcagaaaacacacgctggcatctacctcaacttcagaattgcacacctgactcttcctcctccagacctaggcaagacctccaccagagcaaaaccagcaaaaagcaaggagaagaaggtggttttaccggggtgtctggtgctgtaactatgcacaagggaggcagactcaacttggatggagaagcctggaaaattcaaactcaggtgtcaagaagcagtgtttcctaggatttacagagtgggaaagtattaagtctagtgctcagagtaggcacgtggtaagtcctgagactcccagataaaatgaccagcacctgggctcattctgtgaagaatgttccagttgggcctataattaatccatttaagatgtggaccagtttttatgaatcacaacaaacccttggtaagatccactttctttcctttagatgcaggccagcctctttgtttcccccgttaacacacattttcttaaattaaccctctatccacacattaagaaaaaatatctatacatactccatgaaaactgcaaaggtctcagattaatacagaaacgtaactttggactctatcttcttatcagcattcatttgaacactggtattaagtttactgtgaactttatcattcaaccatatgtaaaatgttacaatcattttatttacatttctctgagcaaaggtggtgggtatcaaccttgtccaacagacgagcaccttacttacatcaggatattagcagacaccaagtgaaaatgaatgatgcagtaaccaagtgcaagggcttcacagtcttattccccagatgatgctacttttggtctaggagaagccataggctttttggtcatcttcttcagccctcagttaatcaaggtttgtctacacattttatatccaaaaacatctcttatagttgcaaactctctaaaatcagatatagttaaatatccacatgaagtaagatcaagttccctcttccactgtattgagaagctactaagtgtcaggggctgggatggggtttaggaacacaagctaaacagagctctctctcaggggctcacaagccaggggaggacacagtgaattctcaagagtgtgaacagaagtgtagcggggacccagaggaggagctgctcaacatctgggcattggggaaggttgccgctgataaagcaccttggacaggaatcttgaagaccaattaggagctcacgtgagtggaaagcccgttccaggagagaggaaggggtatggtgggtcggactgtgcaatctaaggaacaatatatgcatctctggatgtctgagcaagaaagtgagttaggtgaggataatgataattgttttcagatatctgaaggactagcagattaggcatttggttctccatgtagaagatattactagacttgggagggtaagggggcagctataagagtgtaaatttcagtttaacatgtgtgagaacattctataaaacagaactattaacaagaaaactagttgccttaagtaagcaattttacttcctgattacatagttttggagtcattttggattctaattctaacttagctcatagtaagtgcttatgatacatataaatagtagctattcatattgtgagatggtgaactcactctcacactctgagttccagcaccataccacagcaaattgtcttctatggcaaagtctcatgccccagtgtgagtgtggaccagaaaccatcgaaggtccttcccagcctgggactctcatttggttgtctctgctcatttatgatttggcattattccctcaactcacatggaaagacactgaaagaaaggtttattaaaaacatgctatagaccaggcatggtggctcacacttgtagtcctagctactcgagaggctgaggtaggaggattagcttgagcccaggaggtcaaggctgcggtgaagtttgatgacaccactgcactccagcctgggcaaaagagcaagactctggctctaaaacagagaagaaaagaagagaaagaggaggggaggggaggggaggggaggggaggggaggaggggaggggaggggggaggggaggaggggaagggagcggaggggaggagaggggaggggaggggaggggagagacaagacgaggagaaaaaaggagaaaagaaaagagaacctgctgtatacatgttggctatcattactactgttattatttcctctgatattatctttctattaacacaattattcctgatccctgattttaatgttttattcttgggtgtatgtatgtgtatatgtttaatgttatgcaaatattcttgtaagccaattcaaatccttggtatagcataaagtcataaaaatagaataaaataacattatacagcttattttctttctttcttttttttttttttttttttttgagatagagtcttgctctgtctccatgccgatgaagttgataggtcttcctaggaagcagtaatcagcctaccacctctttctcagacatcattaggtaaatgctgaatggcattagcgtttagtttttaccaacctaggagaaatggaaatataatttcatacatcattactaaaatgggtgatcaaagctcactgtagcgttgaactcctggcctcaagcaatcctcccacctcagcctcccaaatacctgggaccatagtcacatgccaccacgtccagctaattttatttatgtttttagtagagatggagtttctctatgttgcccagagtgatctgaaactcctgggctcaagtgatcctcttgcctagactcccaaagggctgaggttacaggcatgagccactgcgcctggtctacagtttatttttgatgacacataagaatcactaatattcatttaacacttataatgtatggggcattatgataagctttttatatacattatttcatttaattcttacaagaaccctctaaggtaagtacaattattatccccattttataaggcaacgaagttgagtcttagagaagtcatgtaatttgctcaaggtcacaactaataagcaatgatctaacccagtaattttgcaacatggcctacaacacactcacattaatgagtatgtacttttctttaactttgaaaagttaaagagttagacactccagaggccaaaaacaagtcatttaatccaataaaacagttggcagcactgacagagttcatttggtcttaatctcacactcaggacactgttgggaagatggggcctgcagagtaaccaggtcatgtttgtctacacggtctttgaaaatcaaatcaaaattttcaggattctcacatattgcatgattccattcatatgagatgttcaaaatgggcaaatcaagaaagaaagaaagagaaagaaagaaagaaagaaagaaagaaagaaagaaagaaagaaagaaagaaagaaagaaagaaagaaaggaaggaaggaaggaaggaaagaaagaaaggaaagaaaggaaagaaagaaagaaagaaagaaagaaagaaagaaagaaagaaagaaagaaagaaagaaagaaagaaagaaagagaaaaagaaaaagaaaaagaaagaaagctgcctagagctaggggaggaaaagagagaggtagggaggatgggtacaaagtctccttttggagtgatgaaaatgtttaaaaaatggactatagttatggtcacacaactctgtagatattcaaaaaaccaatgaattgtatactttaaagggcttaacttgatgatctgtaaattatacaatatcaataaagctgttaaaaaacgatttccagagctcagtatcaagtgttctctagtcactccatgaggctgccgtcttccagaacaaacatagtaaccagatgtgtgtaaagtaagcttgtacccaagaacaaaatgttccaacaacaatgatgagagtaatgagcatgctggtgaagttggtaggtcttcctaggaagcagttatcagcctaccgcctctttttcaaacatcattaggtaagttctgaatggtgttagctttgagtttttaccaacctaggagaaatggaaataaaatttcattcatcattactaaagtgtgtgaaaacgagcagaatattataaagagcagcagagggggaatcaaaggaccccaaaagcttccattcgaatctactacgaccttgtagacttgaggactcaatcattttgggcttcagtgacttgatctgtaaaatgaggaaggggaagtatgaagtcagctactctaaggttttcttctgtcttcagcattccagtcaaatcgtcccttctaaggattgtcttggtatgctgacttgtccctttcatcacatcatcaactgcgtttagaccaaagaattgttatccagacatctggacatattgaaaatctctcaaagaatctttcctggactgatgtttcaggtatttacatgaacttcctccgtatcctttattaaatacactatctaccttatagtttaattagctataaaaacctaactgaaattttaagcttgacacagaaaagtcaaaaaggtgtttcctaacatgatgtataagggcagcaatataattgttctccaaagtaaaatgattctgtcctttataaaaattcattttacctcaactctaacctgtcacttctaatcaattttaatttttattataaaaatgataaattctcatctaagaaaaccttaaatatatacaaatttgaggaaattaaaatcagttttagagccaataccttaaatagattaagagtaatgttagtctactatttctactattatatgttggtatagtctcacttttttctccatgaatagtttttcccttttttaaaatgaatataaagtaatcatgtttaaaataccaatatgtagaaaagtataagaagaaaatataaatcatcagaaatcccaccttcaaaataacccctaaatccctattaacttaaggtgatcatccgttctattgtctctgtaagcataacacacacatagagaggtatattttaaacacattcagatgtgtgatggagagatagtttaatatccattatttttacttaaatatctatcatcaccatttcctcctattacaattttccataaataaaattgtgatggtccgtcatgcaattttcttctgctactttatgtttttattatttgcaacttttcatggtaataaataatgcttcaattaacatttttatacttaaagcgtctacactcctacctagaaaatttaaatctattgactttttccttttgtgatttcctctattgattttgggaagagaaagtgcttacccattcaaagatcagaatttttattttttcgtttcttttctttcttttaagttagctccttaatctgtctgggttatcttgttctatattgttaaaggttctaaacttatttgtaacacgtttaaattttagccaaattgggtagaagttatttgcccaatatttttcaaatgcacatttatgtcttttaaaaaaatatatgtctcataatcttggttatccactaaacttaaggaaaccttcaagactgccaaataaccagagctttgattactagcaggaagtcatactgggcagaaataaagaggacactcctactggccaaattaaaactaaacaatcagaaaagtccaagttcctagctttagtggctttattattttagccttaaaaagtctctaaaatcccaaaagtagcttaagtgtttaaaagacagtattcaatgcagtgggctattctccatacggcctggccactactggtctcatttacgggccatgggcaacctctatatcctgccattggtcaccaggttcttgccactggtcacgagcagagtaggtgagaaagtggagcacaagcttaccaacccaagtagagaaaggacaccaatggcttgccttgctggttgacagtaagtcaacagagcatcttctaaatgaagagcagcacagatgtcagtatctacatggttgtttctcaataataagtactgggttatattggacataatacaatccaaaatgtattaggttgtatttttttcttatatttttctaatattggattctattttcagttcttccccctccacagcaccttctgatgcacaacactgtcatagctgcctactagttgctctgacttaggtcaatctaactttcttgaatagtttcctcaactgtaaaatggagataataaagaaaatcaacaacttaaggttgttgtgaggattaaggaaaaggcttagaacaggccgggcatgtttacaaggctcatgcctataatcccagcattttgtttacatggctcatgcctgtaatcccagcattttgggaagccaaggtgggaggctgacttaagaccaagagtttgaggttgcagtgagcagtgatcgtgccactgcactccagcctgggcaacagagtgagactctgcctcaaaaaaaaagagaggggggctggggcttagaacagtgactgcacttaggaaatgacttttatgtgttcattattattattattattattattattaccactattctaccacttctgctatgactattactactaactggggtagtactactaccccagaaatgctgggtcaaacttaaattgggttcttcagaatgaaacaggcaactggggagctctgtggtcagatcagctccaggagtatactctatcctcaacttttgcaatccctctgggaagttaagtatttactgacattactaaaatagtgaatttccagggtggatggcatcacaatctcccacattttctggtacgtaaccataagacctatgtgcacacaagcacctggttcttgaggggggcaagaaccaggaggttaggcatggaaaaggcagatgtggcacagttcattttagtcaatacatgaagctgacaaggctataaactgcagatgaaaagcctgcacctcccaaaccgtacgctgcaaagatcaagactatgtgtgatcacacaggaacaaggagtgatctgggctgtgaagaacggaactggtccatcaggtgaaaatctaccaaggttcgacggtcagaaaattcatctctaataccactactactcctagttcttcaattctttcctcagagtcctgatcttctactgccatgcaacttcctcaacgtttggggcgtagccaattcaagttaaaaaagtttgcctaagaatttctctccagctttgaaactcagattcattttataagaaaattggcatcacgcccttctgggtcacagcgaggtccataaaccatctgagatgtgtgagacatctaagtcactttgactatcaacaagaaagcatgttggataaaaattaattagcacaaaactcaacttaaaattagatggtatgttatgagacaaatgctcatctcttattagccaaaagacccagatataacaaaattaagccagtccagcagaatgagagcaagaatgcaatgtgtgttccaaacctagaatcaggaataatctaaggtttgcttagacactttaccccaaatttacagattttgaactctctactgtacagtccttttttttctcccacgtttggaggaaacattttaacgtgtatattctctgggaaaaccctaaaatctggtttttagggagtttccctcttatctaatcctttgccacattatttttgtttcgaatctgtggtctttgctttgttaccatctctagatgaaaagctatgaagcacttgggaacacagaaactgagatccacaagatacaaatgagtttcatgtaagcttttaaagacctttatctgtacccatcaagcacaaacaagtaatcaacgactaaaatgtcttaatatttctctctaaaatcatcaggcagctacaatcaggtggacaagtcgttccttaaaatttaatatcatttaataattaataattgcacaatagcatatatgcgtagtaatagcatatatatggcatgtatataaaacatagcaaagtcatagcaatctttgcacttttgggaaagctaaaatgatgtaataaacttactgttaaagaaaatatctacagaggcaggggcaataacacagctgtacaattgtgccttagggggtataaaatacagtccactttgtaatcccgaaatggcatgcagccataacattgtaacttcaacttagcactgatggggaaagggatccttaaagtttagcatatcacctcagagatcttttttaagtacctatttctgtctcccttccccctcaattttttttaagcagagaagaacatgaaagaacagaccctttctaatacactgtatttcgcagtggggaaaaaaggagaataaaatggcaataacagaagcatattagcatatttaaaacactagtacattaccctgaactaaagcatccttaaagtaacatgaaagcaagagaaactatatttcataaagtgttgcaaactttaaaacaccaaattgaactactcctatagaacaatttcatgccagattgctttggtggcaaattaataaaggcagaattgctctttagatctttaaattaacgagattaaggaagacaatgtctttctctgtgcttaattatattgacttaatttcttaattactattaactatacttttatgttttacaagtcacactccatttttacagctgttctttaatcctcgggtaatctcgtattctgaagaatcacttgagaataaaaacagcaaaactgaagacaaaattcaattgggcttaatccacctgtacattctgcctgaatcaattcttatgccagtattttgaggcattccagaaaagtgccagacttttcaaagagaaaaattaaaatgatattctggttcactgaaactccaaggagtaggcctgaagaaaaaccgtgcatcagacaagcacgcaccagtggggtgagggaggacaaccccaactggggcccaacactccactacttaacgtttcaaaaaataaaatcaactgtgtataaaatcatatttatacctagaaggtctagtgcgacgacacaaagaaagcaattataagaaaggaactaggctaggcaaggtggctcacgcctgtaatcccagcactttgggaggacaaggcaggcaaatcgcttgagccctggggttggagaccagcctgggcaacatggcaaaacctggtctctataaaaaagtataaaaaaaaaaattagctgggtgcggtggcatgcacctgtaatcccagctattcaggaggttgaggtgggaggatcgcttgagcccaagaggttgagactacagtgagccatgatcattcaactgcactccagccttggtgacagagcaaaaccctatctcaaaaaaaaaaaaaaaaaaaaaaagggggcgggggcagggctgatatttactaacaagacctctggactgcaaatccaacacagatactaatatgtcatttccacttggcttccagttgtatttaatatggtcaaaaaatgcatatattataaggagaaacataaccccctaaacctctgcaggataaacgaactcacattattttctaaaagaacgcagcaacccagtctgtcctatcatcacaccgtgagctcagaaagaaaatctgacacacgcagcagaaagtgcaaaatgttatttactaacctggtgcccctgtgaaagcagttgctccatatcaccttaaagaaagaatccttactatgaaaccaatctccaaggcagctgatagccaagaggtggcaaaatcgactaccctgagaatccaaataaacgggcaaagccttcctgttcccaagcccagttttggctgactccctcaaggcaacttaagtcatagccaagcccacaaagcactttagcctataagctttagtaatgaacttgaaaccactccccatatgttaaagagacaccggactgctgtgagaaataaaacccacatacagaatgagctacagcttcaggctgcacttttgtacttgctgcccaagaaaaccataacacaaacttaaacaaagagaactctcactcccttctctcccctcagacactgcaataaagtgaatgattaattttaagcaaggggatacagtctgccctccattagggccatgaaatgacttttatattgttcaagttgtgtggcagttatggaacagatagcactgtaatttcacattgcataagagggacatatgaagttatcatttctgagaatcaaatgtagatagtattactattttcagataacattgaataagcttaaaaacctcatcaaatccaacgattaacataagttcaataggaaattttgtcaaagaaccttctaacttctgattctgacttagtgtctataaatcttaaaaacattcttataattcagtttcaccacctacatttagaatggatgtataagctaagacacgtcttttaacatggatctttaagctgccttttaaaatggaacttaataccactcactaagatttcaaaataagaaatttatgtttcattctagaaaaatgtagtcaatcaattccttaaagcagttagatcttaaaacagagtcagtaatgttctagcatattgttagaacatcagctttttaacacaatgtgttcacagtatacttattttcccctagttttcaactccaagaacagttttaattctaatggcttgttgccatgatttgtattttgtttaaatgagacttatttcaacacaataaccaaggtttttgaactttaattattgtttctcctaaaccataagattggaccaaatatgcaggcaaagcttgattcacctgttgccaaactgatttacatgaattactggtaaaattcaagttactcaaaacctgtgaaatataagccattagctcaacaaattcacccatgaaaatcctggagactattttagatctaatacacaccttgcccacccctctacccactcccaggtcagggctcaagaggatctcatggggtcaccatagaatgagggggcaagataatttcttttctcagggaaaaaagaaaacgagcctcaagacctgtggctgatgactttaaaaggagctagtaccccacctgctggcaaaaccaagcgaaagctggatgagctgaacaaacctcaggggaaatgttattactttgatgttggaagaaaaacagagaaggagcagctatgcgagcacattaatgtcacattcagtatgtcgttaaatattattaaatttttccccacaatagtgatatatttctagaggatataaaaatgctcatgcaaaaaaagtagattcaaaaccatctattttacatggatctggtttgcaaacatatatgatgatttgcatgcccaaggaaatcctctgataaataatattgatctctcctctgcagaaagagcttcaaaaaatactcctgggagaccaacacaatctttgaaatggaagaaatatgaataaatccccaactcagctagataaactactggtggggctgtgtctccatcagtctgtatgtctgtattcccagaatttctcttatctttcagcaaaaatttatttccttttgccacatataaattaattcttctaaaatgaatatctgatattaaccttaatgaagatgaagaaaagttaagtggtgggcaccaaattacactacattctttaataaaaccccgcaataataagagtatagcaggatatgacttttaaatgagcccaagctgtactactaaaactaaaatgaggccaggtgcagtggctcatgcctgtaagcccagcacgttgggaggccgaggcgggtggatcacgagtcaggagctccagatcagcctgaccaacatggtgaaaccccatctaaaccccgtctctactaaaaatacaaaaattagccgggcgtggagtagtgcacctataatcccagctactcaggaggctgaggcaggagaatcgcttgaacccgggaggcggaggttgcagtgagccgacttcgtgccattgcactccagcctgggcaacagagcgagactccgtctcaaaaaacaaaacaaaacaaacaaactaactaaaatgaataaggatagctattatataagctcttccgatgagccaagcttggttctaaagtgctttataagtaccaactcatttaaacattaccactctattattataccagtttgtttgtttgtttgtttgtttgagacggagtctcgctctgtcacccaggcgggactgcagtggcgctgtctcggctcactgcaacctccgcctcctgggttcacgccattcttctgcctcagcctcccgagtagctgggactacaggcgcccgccaccgcacccagctaattttttgtacttttagtagagacggggtttcaccgtgttagccaggatggtctcgatctcctgacctcatgatccgcccgcctcggcctcccaaagtgctgggattacaggcgtgagccaccgcgcccggctattataccagttttacagatgataaaactgaggcgtccaaaggctagtaagtacactgccaagatcacacagttagagacagagctgggattagaacccaggtcggtgctcctagccatgtactttaaaaactctttcttcctgagtgcgtaccacttaaaccctgccaggccctggtcaaatgcaagggcgggggagacagtggataaggcctgcactgtgaacagtcctcataaaggctttccagagaagtggccacagaactgagacctggaggtgacatggaagggaaagggtccccagggagagggcactcactcagtctgccaaggcaaagggtaaacggggtgggggacattggagggactgcctgcagggaccttagtaaggctgagggaccagcagaagaaaatgctgtgaggaaggcagagtcctcttatgtcacatcatggagcaaagaggcatcaccaacggatgctaaaccggaaagtgtccagatatgcatgttgaaaaggtaagtaggaggaatgaggcctttttgggtgagtaggaatttagacattccaggtaaaggcaagcacaggccagtgctgtaagacatacaagtttatactttcataaactgtatcaaggaggcttgtgccgtaaaccccgcagcagcatgcgcactggctcccttgtcaagccagctcggggctggagccacgtggtggttactaatgccattcacagagttagggacaaggaggaagggcagggtggtgggaggagggtggggagatgctcaagccaaggagttcactgagggaggctgggtttgaggtcctctgagctgttcagggaggatatccagcaggccccaggagatgcaggccaggtgctacagtcctttgcctagacagcagaggtgcacatttaggagtcactgacactgaaggagcagctgcagctgggggacagtgggacacagagtttgtccctggaaaatgtacagcatgagaagaaagagtgaaatttaaggcaaggctaagggtgtcagacagaattcaggctgttgataaaaaattttatttttatttttactaacttctaactaaaattatcatttccttctgtaacttgtcatcaaagatattttctttgacgtcaaagatattttcttagacatcaaggatttttcatatcacattagttattgcaatatctcaaagtatcatttccactcatcactatttcaaaattacagtagttattagacctgccactagatactggtaagtaatgcattttaataaaggacatgtattacaatatgacatatttacttctttgcatattgataactttatgtcagtataattggtttcctttgtaatcctatgcattttaattttatgtgtttaattttacagaataaatattctgtagagtggttcattagcttaattagaatgtcaaagaggtccccatggcacaagtaaaagtaaagaacatctgatttaaagagggaaagagcccagcgcagtggctcacgtctgtgatcccagcactttgggaggctgagaggggcggatcacctgaggtcaggggttcaagaccagcctggccgacatggtgaaaccccgtctctactaaaaatacaaaaattagccgggcgtggtggcacacatctgtaatcccagctattcaggaggctgaggcaggacaattgcttgaacccaggaggcagaggttgcagtgagcagagactatgccactgcactccagcctggatgacagagggacactctgtctcaaaataagtaaacaaaaaaaattaattaattaattaaaataaaaggggaaagaaaaagccacaggaaaacacttaaaaatagctctgcgaaaagggggaccctagtatgagatggagacagctttcaaagctaggatgcaaacgcaggacttctgactttgtgttctttctaccacgtgactccacaccctaaaataataaaaacagtaaccccttcatttgcgtaaacaaagggctttcacatgtattagcctgttagttcatcacatctattcagagtaggaaaaggcaggaacccaaacgtgccttgaagctgccatctaagaagacactccttcctgggcctcagcactgcgccagtgctgcagcggacggtggtacctgtcaccccactctatggagctgtagtcatgggcacagaagagtaagatgaagagcccctccctcataccacactagctagaacctgatcgcaagaggtgggcacagtgggtgcccacccaaatgatgagttgcacttctctccaggcttctatttacaggtaaggctaagaatttgtttccttgctcaaagctcttttatttagttctgattggtgatccagagtgaattacaagatttgcaatatttcagctctttaatttgccattggctctaaccaagacagaagactttacttaagcaattggtttgaaattagatggacaagctgaaacaatgggctctctgttctttcctctctgtgcccaccaactggcattcattatttaatctgtgacgtgtgttgccagggctgcggtaatgacaacggcacctattgtcttcacatcccttccctattctgtaacatctgtcatggctcctgtctatatttcattttattttgttttattttgcttcttttacttttacaaggttattcttaattactacaaattgctctgaaatctattctaaccctgcaaagtgtagcatcattttgtaacttggcaataacaataaactgaaggcgcgtgtgatagcacccttttaaattactgtaattttacataaaactgtataatttcaaacaaattttatctcaaggttaactagataacctctctttttaaatacctgatcagttcacagacgactttggccccttctcatataatacatgacttccttttacacaataatgagaatgtgggtttatatgactaatctgacacaatacagtaacttctgcttaaaaaaaaaagctgaacatttcttaatatgcagttacaatgtaaattactatgttcatggatggatctttaatttccaagtttctctattattttctttcttttttaaataaggagccagagtgaaaattgtcacttgccttgtaatcagtcacctaaaaactagagtgaaaattgttgtgtgtgaaaagagttcaaaattggtttctatgtcccaggaaccggagagctggtcttcctactgctgtctgtctcaggacacagcacacccatccgctgtaggaaaggcagaggtttcgcttagagctgcttgcgtgtaagggaagagggaactcaacctggcaggaacaagcccttgatgatttaccttctttcctaattgcccagaggcatttccttccttgcttacccaatctaaggaagggtttcctactgccctagcagttcctttaacctgaagccattttctctagttcctaccctgttttttgtgttgctctcaatctgctttctcacaagacctcactttccagccaaattggtttattctgtttttcaaattacctagttcttccttccttttgagtttgtgccactgtcccaactgtggcaatgcccttccccctcctcgacagtaaaggagtcaaatcctccccagcatttcaaggggcggcccaaacccatgtcctctacaaagcattttcaggtcaccctgctttaaaaaaaaacaaaattgctcaacaactacagcaatcatcatcagcagccgcaaatccattaggcaacaaattatgccttgcgactttctattttatctggatgggttatttaaatagtgatggcatttaacttttcatgcatttataactacttcctccaacttagtaatcagtaactacatattacaagttatacctctgaaatcaaccattgtaaaaagcatatagcaaaaattctaccttacattgcattcatatatgtatttgttgcttacaagatatttaaattatttatgttacttaatgataattacaaaataatagccaacactattgccataatatcttactagactcaatatcttatttgacattcacatctgccatatgaattagatacaattattttcctcatttttcaggtgatgaaaatggggccagaaagcttaaatttcccaaggtcaggcattcaacacgtacttagtgagcacctactatgcgacaggcattgttttcagcattagtgatgaaagcagaaaacttctatcttcagggagtttatattctattagggaagacagactatcaaaaattaaaacaaatatatataaagccagataatactaagtgttgttaagaaaactaaagcagagtaagggactggagagagatggcatctggagagagatggcataagtggcgaggtagcacactccttagataagatggtcagaagaggcctctctggggagatgacacttgagcagagacctgaacgaagtgaggtgacaggctctgtaatcatctgggaaaagggcccaggcagaagaaacggaaactgcaaaggcccagaggccaatacaaacttggcgtgttcaagaacaacaaaaaggccagtgtagtcagtgctgtgaaagaaagggcaacagtagagggtgtagtgagagaagaaactagggagtccagttatgtatggctttgtaaaccattgcatagtttcatttacgtttttccttaaatataatgaaaaggccctgaaaggttttaatcaagaaagtgaaacactgtgccatttgaaaagattacacaagttgggtaggtaaagaaaagactaaaaggggctgggcatggtgctgtaatcccagcactttgggaggccgaggtgggtggatcacttgaggtcaggagttcaagaccagcctggccaacatggtgaaacccccttctctacttaaaatacaaaacttagctgggtatggtggcgggcgcctgtaatcccagctactcaggaggctgaggcaggagaatcgcttgaacccaggaggcagaagttgcagtgagccgagatcgtgctgagatcgtgccactgcactccagcctgggggacagggcaagactctgtctcaatgaaaaataaaaataaaaaaagaatagactgagagaaggcagactacttaggagaatattgcagtagtccaggtgggagatgaagagaagtagtcagatctaggatctactgtgaagatagggccaagaagattatctgatgtgggtcgtgatgcagagtgtaaaaaaaagagaggtgtcaaggaagactctaagactcatatgagtaacagggagaaaagtctaattattcagctgaggaacattgtaggtgatggggtctggggagaagcagtaagtttttggggcaaatcagcagtgccattttgggtaggttaagtttgagagaccttttagatatccaaacgaagagaagtaggacgttggatacctaagtttgaggcttggatacataagtccaagattcagtcctggggtttggatatgtaagtctgagattcaggcctggggtttggatatgtaagtctgagattcaggcctggggtttggatacataagtctgagattaggactggagtttggatacataagtctaacattcaggactggggtttggatatgtaagtctggagattcaggactggaatttgtatacataagtctgagattcaggactgagatttggatacataagtctgagattaggactggagtttggatacataagtctaacattcaggactggggtttgtatacgtaagtctgagattcaggactggggtttggagacgtaagtctgagattcaggactggggttaggatatgtaagtctgagattcaggcctggggttaggatatgtaagtctgagattcaggacgggggtttatatacataagtctgagattcaggactggggtttatatacataagtctgagattcaggactggggtttatatacataagtctgagattcaggaatggggtttggatatgtaagtctgagattcaggactggggtttagatattaatctgaggactggggcttgcatacataagtctgagattcagaactggggtttggatatataagtctgagattcaggaatggggtttggatatgtaagtctgaggactgggatttggatccataagtctaacattcaggactgggatttggatacttaagtctgagattcaggactggggtttggatacataagtctgagattcaggacttggaattcaggtggctttaaacgtggtagttagctttaagcaacatattttcaccacagactgactgagggtgaataaaggagggatgtctgaggactgacactcaggactctccaacatttaaataccaggaagaagagatgggtccagtaaagggggccaaaaaaaaaaatgccagtggggtagtaggaaacccaggagagtgtggtgagaaagacagaagccaggtgaaaagagtgcgtcaatgatagagagatcaattatgtcaaaggagctgagagatgaagaaagaggaagattgagaactgaccactggatacagaaacatggaggtcactgatgtcctaaagagtgggctcaagagaaatttatgcaaaagcctaaaaagtgggctcaaatgagaatgtgactacagggcattgctgagagaaattaaagacctaaataagtggatataccgtgttcacggattaaaagaccaaatattgttaaattttctgttctccacaaactgatctatagatccaacacaataccaattataaactcatcaagcttttttgtacaaattaataatctcattcttaaatgtgtatagaaattcaaaggatttagaatatccagagcaaccataaaaaaaataaaactaaagttggaggacttaacactacctgacttcaagacatcgtagtaagtctatagtaaccaggacagtgtggtactagtacaggatcaacaaatagatcaatacaacaggatagagagctcagaaatagatgcacacttacatggtcactcgattttcatgaaggtaagagaaaaatccaatagagaaaaaaaatgacttattaacaaatgatggtaaaaaaaaaaaactaaatatctatatagcaaaaataaataaatctcaaccatgacctcacaccacactcaaaaattgagatggatcatagacataaatgtaaaaactaaaattataaagcttttagatatggcttagaaagcaatcaacataaaaagaaaaaaaaacagacttagccaaagttcaaaatttctgttcatctaaagtcatcattgaaaaaataaataagaaagccacagcctgggataaaatatgtgcaaatcatatatctgacaaagaactaatattttataatacataatgaatgcctacaattcgataaaagtgagcaaaagatttgactggacatccacaaaggaagacagactcgtgatcactaagcatatgaaaaagtgctccatgttaatattcaccagggaaatttaagaaaaacgcaatgaggtactgctacatccccaccagaacgagtaaacattaaaaagaccgtcaaacccaaatgctggcaaggatacagagacagcacaactctcattcaccatgggtcacagtgtaaaactacaaccagcttagaaaaaagtctagccgttgtttataaaactaaatatgcacctatcctatgacccagttatttcattccaaagtatttatccaagagaaaagaaaacacagccacaaaaaaagactccattcaccatagtcaaaatctggaagcaactcaggcatccacccgtagaaaaatgaataaacaacctgttgtatcatcaaacaatggaatgatactcagcagctcagaaaggaatggattcactcagaaaggaatgaatgactgatacacatgatatgaatacatctcagaaacattacgctgagtgaaagaagccttacataaaagagtacatacattgtatgattcaattttgttaatcttctagaaaggcaaaaataacatattgtgggaaaaaaatcaaaacagtggttgcctctggcagagcataagagggtggtctggggactaactgggaagcaacatgagggaactttctgtggcgatggtcatgttctgtaccttgaaaagggtttggattgcagaggtggtacatgcatttttcagaactctgaatggtacactaaagatttgagcatttcagtgtatataaattttacttcaaaagagaactataaacaaatagggaaggaaattaatcatatgtaccctgaaatgtttaggagtgagtgtactgatgcctgcaacttactttaaaatgtatccaaaacataaattgaattgatgaaaggataaagggatagatgggtgacaagacgtatgttcaagcaataaagcaaactattgattgtagaatctaggtggtggcttatgggtgttcaccttaacattctttcaactttcctgcatgtttgaaatgtttacaagatgttgttagaagagaatgtggggtaaggaattggagacagtgagaactgacaacttatcagagttttgctttaaagaggaacaaagatatgaggcaaatctggagggagatgaagaattaagaggaggtatttgtaaagaaggaagacattatggaatgtttgaataagaatgatcctgtaaaaagaggaactttaatgaagctagtgggcagaaactatggaagcagagttctgaacaggcaagagcaacagatggggtccactggggtgcaatggatgtcaaccaggaggatgcacgtttgtccatggtaaagagcaggggatgggggacagatgatggatggatgcaagagaatatgggagctgggaaactgcttctagtttcccagtgatataagcagtaagatccatggctgaaagagagagtctgggaagggatgttaggggtttgaggaaagaaacaaaggtgtgaaatagtcacctgggagagtgagtttactagggaagtagggttgccagagagggctgagtatcagtggaggcaggggtggagggtggcgtgattaatttaatgtcatcagagtgttgtgtgtgtgttttccaggaatgctccgtggtttggaagaaagtgtagagttatgcctgagtaactgtgattttaaccagggttgtgttttgcaggagactaggatagaaagaggagagaggcaagtagagtaaccacaacagtggaccaagcagataaggtgagtaaagtggaaagttagactacacagggcattaatggaaagtaaaaaggtggcagagtcaaaggagtggacgtaaaagtgttgatctgaggatattacaagacagagcataaaagttggcagatggtagagctgggatttaaatctaaatgtttgactcctgttttttttattttattttattgattgagatagggtttgtttgtttgtttgcctgtttatttgtttgtttattgagacagggtcttgctctgtcaccaaggctggagtacagtagtacaatcacggttcactacaacctctgcctctcaggctctagtgattttcccacctcatcctcccgagtagctgggactacaggcacgcaccatcacactcgactaatttttgtagtgatgtttttgtagagatgcagtctccctatgttgcccaggctggtttcaaattcctggctcaagtgatctgcctgccttaggctaccaaagtgctgggattacaggtgtgagccactgcgcccagcccaccctcttaactgtaacactctccagcattttcaggactcttgtcttatactctctgtgtctggatagtatgtgtacccatttggtcttttcaagacccaggggtattatttgacttcatattcttaaaaataacttctacggaagtgattttctttcatagaatgggaaatataagacacataaagagctggtgtaatttttgaacccttcaacaaattggctatcagagaaaaatgtatcctcctgtctcagctcaactctttgtgtcttatagttctcactcctaaaaagcacatgttgctgcttggaacaaaacaaataccacatttggaggatttgaagaaactagtctcaaagtaattatttcaagagaatttattttaaaaacatgtaagcactaagtcacctcattctcagaaggaaaaaaaaaaaaaagacagtagcacgtgttcaggcattcagaattttagagggaccgctaattgtgtatttaagaaaccatttgaataacatttaagtacccaggaaaaaaagtccagattccctagcctgaccttccactattaaagtccagtctcttatcattcccctgcacacatgccatgtcccaggcaaatgaattagccccattcttcccaaagaatgtctcatctctgagcttttcctcttgctgttccctcccctggatcaccaccactgcaacctgcccaatctttccatagacatcctatttttcttcaagctccagctcaaacacaggctccaagccagacagtgaccacactcctctagaaccaccaaagctttttacctgccacacataaggcatctatcactttgtatctggtatcatagctacctatagatagcaaatatctatagaaactccccccttagagagaatcatctaatatttgaatctggatctccatatttaccattgtagtggacacctcacacagtgcctggcatattatagtcaattaacagctaataacatacaaatacatattttagacggaatcataaggaaaagttaaatacagtgttaggtgcacctattttaagctcggcattctgtctctgaagtacagacagagtactacaggaatactacagtaagtcctgtacagatccagattttattgttgtgggatactgccaaagtatcctttgaaatgtttactccaatttaaatgcttgtcataaggttggaagagagcctagatctcaacaatttatgtttatgtcttacctctattctgttctctattccgaccgaatacggtatgagttacaaaagtgagccacatatataattttaaattttctagtagccacatcaaaagtacaatgaaataggtgaaaataatttaatgagtttatttaacctaatttaccaaaatactgtgtcatgtcaaaatgtgatccacacaaaaattattaatgagatattttacatttcttgtgtactaggaaatccagtgtctatttttttttttttttttagatggagtcttgctccgatgcccaggctggagtgcactggcatgatctcagctcatggcaatctccgactccctggttcaagcgattctcctccctcagcctcccgagtagctcgcattacaggcacgtgccaccacggcaagctaatttttgtatttttagtagagacggggtttcaccatgttgttcaagctggtcttgaactcctgacctcatgatctgcccgccttggcctcccaaagtgctgggattataggcgtgagccaccacgcccagcctccagtgtctattttacacttagagcacatttcaacttggactggccacatttcaattctcaaataaccacgtgtggctaggggacaatatactggacagtacaggtctagaacatccctgtgggcagaggctgcttctttcagccctgtactctctacagtgatttacccattcaatgggattaaatgcaacaagcatgtaaaaaccaaagtgttaaagcactaaacagtgcttaccacacaggaggggttcaataactgccagcttcctttccttcacatgcagtaggccctcaataaatgtttcttgggttgactttccaaactggaaacagtattataggattaaggccatcaggctccctttattctgctcagcagaataaagcaatcttgtcaccttaatgtaggttcgtggcacattttcctggcagaagaataattacccaccaataaacttttccaactatttggaaatagcaatttctcagaataaataaactattatcctgctcttcatcaatcccagtgaatctgattttaagcaaacctgtaggattcatttatccctggctgaactaataaaagtgaatttctgagtccaggaagataaagaaaagatccagtaagattgtctttctaaaccaaggagcagccaccctcaagtccatctggaaatggctggtaagactgattctgcattatagaatcctgtctgcccagagtcagagagaaatgcagcaatcgagctgtctaagcagatacttggatatccaaagtattagaattattctaatctcaaagaattagacagaataaagaattaggagcactagaatatttttatcataattgaatactgtttgaggactcaaacagcatttcagaatttcttttgctcaaagcaacattactgttcgggatggcaccataaaatttgtaatttaaacttccatgtcagttgagcttctgtgtcgtttaattacttactcaaaatacaaatcaacatttaaagaaatatattttatatataataaatatcacaaaatatctcatctgacaaaactgcaactagaataggtaacatgggaatttccttatgaattcttatctcttatgcaaacattctagccaatcaaatagatctttcaatacgtgcagtgcctccgtagtgatgcctcatgctaactaactcccttcatcggtaagttatcactgctttaaaccttcagtctctgtccatccatttcctgttaaattcctcctagattcactcaattcatccagccagccattcattaaacaaatattactgagttcatatctacagtagagtgctaggcacccagcacacaacagagagtcaaccaaacatggtccctgccctggaaagcttacagttgaattctcttcccaatcaatgcccattctgcttgtccacctctgggcccctctgtctctcaggctacatgcctgtgctgaagtaccaactaacaggtagctgaccagggttttaccgagtctgtatggtacattaggtgtctgtagggcatggtcatctctgtacaacacaggcctactttctggatttgttatgttggaatagattatctaccctgagtattttcccttatttttgtgatcaaattactttctcttggcaatgccttctttttttttcattaagtacctgggtgcccccaagtggatgatggttctctcacattgcaagagctggttgtacaaaatgcagcacccaagaacttcatgaccatattatcaacctaggagaaaaatgttatggatttgtgcaccaagaaaggaatctaaaatacatttgcatattttataactcatttgaatgtcatcatacccagaaaataaaattcaggccatttttcccttgttaatattcatggtatggtgtggtatgtgtatgtgtgttgggggcatggtacaaacaaggaaggttgatacaagttaaagaacagccaccttctatggagcagcaagcatattatcactgaattctcatttaggaaaagaaaatattttttccctggtaatttaatgaaatttagatattattagaaccaacttggttttttttaagaaaaaaaaaactagaaaaatattttgtaagaaaaaaaaaattgtatgattgtcagcctcaagaaaaaaattcagccgggtgcagcagtggctcatgcctatactcccagcactttgggaggctgaggctggtggatcacctgggatcaggagtttgagaccagcctggccaacatggtgaaaccccatttctactaaaaatacaaaaattagctgggcatggtggtacacgcctgtaatcccagctgctccagagaatcacttgagcccgggaggttgaggttgctgtgagctgagatcgcgtcattgcactccagccttgtgacaagagcaaaaatccatctcaaaaaaaaaaaaataataataaattaacttttgtgtttgtgagtgcatctgcacttctttttttttttttttttttttgtaaagactgaaaggagtatttctgggctggtaaactgatgagatgaatgacagagtgagaaacaggcttatcagtttaccaactgctgaaaaaaccaagccaggttcacaaggtaacaacaatacagaggtgatagaaataaatttttccttaatgcatgggattcctggattactcgtatacctgcattcattcagttagtgcttcaataaaccaagcagtttgcctctggttttctaatatcccgtctctctattagcttcccaaataaaaactcaagccaagagacaatataacaacaaataaaacaaggtaacaaacttttattacacatttgttgaattgtttaaaaacttttcatgtttcctgaacactcatccaggaaagtactgtcaagatgatgacgaaactcagtttattcctggacaaaagagctttgacacatctgcttgtggttatctacgttcataaaaacacatcactgtcatcaaaggcttaagacaaagaaaagcatttattaagttctgtctatatatagtacttcaactgccaactctggtaatttgtttgagcttagattctctgcgtcatgagaggagttggtttgcatctgttaatgagactgtttttttgaactgtattcctttactccaatatgtattgcataactaccctgtgctatgcactctgctaggcactgagaattcgaggatgaataaaacagacattgtcctcaaaaagctggcaaactcatggaggaggcagtctacatggcccagccaaaagtctactgtgcacaaacaaagctgtgcaaacacagaggggaacagaagtaattcagcatgctaagaaaatggtggtcagggccaactcaccaatgcacaggatttttctatctacaggcagacaagggaggaagggcatcctattcaaagagctccaaaggagaaaagcacatggcacgttctggaaccaaaaagccctgcagagggcgtgggacagagatggatgtatgtacattgcaaggctggaaataaagttgaaaaaaatgcatggcagccacatacagaagggtcttgaatgacactctaaggcgtttcagatccactcttgggtgatgggaagttcatggagggatttaagctgtagaataatgtaatctaatttatgcttcagaaagatggctctgtaaaactaggtacacgaagtcagcagtattcctcagataagagcccctttgggcagtggccagagtgggaatatctgtatacaaaagacaaaaaaaaggtacaaatgagaaaaaaatatttgtgctattgaaaacttggacatctttccattcattttaaaagcaaattttaagtgctactaactttgatgagttcacaatggctgatgaccctcaaattcttcacttactcttcactgtctatgacagaggagaataaagcagaaaacaaaacaaaacaaaatgcattaataccagttcctgattttagccgataatggtagcatcactcacttgctgccagatatcagaatgaagaaatactaactgctgtttttacctatgtctctctcttcatgactactaaataatagtatgtgatgtggctgggctgaaccacattgcccagaattccccttcttgtaggcttccacgtagggtcaaaggatattctctcctaagaggtggggaaaagaaaggagacagcaacattttgcagcatgcatgtacacacatgcctttacctagttattcaatcaagtactaatctactgctgctgtgaagggattttgcagatgtaaggtatgtaatcagttgattttagttagtcaaaagggagattatcctgagtagaactgaggtaatcagctgaaagtcctttaaaagagggcttaggccctccctggattcagagactccaagcttcagctccactcacagggatccagcctgctcatggtctacctgcctgactggttgccctgtggatttcaagcttgtttagccagtcccacaattgaggaagccaattccttgtaataaatcccttaatgcatgtaacctactaagtctgcatctctggtaaaccctgactgattcatgatgttacggttattactgttgtgaggacacagaggaagacctcttggcgtggaatcacccagaaagacactaaagaatctcactcttgtactagctctctcccaatctcttgcaataatggccaggagaagagaagattgtgagttaatttttcaaaaaatgagatttatgataatttagagatgcacagtgaggtgtggctatgttactaagctctggccaatgagatgtaattgggagtactggaattatgagacagggcctgcaaaggaagctggcatgctcctcttcctctattctctgtctgtaatgtaaatatgatgttgagagccccagcagccatctcagacaagggccacatcctggaggtggcagattggagagctctagagactgatgacttctagagccgtcatgccagctcccaacggactacttctggactgtttatacatgagaaataaagccactacctgggggctctgatacttgtagtgaaacacaattcctaactgatataagaattgttttctttagtcttcctattcccttagcagtagacttttacatctaagttgctacgttatcaggaatagctgtatttaatttcactgctatgtacataggacacattaagtgtttaagaggattagaggagacagccacagtaaaagctttttcgtatttctccatgtttctgtgttttggcaaaagaatatgagaacttttcatagtctgcaacaaatgccttcacaaagccacaaactttaattcccatggaatagaatttcatatggcaagcctgtggttacatccaaatccacttattcaacagatttgtgctgtaaaaaaacctcacactagcctatctctttagataggctctgtcttttcatgttggagtcatctaattttccccaaaccaacaacccttgcacatgtctggggtatatttttttgccgaatgcaaaccacatggtcatttcaaagcctataattcagttcaggagcactgggctttctggatgctcgtgaacataaccatcaagagtgacacacatttctggcagtcaccttgccagctccagctctattgtgtctctatatcacggtgaaaaactgcctgacacactaggcagctgacatgtgtagggaaaaaaatatcaggcctgtgaccaaggggaaaatgaagtgattaatatggaaaacacaacaagaaacatcaaacaggaaaaagctgacacttcctattcctttagcttcaagtaaatgtgttttctcctcacactgactgtaaaaggctggatcgaagtattgacatgatataaacgtgtcagatgtcttcctcacctggggccattcataatactgaagagtctttcactcctttttttttgttttgttttagagggagggagggaggtgaggttaacgtaatcataaccctgaaaagataaacttgggaaactataagcataaacacaatgggccgaagtgttcccagtgtgagtcaccactgttgtgccccagctcctttgttcctgccatttccttcctttcagagttccggaacattcctctctggctggcctggctccctttcccaacaccatcccttaaacactggtgttcttcaggcttctgaactcgacctagtctacctgtagactgtgtctcctcattctatgtcctcacagggaggtgagtctcatagatactcattcatacccacagctttactactcccaatgccaccattcctttcttctctttctcctgaaggcccagtgcctagtgaactgtcctaccagtatctatttcatcaagtcccaaactgaacatagtcatgcttttctaccttgcatctcaattccatcctctttccctgtctcacagcccagccacatatgcaccctgtacctccgttattggccccatcatgcacccaggggccagttccatcctcttatctattccaccttatttcatatactaagagtagtgggggctgggtggccccaaatgagattcttatattctgggaatgcagatggatcaggggcccctggccatccatcaggcattcagtaccacaccagctgatctgcaaggtgagaagggggccctcagacacgaaggtctcgctgagcaaaccaggggacaaaccaggagaaggaagagggcctgtttccctgcccagccccagactggctgaggctgatggagcaagtagctgcaggaagaagtggagaggattgtctttccccctgcctctgtgagtcacagagaaacacagtaaatttaggctcctggtgacaaaaggagtcaaggacatttctgcagggcacataccaggttccagcatctttctagagccccaccctccccccagatttgcaaacttgaaaaaaacaagtcctggcatgtgactccttttggcataaatcctcttcaggaggacaccagctatggctgaggtggagcctcacacacaaagccctttggcccacggtcatcaacaaggaagccaaagcggaagactccccaaggaagtggggctctcaaaacacatgtgagacaatgccaagataccaccaggaatacctgaaggagacttgcattgaaggtcctacggatccacgtgggaacacaaaccagtgaaatttgcgtgatctccactgactagacatcatttgaaccctcatgctggcagggtctgaagacatttcgtaatctgtctccacttttgatccctactgtagctcccctacaaaacatttctacagattgctaccaaggtaatcttctaaaattataactccagtggtattctgggctggctcatataggctcctgagagcagactgggaaattttcatcaagattgggaaattttcagcaattttgtgagtcagttgttaaacacataaatcattaaaaattaaaatattaaaaattgaagttactaaaaattaaattatataaacttacaataaattatattaaagcaaaagttctccatttatcacttctttattacttttctatattttaataatgtctattgtcttgaggttacttatgcctattttatgtgtagtgcagtccccccttatctgtggtttcatgtaactaaaatttcagttacctgcagtcaaccatggtccaaaaatattatatcgctacttttgcactttgtagccattattaagtaaaatacagttacttgaacataagccctatgatactgataaaaccactgttaatctgatcacagagatggccaccgagtgactggcaatgctggcaggatggaatggaggagtgcaagatttcatcacactactcagaatggtgcacaatttataacatgaattgtttatttctggcgttttccacttatgtcacactgcctaggttattcgcctcacttcatcttcacacaggcattttatcatctcacatcatcacaagaaggggctgggagtggtggctcacgcctataatcgcagcattttcggaggccgaggcgcatggataacctgagatcatgagtttgagaccagcctggccaacatggcaaaaccccgtctctactaaaaatataaaaattagccgggcgtggtggcacacgcctataatcccagctactcgggaggctgaggaaggagaatcgcttgaacctgggaggtggaggttgcggtgagccgagatcgtgccactgcactccagcctacacgaggggagcaagaatccatctcaaaaaaaaaaaaagaaaagtactgtacaataagatattttgagagagagagaaaaagagagatcacattcacataatttttattatagtataccattataactcttctattttgttattagttattgttaatctcttactgtacctaatttatatattacattttatcataggtatgtatgtatagggaaaaaaatcatagcgtgtatagggttcagtactgtttgagatgtcaggcatccattgggggtcttggggcatatcccccttggatgaggggagactactggatgtgaaaagactacataatgttgtgttgtgcttctaccgtgcatcttttcccaattcaccataacttgatactggccatgatgagggtagtttcatactgaaattgacaaacactataatcacatcgtttctgttttgctaattgtctaggccttaggaggtgatagagaaaatgttaataaaatgcctggtgcttgtagtagttacatcgtgaataaaacaaaaaactgaggaaatattcctctagtattaaaaaaaaaaagtactggacaattcataaagaagatgttccctgaacaagtaaagttttgggatacacctttgctgcttcactttcaaattatacaataatataaaaagaaaatatcaatatgttctttcatcaattgtaaccatgactaggctatggatacaagagttcaaaaaaaaccaacagaaatctgtctaaatcaattagctatatagatttaatgataaagagtattttattactacttgtaattgtgtgcaacacatcttttgtatcagtacaatttataatagacatatgcgcatgcacattttctggagagctggttgttaaacacttacaagcacaccattatatcattctgattaggtgttcctttgtttaaaatctctcaatagctcccttcattggcctccttttacggactacttcaaatcctctcaaacttgcttcttattcctgcattgccatcgcaaccagttccatgaagaatttaaccagcttcacacaagtgcaaactgacaggcccactcacccctagactcctctgttgctgtttcatgtgtcgcccatgggaacctggcagtcatacatgtgcaatccagaagtggggccgcctttattcaatgggagacaagaaacatggataaaagcttctccctttttttctctacataaactgtgctgagtgcatttcataaaacttctcagataatctcttggaataaagcaaccagctgcctatagcaatgatgctccaatattggttccttgtattaccattgcctccttccctagatgactgtctctggtctttcacccctgctccctggatgccattcccaattaaaccacctggcacaaatctctgcacaagacaccacctatcatcatagggtgggtccaggctccttatcttaggagaaatggccctctgaaacaaggcctccacctgccattcctgcttaatttcctagcacatcacacccagtcacaaagaacacacatactcttacccatttcttgtgttttactcatgctattccctctgcttagaattcttcccaaaagggtgttcagagagttctaaaactttgtaatttagtacaacctcaatattacaaaggagaaaattgaggcccagaatggaaaggtctggcccaaggttttcaatagttaatttagatagagctaaacactgtgctactttttatgggcttctgcttctagtccctaaagtgtccatgaatatctctattctagttttgagagtctactgaattaaatgtgtttcctctttctacttcctaggatatatggacttccatttccctttaaactattgctctttattgtctgagacattggtctctcccaaaagaacagatagtaatttactcttacccaatgattcaatccagttccccaaacatttgctgtccactttttgtaagtatttacgatgagtgcagtgaagaagacgaaaatgagtaagatatgtcccttacccaaaaggagtttatgatccagtgggaaagacagagttgtgtataaatatctccatatatggtgtgattattatgatgtaagaaatagccaaagagatgtttaaattacctgctgtacttgtttaaaatatatacatagagcacatatcaaaaaaaggttgatattcatagtttataaaatgggaggaagagtaagtcaacatactaagaaaaccatagcaaaatgaagagctgagaaagaagactatttgcagatgtaactatttcagagctaatgattgtcatggatcaactaatcaacaaatatacgaatgcctgttatacataagccattaactttttgtactactgtgttctatcatatttcagacaaccaaaaaccctcaaacccttaattacaattacaaagaaacctttaagagtatctagtccactcctctcctgaagaaaccaaggcccaggaggttctttttcttatccattatttcttctgagagatccagccattaccaacactcttcaccaacaattcagactttgaatcctcactctcccttgactcttccctctctctcattttcaggaaccaatcaactaccaaatctgtggcttctgctacagatgcatcacatgactgtatccctcccatcttcatgctcttcttcagcctatccttgcttctggatggggctgcctcaataattcctgattctcccaaaatcactctttctcttcctgcaccatccgtcgcaatgccagagctgcccttcttaagcatagctctgatcatgcttttcctttgctgccaaactccaaaaaccaagaacatgttagtttaactttccagctctctcattcttaattccacctgttcatggttgttcctcccctcacatcacccttactctccacctgtgctaggctatactcccactcccatatacattctgcactctccctcccaacagtagagtgtcatctccaaaatgccctacctgccaaggcttcgaaatcctgcttaacctttctgcttccatatggcttctccgatctgtagttgttcactcatctattgccccacctctccacaccctgtttcccattgcatgttacttgtacttatttcacagcatttaatctttgaattgtgtttactgatgtgtcagctaaaccattagatcagtgactctcaaattgtagtccccaaaccagcagcatcagcattatctcggagcttgttagaattgcaaattctctgcccagcccagacctactgaatcagaaactctagggtgaggcccagccctctgtgttctcctgagccctccagggattctggtgcacagtagagtgtgagaaccactgcactagaccatgaatccccagagggcagttgctcccaggataatttcagaggcaaacttagaaggttgtctttaaaaaaaaaatactatagcatattatggacatttttcttctgaatacatatttttaagtaagcagcttttgaccaaaatatatgcaaatatcctaataatatgaaaaaagctggcatgtattaatgtgaatgaagttttcaaatttctcacttgtttattttgggcctcttatttaaaactgactgaagttggctaaattctttgagggttaatttttttttccctcaatctttagaattttttagagacttattactccctaagtgccatttttccttgtaagtttcacgatggctgtcctgtgaggataattttcaaactcattttccatttttctatgactcatctgtgaaacaatagataacagttaagtgtcactgacccttaaaatgtgaaacctaaagaaacattaaagggaaggaaaaaattctcaggccactgaatccaggtaacaccgctacttaagtaagattgtcctattatataaccagcaatggcaggaaagtgagtcggacaggatcaaagtagactgattaaaatgctgtgggatacagaactaaatgataagggagtgctcagtgaattacaatcacttacacattctctactaaaggaattctaaaccatttttgcatcacagagcaaagggtctagagacctttctaggctggggctatgatacctcccttgcttcacatcaactctcctactcatcgaacatatgaccaattttaaattatggtcaaattttacagactccttgagtccttggccctaggaaatcaggcgtaaggaaactgttgctgtacagaagtcatcatattaagtgctatgacttagagaatatcaagtaaattgagaaataaattctaggtgaaatcaggtgacagtgtcaataatggtcactagcatgagaaagagagaaagactgagaattgaatttttgttttgaatttttggatcttgctttggttgtgttaaaataattctaatcaattatgtgaagtgcttattatgtatgcttaacttgtgcttaattacaacaatgtcttctcaacatgttccaaattaatattgttatcctttatttgattgcaacagaaaactcttcaggtctgtctagccaggtcccaaggcccagctctggacatattacctgaccgtcctgagagctaagccacacacaggcccaaaagaacttggccattagagagtcagccatgctgggatgggcctcacactcttttttaggaggactgtgtcctcagtcaggcatcggagcacaaaggtttcatgggtagcctaccgcacactaagccactaaccaacacctgatttgggggcatcattctggtcccttcgaccagattatctggtctctgagcataattgtctgcccacaactttcatttaaaaagagggactcaggccaggcgcggtggctcatgcctgtaatcccagcacttcgggaggccgaggcaggtggatcacaaggtcaggagttcaagaccagcctgaccaacacggtgaaaccctgtctctactaaaaatacaaaaattagccgggggtggtggtgcgagcctgtaatcgcagctactcaggaggctaaggcaggagaattgcttgaacccaggcggtggaggttgcagtgagccaagatcacaccactgcactccagcctgggcaacagaacgagactccgtctaaaaaaaaaaaaaaaaaaaaaaaaagaggaaaaaaaaaaaagaaggacttgcctgcaactaaaactactttctaaagtgtttctgtgtttgtgaactagcacagaagtgaaacaaggccacctaagtgtactacttttctattttagaccaaaattaatgacatacaaaagaaaatctataacattaaaggaagtaaagggaatgaaatccttttaggacatttccccctctctaggaggtacagcataactcccaaaagtatgggttgtgcacagtgacttctttccaaagagtacagtgtggagagggaggaaaaaagtaactttacaatggaaaacattacacacacaacttcagtgaggtgatcaaagtggacatcaccagtgataagtcatgctgatagtatgtacccttgatacgatgtaataaatatggtattttacctctgtcctctccctccccaaacccatcatcccaatctaatcctgagaaaaacatcataaaaatcccaactgagggacattctacagaatacctaaccagtacccctcaaaactatcaaggtcatcaaaaacaaggaaagtctgagcaaccatgataaccaagggagcccaaggagacacaactatgaaatgcagcatggtatcctgggcaagatactggaatagaaaaaggacatgggagaacatctaaataaatacaggttttacttaataatgcatctatatttgttcattaattataacaaatgtatcatatacctatgtgagatgttaataatagaggaaactgtgtactcctttgaaactcgctataatagcatcacaacttttctgcaaatctaaaacaaacataatttttacttctttattttttatttttattttttagatggagtctcgctttgttgcccaggctggagtgaagtggcgtgatctcggctcactgcaacctccgtctccctggttcaagcaattgtcctgcctcagcctcccaagtagctgtgattacaggtgtgcaccaccacacctggctaattgttgtatttttagtagagatgcggtttcaccatgttggccaggctggtctcaaactcctaatctcaagtgatccacccaccttggcctcccaaagtgctgagattacagtcatgaaccaccgtgcctggcccaaacataatttttaaaaggcaaatatacaatagtatgttttctaaatgagatgctctgattaaatgtggtatttagagatgctccagaagtctgctgtctacatccctggacccaatctctactccaatgccagccacctgtcttagtccactcaggctactgtaacaaaataccatagactaggtggcttataaacaacagaaacttacttctcacagttctgggggctaggaagtccaagatcaaggtgcttgcagatttggtgtctggtgaaggcctgcttccccagaggctgccttttcactaacccgtcacttagtgaagagagtcagaggtccctctctggcctcttttataaaggcactaatctcattgataagggcagagccaccatggcctaatcatctcctaaaggcctcacctcctaataccatcaccccttggggtgaggatttcaacatatgaatttgaggaagacaaatattcataccactgtactgccctgaaacaaagcagtttgaaaatcactatcaaggaaaattggaacatacaatcattataaaagccagcccatttcaggaggcctggcaggattctgctgcacaattcagtcctgcctttggatgactgcattagactataagctgtggggctggaaccacattttagactcactagcctaggcctagtactgtgttagcaccaaaaagactctgtgcttgataaattcttcaacaccatcctgaagaggggctattgcaaatacaggatgaaagctttcactgccaactttattggccttccaggcaatggatctgcaaaaattacttcactgtcagtcaaacctaccccgtgtatctggtgagatcagacaggacgaacatatccaacatgcgtttctggcatgcctttctttttgtttcttgtttttgttttgagacggagtctcgctctgtcacccaggctggagtgctatggcacgatctcagctcactgtaacctccacctcctaggttcaagcaattctcctgcctcagcctcccaagtagctaggattacaggcactcaccaccacacgcagctaatttttgtatttttagtagagatgaggtttcaccgtgttggtcaggctggtcttgaactcctgtcctcaagtgatctacctgcctcagccttccaaagtgccgggataacaggcatgagccactgtgcccagcctatggcctgcctttcttacaaagtgatacacatttccctagtccccatgacactaccaaaaaccaccccggtagaactcaaaaaaggtaggaaacaggagtttccccaaatcagtctcatttatgttacgatactttcatgtttaatcgatccattctatcacagattatacacccacatgacagatgcaactgaaacaagtttttgcaagctctctgaaaacgacaggaggcattcacatagaaagctacagattttatttctcatcagttgagagcagcactttgttccaaattgcagtaatatctcagcaatgaatcattgtcataaaaacagcaacatctgtgaggtcagaaaagaacaattaggaaaacaaatgaatcccttgggaaccagggttcacactaacatcatatatttatataacaacttggaaaggtagtcattcaacaagtagttagtgagcacctactacatgtcaggaaagtccctactctcataaagcttaagttcttgtgtagaaaacccagtaagcaagaaaaagagaaaagaaaaagaatttcagatagtggtgaatcctagcatgaaaataaccctaggtgaaaggctggaacaggatcaggtagcaagcaatgcaatgtggactgtgaagtgaggcagctttcaatggtcagggaaaaaacctttccaaggagataacatttgaccattttgtcattgatccaaatgacaaaaaagaaggaagccatgcaaagacttaggagaagtgtgctccaggcagagggaatagcatgattaaaaggccctaagatggaacaaagcttgatgtgttctaaaaacaaccttcctaacaaactctggagataggcaactgtagttcagaaaggtgagaaacaagttgatcaaggttacacagacgctaaagtagaaatgaaacttagcacacctgactcctctgatagtctccctgcaacacgctagctgccttcctagttagaaacccaggctccaatgaatgagcatgagaaatcaggccaatggggcaaagagtggcccctgattaccaagtttcacaggatcagaatttgagttcaaacataaaaatcgaggctaccatacaatgtggccagggtccagcagcccagatgacctgattctaagcaaggtacacaggtgccagggctggagagcaagagcccacaagaggggcccagaaggcacatggggtgatcatcaaactcccaagggaacttacaaaatactattttgagtcccattcctcaagaatctaaatttattacatatgtgatagaacctggaaatttgtattttaagaagttcccaggtgattttgtttagccagactttggaactactgtgatggagaaggagggaaggccagctcttcaggaggttgcagggagaattctatctctacaaaaggaagaatcaagggttaaattgaatgcagttgagacttgtaccagaccagatcataggcacagagagataagaacattgcataactaagcgtattcctttctccccaaccacatccccaaattcagaatcactgtgacggttgacagaaaagtgcaggagaaatctctttggtcataatgagaaagaaagatggggtggagaagctcggatataccccctgggcaaagccagtggtgtgctgagaaatgcttagcaaccaggtccgggtggaggagaaaccctaactgtagtgtttgccaatttcgatggtgtaaatattcctggaaggccaaggcaggaggatcactaggtcaggagttcaagaccagcctgaccaacatggtgaaagcctgtatctactaaaaatacaaaataagcctggcatggtggtatgcacctgtaatcccagctacttgggaggctgaggcaggagaatcgcttggacctgggaggcggaagttgcagttagctgagatagcaccattgcactcctgcctggacaacaagagtgaaattctgtctcaaaaaaagaaattcctatcatggccgcttccaagttaccaacatgatatcactagaacatacagtttggggaagacgtgcaatagttacagtattttcaccatatagaaataataaacataaatagcatagagagcaataaatttagtaaaataattagtaagtcagaggtgtgggtatttattatcttttaaaaatagttttaacatcacagtgatgttagtgccaaaaatatacttcatccccaaattctgtactcctaccttacctcttacctctttttattccaaagcaggaataatggtgacatttaaaaaacaatatctaaaacatcatcttcatttttttttcctattcttagcccctttggttaaatttctcacttttgggtctgtatcttcagaggaccactgccctacacatctggaaatgtttttctgctccaagtcataaatctccaatcccaacccatggctacctactcaaactctttatttcaaaggactccttcatcagaaattgggcagaaaaagatcaatgaagtgagtacagctgtttacccaaaatgccacagactgtccattctacatctacacattttatttttaagaatagttaaatggcaccatagagcaaataaataagtaaaacgttaattataaagacttattttctggaaatacctatgtattttgaataaaatggattacaccttctcccttcatccatgtaccctttcattcagttcacatctattgtacactacaatggacactggagacacaaaaatgacaaaaacacagtctgtgacctcaaggaccttgccctctcacacggaagacagacaatagaaaaaataatggcaaatccagtgattctaatatcacactacatataaaatccacccatggaaagtggcataaaccaaactagactagactgttatgaagatcccaatcaggggctaagagttcccttgtatcttattgtccacatgctttgttgattagcaacagtttaaacattaagatcccatcaagataaaccaaaggaaagatcatctccaactgcttatgagattttgaaggcatcatccagtggtaacacactgagatgcaaggctttttgtaaagaattgacaaaggtattagctccctgcttcctatctgtggccctctgccaatgcctcgtctctgcatttgtttctcccctccctttctacggctttccttttccccatgtttattcctattctccttcatctaaatgtgccatctgtaaaagcctactttgaaaaagatcactgttaaattctgaacccttattttcctgttcttaatataaagttcataagtttatggcctcagaagtctctctctctctttcttaacaaaagaactgactaaactaagttatttttatttccatgttgcttttggctggttttcttttgtgcgtcagaggcttccaaaaggttcccaactctagatccaaaaagttcaaaaaatgattgagtacagaataaaatattgccctcatccagaggggagctgagggtcacgggcattaggagcaacgggggaagcaatccaggattctggagccctaggaagcaagacctgccatgacccagtcggccataatgtgggcccttatttagcagattagctctagtatggtcataacaattattaaaatattgaaatgcttccctctggaaatattgcacataacacccaaccccttccaaatacacctggcctcccagactctcccaggatccctggcccaatctcctcacaatcaggagttaaggcctggcccagcagaggatctccaggaccctgccccagtgcttctaccctttgacatacccatgctccaccttaatttcgttttccgaaaaataaaggacttgaacagattgtctgagttgcactataattgcaattatgtcaaagaacaaggacgaaatggaaataaaaaaacctaaaaaaaagtttgttaagaggatggaatcacaggttatgtttttttctagacagacagcagtgtcaaaactctgggtgcaagctgcctgggatggatccccagctctaccatgtgctagttgtgggatctcactatgcctcaaactgcctcatctataaaatgggcataggccaggctcagtggctcatgcctgtgaatcccagcacgtttggaagccaaggtaggaggaccacttgaacccagaagtctgaaactagcctgggtgacatagcaagacctcatctctacaaaataaaatacagtaaaacaaacataaataaataaattaaacggccataataagattacctactttacagggttgttctgagggttaaatgtattcatgtttgtaaaatgcttagatgagtgcaaggcacaaagtaaacaccacgtaagtgtttattaaataaataattcattttattctgtcgttgtaatgtttgctcaataaatttaaaaattaagaaagtttcacaacagaaaaaaaacactgtgacactatgaaacacttacgtaacatacacttttgcttaataacccagcactaaaacagctggggtccagattttacactgcactgtgaatttagggaaactaacacactggaatgtgttcccactgaagcataagatgcgatttgtatgattctctttgtaatcagaaatgtcacaggcttatgggaaagttaggtttacatgtttctcattttaaccctgcaacaacttttagccacaccctagcaaatacattttattttgtggtgctaagacttaaaggattgtaaacacaaaaccagaccttgcagagctacagcttttcttgtgaacacaatgactcagcctaactacaagtttaaagagacatatcttatgtgttgggtcccctagtatcaatctttagtaaacatctgggatggacaggaaattgctacacactgcttttagttactaaaaaggcaacactacctgagctcaagcatagtttagataggtactatttgcactgctatagaggacaacactgacaattgttatttttctgatagatactcaggagaggaaatgatcaataacaataattcccttacgtgttccttcctcttgacagctaaaccccacaatacccttagacacaagtttaaatacatcacaagcttatcctcaaacagtaatgtattaggtctttcctgctgtagataagatttgttaaacagtctggctatggctttttaccttttctcttttaaaagtgcatttctcagctgggtatggtagctcatgcctgtaatccagcactttgggaagccgaagtaggaggattgcgggagcccagctgttcaagaccagccctagcaacacagtgagacgccatctttataaaaatacaaacaaaactggccaaggatggtgatgcgcacctctagttccagctactcagaaactgagatgggagtatcacttgagcctaggaggtcaaggctgttgtgccactacactccaacctgggcaacagagtgagaccctgtctcaaaaaaaaaagtttaaaaggtgcatttctctaaagctacgagaaggaactcaaaccttgcttagtgataaaactaaagcctgcaacacaaccattatcattaaaatgttattaaaaccctgtaagaaagatgaagagtcttgtggatggatggtggtgacggtagcacaacgatgtgaatgtatttaatgccactacatgtacacttaaaaatggctacaatggtaaattttatgttgtacatattttaccacaacaaaagtgaaattataagagaaaaaaaattttttaaaaaaacatcctgtaagagaacatttatacactgtcggttggaacgtaaattagttcagtcactgtggaaagcagttgcagatttctcaaagaactcaaaacggaactaccattcaacccagcagccccattactgggtatatatccaaaagaaaataagttgttctaccaaaaacacacacaaattcatatgttcaccacagcactagtcacaatagcaaagacatggagtcagcctagatgcccatcaactatggaccggataagagaaaatgtggtccatatgcatcatagaataccatgcagccataaaaagtaacacaatcgtgtcctttgtagaaacatggatgcggatggaggtcattatcctaagcaaattaatgcaggaacagaaaatcaaacattgcatgttttcactaataagtggaaggtaaacattgggtacttatggatatagagacggcaacaatagacactgggaactactagacgtgggagggaggaaggagagcaaaagttaaaaaattatcaggtactatgctcaccacctgggtgacgggaccagttgtacccccaacctcagctgcatgctgtatgtccatgtaacaaacctgcacatgtaccccctgtatctaaaataaaatttcaaattattaaaaaaaaaaaatagggtcgggtgcagtggctcacgcctgtaatcccagcactttgggaggccgaggcgggcggatcacgaggtcaggaaatcgagaccatcctggctaacacggtgaaaccccgtctctactaaaaatacaaaaaatcaaccgggcgtggcagcaggcgcctgttttcccagctactcaggaggctgaggcaggagaatggcgtgaacccgggaggtggagcttgcagtgagccgagatcgcgccactgcactccagcctgggcgacagagcgagactccgtctcaaaaaataataataataataataatgacagtcctacttttcctttgtaacaaaaataaaagttacctataagagttaaaggtaaataaaatttgtaattttaattaagaaacactaagtaaacatacaacttccaagaagccgggttccccactacctggttataagtaagtctacaaacctaaatgagcattgtacagcgcttactatagttcataattattctgtcatcagggacaaacattgtaaagacactttttcctcaaagccttagcattcaatttttttttttttttttttttttttttgagacagattcttgccctgtcgcccaggctggcgtgcaatggctccatctcggctcactgcaacctccgcctcccgggttcaagcgattctcctgcctcagcctcccgagtggctgggattacaggcgtgtgccaccacgcctggctaatttttgtatttttagtagaggcggggtttcaccatgttggccaggctggtctcaaactcctgacctcaggtgatctgcccgcctcagcctcccaaagtgctgggattacaggcgtgagtcaccgcgcccaggcagcactccaactttttatatggattgttaactgtactggttcttgagaagccagactgagcgcttatacaattagtccaaagatccccaaacaacatttaaaggctgtctacaaattcaagctaaaagactgtgtacaaattcatttgtgtgtcacaaaacatttaatactgaaagagattcttattcaaataggcagtgtgtaaatgtggggtctgttaacagttcaaattgcagattcctttccttctttaagttttcattgcaccaccacgaactaaaccatttaacatacctcagaggtctctgggtacctagtctctcagaggcctttggaggcccacgaaggcttatcttaactaaaattggcagggctggctgataaagttaacggaactccccattttggaggcagacttagtaatggtcaaacgaagaaactgttgtggtctgttcttaaaaagctactagtatttagtgcttcacagaggaagtaaagaaagcaataatccgagatgaggaggagcaaatacaggcgtggcggtagttcaggactgagtctacaagggcggttctcaagggcgtcacaaaatcctatggaaggcttggaggacggcactcctggatctgagccctacgtcccaaacaccttcaatcgtattgtgaggaagaagaccttttacacactccctgctgctggcccccggccccctcgccccacctccgagtggtcacatcacacggcgggagccgcggtcagcagctgtgatcacacccccaggaccgtgctctgcgggctgggctcgaagccttgggacgcggcacttcctggttggtacgggatgccggtcccatcgcccccaccagcccagtcatgccaccgcgcacccgaaccaagggcgcccggatgacctggggacaccacacacactgcacccgaagccctgtggcggcgaggcggtgcatcctgcagaggacgcctgggcttcagcctgagcctgcgcggctctgcgctccaggcagccgcccgcgcggcaaaagtgcgtgccagagttgtcagctttcaccctgcaggaattccacccgaaggcgtgcgagggaggcccttggggatcgctagggagtccgccgccgactcactcgctgaaatcccgtccaagttgggcggggagcggccagctgcccaggttgggcggaggagggacggagggcgagggcagtggaaacccggctcccacgggcgcccggtgatccgggtctcggcgcggctcctacctgcagggcgaaggggccgctagcacctgcgcgttggcggcggactctcagggctcgggtgcctctggcacagctggagctcagcgggagggaggg

SEQ ID NO: 746 - DNA, 210091 bp, Homo sapiens; identical to SEQ ID NO: 745

SEQ ID NO: 747 - DNA, 486385 bp, Homo sapiens
atgattgaaatttgttggatttatttctttctaaagtttgtacatttacatgtatcatatacatattttaaatccttcactattttgcgtgatttctattacataaaaaccatttaaatgcaataaattttgttgccgtaaaacaacaaaatatccccaacttataaaaacacaggaacaattatattcataaacatttacacaataaatgtactctatatatcacagcttctatacatatcagatgactcacttgtctacaaggtttagatttacttgaacaacagtgaaatagggtaatatttatatacaactattttaataaaaaataaagcaattgtaaaatgtaaacttaattgtcaaaatattctttaaacactttaacaatatccacacaaattactgttcctttcaaaagaagaccaccacaaacgccatcgttttctagaagacggcatttccagaatctggtaggtggtgatgaggaacaggtttccagtacgtgttatagtaccgccagcttacccaaaactgctaatgccgacagtttcgccattgaaaaggagcaggctgctattttgtcactaattactttcacaatttgcaggggacatatggcaccaggactgcaatagaactgaaatgattggtggagaaaactttgaaggtaaagaaatgttccacaatgccaattagtttgagccacagtgaatataactcagttattataataggctggaaaagttaaaagcttcttttatattaaaagatacaaattatcgcctttctgcctgtcctatggtaatcaaggctgacaatataaattctccgctagtgtacatttagaaatgggttcctaaagcttgagatataagagactgcagggaggtggttaggcctttacctaacagctctgatctggactgaacaaagctgctaagctagcacttgagtattcctcgacccttcccctagaaaggaaacgttagccatttccaggaatctgggtgtggaggcaaagatatcgtccgtccgtagttagaactcagggtgccagtttgttttttgcaaaggtaaaatacgtggtgttaacttcactcagagaatctttgtcatgacgtttgttcatgtgccacgctcagtgactcagtcactctcggagttgataccttgcctcagcagggtcacgctatcaggacacctggatccctaaagcaggggaagtggcatttgaaacccaggctgtccttgctgctcagtagaagcctgagtgaagtggcggccgggggagaggttcctctttgcagagatgatgtgttatcaccactctctgcagggctctggtgttcaggactcagagcagtgagcctcagacctgcagtgtggtccttaatcgagccttgggctgggactcttctaggagcgcctgaagacttatttatggcgaccgatgggaaaatattaagtgaaactccaaaattctctccattaaccaacattttcaggaattgaagttagggtgcttatttctataacactattcctaagagcttagctctctgccctgcaaagggaaatgcattttagttcggttcctttccatttccatcctcgctgttgttgctgatggaaaagtgctcaactgctcagcatgttcagtcggagctctcttaccagtaaagctcagaggggagtgtggacaaggcacatcagtgctcctacaggaagtgcctccttgtttcttcacttgtactcctctctcaaaggaatgatctgcagagcaagcagctctgccaccttggaaaatgatgcacaccagcttctgggacttcacccaggctacggagagatgctggagagctgctgcttgtgaattacaagaaagccttcaatttggtggtccacaagaaagaatgtgatatggatcccctcatttatgtgttaaaaatataatgcatctcaaagtcagacactagagctcagattccaccctggcccttggaaaacatctgtgatgcagtttccaccccctctgttcatcacctctttagaatattctggctctttgcatcttaaggtcttatgtttgtataacttaaaacattcactgtgtgtgcatgtgtgcaagcatgtgtacacatgtcagaggtcccagacatgtcaacttttctccttatacacctaaggggacagtcaactggttctgaatctcaggaggagaggactaaccacatgcatggttaccctaaatggaaagcaaccactttactgtcccctaagcttcaatttggtctaattactcttgttcctacagttttacaaaagtatcttaacagcattaaaaatcaatgtgcatatatatactctctctagagtagatattattatccatatcaaatggttacttggctttataaactccatggctttatgtttaaagtccaaacatttcaaatggttaaggcccaaaaatgaaacgttttgcttctcctactccttttctacatgatttttgaatcaaatggctgtttctgcagatcacaataattcttagaaggaaatactctcgcaaaactaagaccctgccaatcattcacagagccagtccactgcacgtcaagaaccaattaggaaaaatgatatatttgcaaaaatagtttgagactatagagttaattaacaacaacaaaaaaatgcctcaagtgtaactaccaacacattactgcagcctggagctgaagttagtctcccaccccacaattcaaactctctgaatcagctacaaagacacgaggcagtgtgtttaaacaaaagacactgcactcagccactcactcaaacacactcagtcactgctttaaatataccaaacatgctggttaataaaattttagtctctagttacctatttacactctataatataagcagtaagctcaaacaactaaggccagtggctcttctttggggagaggcaggaaaaagagacctaagtataaaaatatttaaaataaagtttaaacctggtcctgaaattcttttacctgtgacactagatgctaatttctgcaactgcaaacctaggatacagtacccaatcctgggatgccctgatatactttagtgcttgtgatatttcttccaagtcaagcgagtacggatgcggcaccacgagagtggtttgatctcccgtaaaacatacacaaatacataaatgatatggtgggtacttaattcttccgaaagctatattttttatggactaattacaacaacaataaagaacgtgtgctttaaagcatcacattttgtaataagcccaaaattgtcagtttgactttaagtgctcttaatactaaagttactaagactgcacaggctgcctttttttttttttttcttttctttctgtatttcccaaattacagggagctatgcccttggtattgcacacagtacactgcaaaagattcacaaggttagttgaaagtcatttttgccctggtgattcaaagctcaaagaattttctagcataaagtcttattaaaaattttaatcaaaatattatttgagtttaagtttaataaaacaataccactatatatactctcaacaacttcattatataatcagtcctatgaggttgtacttgcttttcatatcacactgattaaggacaaaaataattttgatgtacatgtaccatacactgatatgcaatctacacactgatgcatttacatacatacaactataaatacccacaaatacaacaatggcaggtgacagcattttctttgatgactgacatactgcctgtaagaatagtctccaaaagcctgcaatactacagatacacacacaaattacaaaggatgaaccgaagagacttaagaaaacctactgtatatacaattatgtaacttgcaaaattttcctgctgttgcattcaagtcaaactgtcatgcagattcaagtatttaatgacattctctctatgaagacattctctctgcatgcaatgggccaattattgtcataagcagaaggctgcccacgtgggttctggatactgtaggtacaaaaggagaatgcctttggatttcagtccttcctttatggatgagagatggaaaaggaatctgagagaaaaatcagtgacaaagcccctctctattgctatcaataatctatcacggggttattctgtgatgatttgatcatgtaagatgctataagactggtggaaagaaatttgctgacatgtggcagagcagtggcatggcctgggagacaagatggccagaaagctgtggagcaaggtaggaggcccagaggcgcatctgcctgcaaagctgacttaccattttctgtcagaataacttagatgctttgagacaaaagcagatactatttaaactccaacttggacaattcctcataaactagacttcaggtttaacaactcttaggatgccactttggttctttgttttacagtgctaattttacaattggaaaaaattctgtcatttgaaaagtcaagggatgactcactgctgaaatgaagagaggtggctcccaacctgctgaaaactcgaccaagtccacgggagttaaattacagagattcaaacctgcaaagctaaacttctgtgaattcaggatgcaacatgcttaactgatgactgcaaggaaaaatgccaaaggaactcaatttcaaggacaattaatgaaacccaaaaggttttgttagtaagacaatggagaaacttctttaacgtcaattttcttccaattgtcaatgattagttaaaaagaaaagagtgcagctcatgacaagcaggccctgcctctcatccttcccagatctttacatgatagagggagcaataggcaaaggacagtagaaaagctcagtgtaactttgtgtttaggcagtaagaggcctctttccctgctggttgcaaaaattcttccacaatctcagaagttctgtagcttggccacagggtgaaatacaaacctatcttagccttggaaagccacccagattttcctcttccagagtaaattcctcatgtcacttttgcccaggggccagtcctcattttctagattaggataacagttggagacgcatagagggtcttgtgtttgccacaagaccactgcaccaaaaaatgctttctatcctctgcatctaagaggaataaaaaggttacacataatccagggactacatttccatcagaggactctctcccatcatggttttgctgagattaattaaaattcacaaaagtattgctcagtttaattagacactgctgagagttagcaaaatgatgtttcaaaaaagtgcacttcagaaatgcctacgggctggcgataaagtaaggactctgcatcccagtaattaagttttgattgctaatgaggaatcccagacacctccctgtaaaagccagcatgcgaggtggggacaaacccctaaaattcagattttatacatgggccacctgtatggtcaattttgcaacaacactatgaccaaggcattctgatagctgtcaagattttctgtactagaaattaatatgaagtgtattgacgtgaagaagaatgatttatcatatggaaggaagtcccaaggctcctgggcgctgaggtgggcgacggaggtgggtggcgtaccttcagaggaaagggaaggggtgctcccttgtaccgtgaattgggcaacaggcttggagcagctgtgaaaggaaacatcctcaatttcttctggctagatgccacaggaaataaattatcccaaaggaaaatgtggttggctatgggccagactctcagaatctaggcaaatcagtgactgtttcctcccatagcataaactcttggcctccttcatgcactcatgacagacagcaaccttcagaagcctcagggaagaggtgttctcagcccatgcgctaaagatggacagcatcatgctacggcagtctgagatcctggctcacaaaagaacctttaaagttgtttttaaagataaactatgcaaacatggtatactgaagcttcaaaagagcccttcgtatccaatgatctattagcctatccagaagtccctggagttaatattagtgactcatatgacacggacagtgctatagtggtgctgatgctagccgagtatttcaacactactctaaatgtcagaaatactgtagcaaggtaccattcaatgtatattaaataagtaaaatacatacagacattctatatacatagatatagactgtgggcaaacacattcaagccactcagggaagttcctttttctttagttactgaagcttgtagatgacatggtctaggtacctctctcccctcggcttagtataaacatttaggcagaaaacaaatatcctgataatttagattatcaggtagaaagacagataacttgcttgtggatatgttggattcagtgagaggctacaaaaatcaatctgatacatgggccatattggtaactatcctgtttgttttgcagttctgaaacataaacttagttactgcctttacccaaacaaggcagagagttaaaagtgaggtttttttttttacaggtgtggcaaaatacttattacaaagaaagcaactgcaaccctagagaggggtaagccttctctgggcaatagtcatggacatttacagaggggaaggaagtaaacgttaataaataattctgtaaataaatgctagtacatcataataacataccacttagacactaccatggctttacagcaggttttctctaattcactggaaccatgctattcctgtagagcagctgattctttggtcatagtaccttcaacaaataaactatagaactagagaaactttctaagggaggaaaaagaaaaatcaaagtgatactattagttctgaagttgtgccacttgcggagattttaactttagggattacagagtttcaaggttaggaaatcacaaagctctaggtctcagtgggctaaactttcactcctttctcttcctctacagaagaatattctgtttatcaccctgaacttcaaagggactgtaactggaacaagctcatgactgcaaagttaatagaaccattttgagtagacagaaagaaaggactgaaaatagatgaagtatttttaggagaaagttgagtagtagcagagtgaagtggctatcaaggagactgagacaagaataaacaaagtcactttgcacctgcaaccagaagattcctcagttttccaaccataattcattctgactactactttcagatatattttaaagaaccaatatccatcgtggacaactgcagctacgttttccttccttattttgtcttaaggacacaagaaaagctgtttcattttagtattaatttgttaggaaggaagacctcaatatcacaaccaggacacaaccccatgcccacacacgcacacacacgcacgcacacacacatatgtagagtaagaaaaatctattcctggatggaaggatatcaacgatagagatgatggatttctagtctagaccctgtgggagtgaggtaacaattcctgcagactgagcacatgcctactgctgcagctcctcaagggccgattattgcccccatcctttagcaaacaaaattaactgggtatcaatctttcctcagccttcaaaggcaaaatgactccacttcctctttcccttgcttggctgaaatggaatcagcacttcaagcaagctaatgtgcttccctaagttctcaatcctacgatcttcacgcttcttttccctgcttccagcagggtccgatctcaacaacaagtgctaagctgcacatgaagctgcctcatattggagcaactagattcccagcactgtgattcttactggagcatctgtgagtgctcaattctacctctgtgactgggcaagatttcacatataaaggcgtatattaactccagctagaatttactaaaactacagtttgtccagttaagtgtttcacaatggattaaattctttaaccttaaaaaaaagtttaacagttgatatgagaatacataaaacaactgagcagactgcaaacaagagaaaaccaaaagagaagggatacataattcattctgaaatcacgatcccctcctcctcacagaaaaggtgcattagctatcaagttgcaaaaatcatcaaagcaaaagaaatcaagagcaaagacaatctgtacagaaactaacaaaaatatacaatagaaaaaattactaatgcaccgttttgtcacagactttttttttttaaatatattcacggattaccagaaagatcttgaaaaaccctattttgctccatgaccagcacttcctggccgcagatggactctaagtaactttttgcttaatgcttggtgtttcaggtcggtgatccttcctctctgacacgttacgcttgactttggcagtgattggagaagtatccgggttcagcgaaggactcgagtgcgacttcttcagtcctgcagcctcgctttcatcgttactcagtagctctttgcctccttccttgagaatgctgacatacatttcatagcgggttttctgaaggcaaagccagagaacaacggtagtcagaaaactgttcaaaatgcacgtgtgcagcacacttgtgtattacccacctggagagtgtgaatggctgttgaagacttcgcttcatttcccaaactgacaaattacttgggcacttactgggcacatgagaggcaactacagagactgtcttatgtagataagaaattaagttagaattttagttctcatttgttctagattctgacagaatgtcaacttggagttgctggctaccagatggaacaccatgaatctagaacactcaggcatgagaagggtctaagttggaggagctgtcacctctggttttcggcggctgcatggctcttgtggctctgtaccaaagtcacctgagcctccccaggtagtccaggcctcacaagaaactggcttggatatggttgtttactctttttctgactccctgtaaccctacaaaggcttgccttgagggaccattccgtggctaatctcctggacagtcagtcccctatgagaccataccaccttctagaagctgctctgggtttccctccgttgcttttctgcaaggattacccacttctccggttattatgaacaggtgctgctatgaacagtatgaagctggcagaatttcaagttattttctgatgcttttccaaatcaacaatattcattaccaactatgtactgagtacctactatgtttcaaacagttccttgattcctccgtctcttggatatctaagattttttttttctttttccatggctctggcactttttttttcttccagtttctatcccaatcaatatatagaactatcatatatgttgcaaattagagaagggtctcagattcttaatttgacacattctggtaaagtaagtattccaccatcctgcctcaacgcatgaagaatttatagaaagcttaaagtgttttatttctaaaccaaagaacatgtcagatataaactgtcccaacaaaggcaggcaaattctgttttgactatacatccgtcttagggatttttctagtcagattggggttttgtacgtgtcagttttaagttagtaatttagaagtgctaccttttcaagctgcttcgtttaacaatgggaaaaagctgctagacattcagtatgttctggggttggccaggattcaagtggggtgtgagcgctggttgccgatgatgacatttattgagtaccaacagcttaacacaggtcattcacacaatattcatacacaactgataacttaccatccctgctttacagttaaggcaacaaaggcaaagacaagttcaaagtcaaagtaaggaagaaatgaaactcggatttgaaccaaggcaatctgagttcaaaacccacggctcttaagctatattacctccattgatatgaaaatatagattatatgtatatagattttaggatgactcctctgacagacactgttgtttggccagtcaaaggccattctcaactccttctactctcatgtgcctttcactacaaagactgataaaaccagagatacttactttcccagtctctcttgtagctaagttgggccatgtgatattgtgaccagtaagacgtaaggaagagtcttttggggggcttctgggaaagagattttgctttctgataaaagggacagactttaaggagaagtcactggtgttagcctctcattcttttttttttttgagacagagtctcattctgtcatccaggctggagtgcagtggcatgatctcagctcaccgcaacctccaccgcctgggttctagcaattctcctgcctcagcctcccaagtgtctaggattacaggcgcacaccaccacacccagctaatttttgtatttttagtagagatggggtttcgccatgttggccaggctggcctcgaactcctgacctcaggtgatccacccgcctcggcctcccaaagtgctgggattacaggcgtgagccactgcacgtggcctagcctcttactcttattccctccttaacatggacatgactcctaaagctgctgccccgtgacatgggcagtaggtatgaggaaataggacaacatgctgcacctgaggaaaaatggaaagacggagagagccatgttgacatgatgagctggatccaaccctaaggctacaacctctggaatcatgttaaatatgaataataaatatcctatgggttaaaccactgtttatcaagtattgttatttgcagtttaaagcattactaaacacacattccaatttcaataaagaagtaacaaaatacagaatagcatgctaagcattatctcagaaggccacatgatagtttcataaggtttgctagtaaaaaatgtcatcagtatcacccatcagtagatgcactatgaaatcagaggactgaacaagataatatccacaggacataaagattctaaacgcctcttcattttatgaatttattaattaatctactcctaaactgccttggtggcaagattaaaaaacagaaaagaactacccccaacagaaacaaagtttggtaaaatagtctaaaggtaagtttaaaaatagattcaggaaaccagcgtaaggcatacgatttcatgaagctggagcgttgacacaatgaaaagagaatgaagaaaaattgtttagatcacttgaaaggggacaaaaggagaaaagatgatagggacagttttccagtagtctttgaataaagtgatactactaggaaaatccacctgaaaaatacatgaaggaaagccatctcatccactcattttacagctccagctgcaaagctattgtcttaaataaattacatcagtgtgtcaatcaacaaacaaaaggcacagcacagaggtgtggcagtgcatgagtcatcagatcagaagtaaagacaaagcagaaaaaagggggtgagaggggccagaaaacaaagcctgccctgctgttaaggaagccttcgagggttgatgagtttgcaaacgccgtgccccatttctgacttaaaaaaggcttatagggacacaggttacaaaacccagaaatgtagctttgcattttaccagtctctgagtctagattttactgaaccaaaccaaatatacctcttcaaaacattttaggaaaacgtaactttaacttcaggactaaccagcaggtattagttttagccaagtatctctaggattacagactcaaccacatatgtaaatgctatccagaggatttgaggacaaaataaaattgtctcagaataaagaaaaataactctgaatgatgctctggagagcaagggcaagaaacataactgaaatttctctcttcattgatttcgcctcatattctctttctgggcagtaggaaggtcatatttcttaactatgcaacagcatcatttggagactttatttcctttcttcctttcagagaagatgtgatttgcatcttttttcctaagaccgattgtgaaatttaagttttaaatgaaagctggtgtgtaagaaaaagtaaaggagcagcaagaagtatattagtaaattactttttttttttttttttttgagacggagtcttgctctgtctccaggctggagggcagtggcgcgatctcggctcactgcaacctctgccgactgggttcaagcaattcccctgcctcagcctctggagtagctgggactgcaggcgtgcaccaccaagcccgactaattttttttgtgttagtagagacaggatttcaccatgttggccaggatggtcttgatctcctgacctcatgatccgcctgcctcggcctctcaaactgctgggattacaagcgtgaggcaccacactcggccagtaaattactttttaaaggtttgacacaccagctcagagactgaaaacaatgatcagtgttcaagtggtcatcatggacccaagaagctcatcaatcatattgcggcagacggtgtttcctgcttcctgaacagcctcttctttcgtactaatggaactgtgcgctttattaagaatgccagcgtgcccagccccatgagaggaattatggtttaaagcaggcgtgatgacccttgtctctgttagtttccactgctgccctgtggcctagatttggcccctgacatgtaagtagaagtctgctaggacagtttatgaaagcagcttcttttgctattctgatagaaggtggtaggcaataaggtattttaaaattaaggtacatacattgttttttaagacataatgcaattgtacacttaacggatgactgtatgctataaacaacttttatatgcactgggaaacaaaaaaatttgggtgacttgttttattgtgatatttgctttattgcaatactctggaactgaacctgcagtatctcaggtatgcctgtgtctgtaaccactttcaggttctaggaaatgattagcactctagtacttagggagaaagcttagggataattcttaagtggtgaagaaggaaatttgacaataaaagctttgctccttcactcttctttttctctaatgtctcacatcctttcagtcagcaggttttgtccatctatcttcagaactgcaccatttctcagtacctctcccatttctagtctggaccgagctcatcaccttgcgcctgggttcctcccacagtcgcctgactgctctccctgttccctccttgccctccacgtgcactcctttcaaaagacactgccctgttaaaacacaagacagagtgtgtcagctctgcccaaagtactccagtggtttctcatccttaattctcatccttaaaacccttctcaaccaggaatccttaaaatgccctagaaaacccatgggccacccctttcccgtggcccagtctctcagttctgtccctgggcttgaatctgcctccatggcacacactcctattcgaggacctgtggaacttgctattctctgtccaaaaagctcttcttccaaaagcccacaggacttcctccctcccctccctcacctctttcaggtgtgcactttaacatcactttgacactgaggccttccctggccatcaaaatctaaaactggaacacctactcttactgctttatgttttccttagcacttctccccatctgtcagccttatattttacttgaaaaaaaaaaaaaaaccttttgatttcctcctttgccccccaatactagataccatcacatgagggtaaggactttgcgtttgtttactaatatatccccagggccaagaacacacagtggacaaggaataagcgccactgagtgcatgaacagaaagaggaggaacacatttttccatacacggtagaaaatatattttgaactcgtaatatggcaaatccagaaaaagaaaaataacacggatacccacgttgatggcagatgcctgatgtgttcctaattcaggatcctctgggaacacacctttatcttcagtatcccaccgttccaatgatgtttttcacaaaaatgctaaggtctgaccctgtcagtattgaagctcataagccaccacatgacaaaggcttgtccacttccactgcatattctcttgacctctgttgtcaagatgccacacgtgtcagatcctcaacagtgcactgaggtatagcctgccttgcttaggactggggctttttctctctctttagagagaaacgtaggttatattacacttttgaggttcataaaacatagacccattttctgagaatctttttttttttttttgagatggagtttcgctgttgtcacccaggctggagtgcaatggggcgatctcggctcactgcaacctctgcctcccaggttcaagccattctcctgcctcagcctcccaagtagctgggattacaggtatgcgcgccaccacgcctggctgattttgtatttttactggagaacggggtttctccatgttggtcaggctggtctcaaactcctgacctcaggtgatcctcctgcctcggcctctcaaagtgctgggattacaggggcgagccacctcattcggccctgagaatctcttacgtagtagtacatgaaaaatagactttattgcccactgtgagcttcaaaataaagtgagaaactggaccactgtaggtggactccagtgagtcctcatttggataattactaggtctcattacaattcattacaacatgaagagaatgctctacatttgtcttctaaaagcatacattaaaaagataaggatttgtcaaggattatttatatctggaatctacttgcctgatcattctcacatgaaattgacatgtaaagtatcaggagctcatttacctttggatacataattccatactaacctaagattctaagttctctgggtcagaggatattagcctcatcaacatgaattcaggacggaatctgctgttggtactaaacaaataataacaatattcaagtattatatcttcgctttgataattttttatagccagatggtagaaaagggaatctgaaacagcaacaatatgttttaactaatataatttcaggccacaaagtaatcactacacaaaaattaacatagttccagatagggcacattaaaaatgagatgggatgtttaataatgagcccatggaaagcatggtggcggtaaaaagaagagtcttgcagtcaagtagcctgttgttgacaatgcctctaactaataagactggccttaattcattctctgaaattgttgtttagtcttcataatgtagccctttcaggtatgtgtctttcatttacaaggacaaagacagttccagaaaaatgcgtgcctcagggtcagttttgctacctttggttatgttattaaagattttatctttgtctctgcagattcattctcaggtcaattctaaataatttcagagccccacactcagcttccttccttaggaatgctccaacagggtaaatagagttccagcagtgtaagcataatataattccactatcagaaaaataacttgggatggaattttaccaaatacaactgcaatggcagatctctgctgacaagaatctacataccgttttcttggacctggcccattcagtgagctctctctcttaattaactaaaatttgctgttttgataaagccttttgtgaccaccaagagccaaaggcaactcaagtgtttaatggcgcctttgtctactcaagtaaaattctttcttcagtgtgtaacccctccttattacatttttttgctgtatttctttattaagctgatcttcgattatctgtaaaaatacttcccaaatatggccaggcgcggtgactcacacctgtaatcccagcactttgggaggccgaggcaggcggatcacgaggtcaagagatcgagaccatcttggctaacacggtgaaaccccgtctctactaacaaaaatacaaaaaaattagccaggcgtggtggcaggcgcctgtagtcccagctactcgggaggctgaggcaggagaatggcctgaacccaggaggcggagcttgtagtgagcttagatcacgccactgcactccagcctgggcgacagagcgagactctctctcaaaaacaaaaaaaaaaacaacaacaaaaacaaaacttcccaaatatgtagggaaaaaatcccttttcactagcatcaatgtctacgagggataaataaaaattatcgtgtctaagaccatgtaaactgctacttgggttgaatgttaattgtgttttgaaaaaaattacaactattgatattctttgaaaagtagtttaatcatatccacacatatatttacatggatctcactgaacagtttctctctagagccctgcataccattttatagaataatatctccttttgacctctgatacatgaatacgatagtaacaacctgaatgaaaatacagctgggctgcaattttaactgactgctcctatttgcattcagacctcactgctctagcaaccaaatcctgaatacatatcctccttacatttcgttttctcatgcagacagggcaaaaggccatcttaagacaaaatgagcagaaaagcaataatctcatgtacacagcaatacactttgctcctagatctctacaatggaaaacaaagaaacaaaccaaaaaaaaaaaaaaaaaaaaaaaaaaaccaaacaaaacaaggagcttctgaaggaactgcttattcaagtaaggactgctcatctcccttctgcgtactacgagatgatggcagaattgagttgcagagactctccttgaccaggtggcccacccaccactacctactgacttaagaaagcatctgcattcaaaacagagttcctgtatgaaagctatgctggaaataacatttttaaaaagaaaatgttcaggtttttttttttttcttttccctatgctactcccatgtcaggcttcagagtacagtagtaacctactgcctaaatatagcaaataaccacacatttttatttatatagttcgtgttcgtggctttctgggaaatccaaagaaagtgtgaattccgttcttttgattcattctccctttctgccctattgctctctaaatgaactctgtgactttcatttttttaaaaattaaacattaaaaagcttactttttaatataatggtacaatcagagctcaacactagcacagtccaggaggcctgggtctgtagaaagtgttctgagaacttcatttgtctgcattctgttcccacacctcgccccaggaagctctcataggaatctgctcttgactgtggactcagctctatcttactcttcagtgcccctacggagtttcctggacaggcccttcagagaggaaggagagctgagtgaccatcagtagacgctccccacctccaggccctgctattcctttcctcagggtccaaccagttgccaagaccaggagtagaaagcaggtgcttttacctttgaataacaacactgttgtctttgtggagaagaagaaggagatatgagttgttaagaagagtatgcaattcctgttgaaaactcattttaaaatactatgatttctctcattctttacactgtttctctagctctcaaaattctttaaactcagtctgtataagtattcagcttttcatctcttttttgaaactaaaatgaacattctgtaagtctacaaagcttacttagaaaataccacacattttattttctaggtggaaaactcaagaaataaattgtccggttccaaaccacaaacagagcaaccttacgaagatctgccacccacaaggcctctggctctggctgtttccaaaggtcccacccagcttggccttgtgatggttttgactatagctgagtataaaattaaaaaagaaaacacaccctgatttgattaatgggattaccgagtttgttgttcaacaaaatggaaaaaaaaaaattagcctctgaaacacaaggatagaaggttaagcttccacttacccaagataagtaatctgggctaaagaggtactgctatctgggtaagagactaaattttgcctaaggataaaagtttgtcactcattaagtttttccctatgtaatttacatcttctaaaacaaaaaaggtagcttgttatggcaacattttaatatagggcacgtggttaatcttttggtttacactttgcttttccttctgattgtactggaattccccgaagtcataccgggtatccctcagaagcacattcccagagttctccatgtcagcttgtgtgtcacactcacagctccaaaagggctaatgccagtcttaatgggacagggtcagttcttccaggaaatccttaaagtgtgatttgaggagcagctgaaggaactatgatctaaactaccttccccagtgatctcctaagacatttcatcacctacatttatttattccttttggacctgaagtagtctatttattcatttatttttgagatggagtctcactctgtcgcccaggctatagtgcaatggtgcgatcttggctcactgcaacctccacctcccaggttcacgcaattctcctgcctcagcaagtagatgggattacaggtgcccgccaccatgcccgcctaatattttgtatttttagtagagaaggtattttgccatgttcgccatgctggtctcgaactcttgacctgagatgacccacctgtctcagcctcccaaagtgctgggattacaggcgtgagccaccgtgcccagccttgaagtaattttaaactttctgaatttccagtttaagtgatcctttaaatgggaagtatcataagtagtcatcttaccagtccatgtccaattttgagcttgtcttggtaaagcgccttccaacccaaggagtcagtgagccataagttatgtgtgactatgagacatgccaaatggggctagactggattgagctatgctgcaggtgtaaaacaaacactaggttttgatgatttaatatggaaaaaagaatgtaaaatattttggacatataatgtaaaaattttaaaatctcactacaattaatttcacctgtttcatctatttattcattatgttgagaatatttaagatctattatcctcaggaaatttgaagtacataatacattattattaaatacaatcaccatgttgtacattaggtctccagaacttatgcatcttatgactgtacatttgtaccttttgatcaacatctacttatttccctccaacccccacctcaacccctgatgaccaccattctaccctctgcttctttgtgtttgagttttttagattccacatataagttgcacaggctataactgctccatggttcggggataagaatgccagggacatatttgctggcttgtacctccagctggaggtgagagaacatggtggttctgctggctcaagagcaggtatgcctttggtgggtcatctgggctgtttctctagacaggggcaggagcttgcattaattcagccagcctgggattaatttgtctcgtgtgcaggatctgagtccacagttgttcctgggccctagcactgggcacccacccatgtaagcctggtggaatgacggtggagacccaagattggtggcacacagaggctaccaaccctcagagcaggacacactctagcagtggatctggtttcaaggtggtgccatatcatggtagcttacataaagagggtaaagtgagggatgcacaacttgtgctcctaatctgaagcaatgtagctgtgtgaactacaggcagctccccaaactaggctcagggcttgctgcggctgtggtatactcttgtagtaagaactgcaggtctcttcagtggcaatggaagctggtggggatcttttgcttaccttttcccctcaagggggtagtccctcttgactccaagctaatctcagcagggaacatgagctggcagaggcagggtgccccatcaccctcactatgctgccttcctgggcttctgaacactacagggaatctcactactctcttgctacactttaatgctttccctctgacactctaattgagtttcagttgttttttgtgaggggcataagtggcaggtatgtgtaagccatcttgcagacatcacttctcaactccctttctttcctgctttcaagattctctatgtttaatttttgacagtttgattataatatgtcttggtgaattcctctttgggtggaacctgattggaggtctttgagattcatgtacctggatattcatatctttctctagatttgggaagtattcagtctttaaataagtattctttaaataagctttctgccatgttccctctcttgcccttattacagtctatgatgcagcaattggctctgttgatggtgttccatgaatcctgtagatttctttctcccttccttttcattctttttccttttttcccccatctgattaggtatttttaactgacatgttttcaagttctcagcttctttcttctgcataagaaagtctgctgttgacactttctattgcatttttaaaatgtcattcagtatatgcttcagctccagaatttgtttgggttgttaaataatttctcttaattgaacttttgttcttgtattgtttccctgatttcattgaggaatcaatgaactcttgtattcttatctttgtattctgtggcctactgagttttcttaaaataattattctgaattctttttcaggcaactcatagatgtccatttctttgaaattggttactagaatattattattattattttttgatttttacaggattgtgttacttaacgtcttgcactgctgtttttgcattagaagaagcagttatcttcagtctttactgtctttgggtgaggaatactttctccaaacagccaagctagggattttgaggctctctcagaccttttctatggacatatctactctatacttctcatttcaattagtgggtaattcttacactgtacgtgttctcttgatcctgcaaggctgagtgctgagagcctcccatttgcgtgcccttggccagtgtcctctaatgctcaaatttgtgtgccctctctgaatcccaccgaattgagctcagtgactgtatgacaggtagtttgcacttgctatctgcagtgcatgcattgggagctggcttggggtggggatgggagtgtgaggtgcatggagcatttggagtgcctgtggaccacctgggggaaaggatctgtaggtgaggcatcccatgcagcttggggagaactttctgatggaggtctacagagtagttagaagcctccatggcctctcttccctgctttcaatctttctcaaccactcagctgtgctggttgccttaatattctgagtgggatgtcaaacagtttagcctcttaggcagcatcctacacgtctcagggagccagacactcactcattacactcccactttccccagtggaagaaatcacaggtcatggttgcagggggctctcttggcagtgacctttctgccttgaggtaggggtgacatagataaagtgaaactgttcttcttatactcattattctgtctattctcagtttttttttttttttttttttgagacagagtttcactcttattgcccaggctagagtgcaatggcatgatctcggctcactgcaacctctgcctcccgggttcaagtgattctcctgcctcagcctcccaagtagctgggattacaggcatgtgccacaacacctggctaattttgtatttttaacagagatggggtttctttgtatttttaattgagacgggtttcaccatgttggccaggctggtcttgaactcccgacctcaggtgatccactcacctcggcctcccaaagtgctgggattaccaggcatgagccaccacgcctggccctattctcagattttataatctaatggtgtgctaaaacttctccactggactcatggattcccacaaatgtactcttgtctgtggtatacgtctaaatcaatgcttctgcagggagacgacaacagaaagctcccattctgccatcttgctgatgtcaccctatttacctgtttctttcaatttttaaatgtagctgctagaaaatttaaattcacacctaggtggtttacatttatttctaatggaaggcactgatctatatcacctgacattcctgaactgaaatatttttgttttatgtttaacactcatagaaatctttgtgaaggtgacataatctaaaacaaattgctgttaatgtgtcattctcctaaaaatacagagttggaagggatcttatcagctaattcacccaatcccatctcatttctatgacgaggaaactgaggttcagaaaggataaggtcatgccaaatacaccaattacaagactaaaatggattcccaatctagtcctttttctaattttatgatttttgtctctcagctttcttgtccttttcctgaagataatacctttacccaatagagtgacccttatcagagcaggcatttcagtaaatgattgatgaaggagggatttaaggacagggagtcatttcaaatcacatgattggctgcttattcttccttctcaggaatggccctaattctttgcaatcatctactaaaaatgtggctcaaagaatcctgttgctaggctccgcttctcttcaaaagcagctgttatcatttaaagattaaaattcagagctcttagtcctctttcattatgtaatacaaaatgcaattccaaatgacaaggcaaggatcatgtctgtattattaactggactcagggtataaactgttgatcttacatctctagcttttgactcataattgtaatacagaatctctttgacttgcaatagggttatatcccagataaacccattctaagttgaaaatatcgtaagtcaaaaatatatttacaccacctaacctactgaacatcattaacttagcccagcctaccttaaatgtgctcagaacatttaatattaacttaggtgggcaaaattatctaaccccaaagcctgttttataataaaatattgaatacctcacgtaatatactaaaaactgtactgaaagcataccacttttgcactatcatcaagttgaaaaattgtaagtcaaaccatcttaagtcgggaaccatctgtacttagtatcccacgaaaaaaagaaaagtcttcaatttcctcaataattctattaacctacactatctcagttccagatccagatgtataatcacctctgtcatgtcttctgtaaaggagatagcatttgattccacgctagactgacttactaagattgagacttttgctactaatcttctttaactagtttaacagaatttctcccttgctttcgctaggaagaccaagggaaataatggctatctttgcacttttatgatccagaccacttgcagcttaattgctagaaaattttgtttcagagggtgggtttgccttgtgacagttggcactgtattgagatatgcctctgcactgctcctgtgaaagcaaaagtgacctagataatggcccctactatgaaaattgcttccccaatgttgacaaataaaaataaaccatctgaggaataaggctaggatcacaaccagaaagtgttctccaaaggaaatatatcaaactacccaacgctactgactatgcaacaagatactcaacagtaaaatgaaaggtttactatctgaaatttatattatctgtgcttccagatatgaatggttatgggcttccctaatgactttgaatagaatgtattctttttttgcacatatatcaattttggaaggaatcatgctgttttaaatgtcaccaagaattagaaattcagaaaaaggtgcatcatgcttcaagaatgtcctagatttttaagaaaatattctgtcccaagaaatttataagttttgttatagtggacatttgttgtttctaaaattgaatttcctagccatgtggttggtgtgggctctaactgccttaagccataagcatatgctactctgggtcgcaattcaggagtgggtattcagctgaattcaagcccattaagtcaagtgacctttattctaagtctttggtttcagtcatgagggaagtggacattctcttttttcctgctggattggaacctgaaaacacatataccgagaagtatcttccttccaagcatgaagggactattaattccaagcccatgttcaaagatctaactaatacttaatacatataaaactggctgcagcctctagtacagggtttgcaaactcaaaagccttcagggaccagagcaatgacacttactgtagaaagttatcagatgtgatatattaataacaggcaatggtgagaaggacaagacctgtctttcctaaacgcatttaaattacaatgaaaacaaatacagtattatgttggccaaagaaaacacgttgacattaggtgggctggcaacatacaattcattggcattgcgtcggctggttttctaacaggctttacaatgacctgaaagccagctattaacctgaccttcagcaattcccctgtagtaaatctcttgtagcccagtcatggatttaataggcttgggctggtgtatcttttccctctccctactcaggtccagcttaatttaaggagtatgttaacatctgtaatcatcttaaacgttgcatctgtaacatcttaaatgttgcaggaaaaatatcttgaaataaaaagcgtcatctccttccagttgctgttgtttttaaagctgaagaaacataaaaccaaaacattagggccaactgcattgctgtcaagggaatttctctaatggtgctgtgtcttaaggggcccaggtgttttccagaacagctcaaccaactgtgctttgtttggagccttgtaaacttttacattgacacaaaacatcgatctgccccagaacttgatctgtttcccaatatactagaagcacagggatcaattaaatatttttaagtaaaatgggaactgaataaaatagaaaaaagttaatttataaggaaatgtggctatttctgatatttatttcttgaaattgggaaatgatggtgagtttctcaatgtagacttgtcatgcttaaagcctcttttagaagtaagattagattccaaaccacagcttggaggttaccaattcagtaacatcccttcgcttagagttaagtcaatgaagagagcccattctgagtaaagtttgctgctttaagtaaaagtgaacctcttttctaacaggctaagatggaagtttccttgctctctgtaaatttttttttaaaccctgtatttaccagaatttctgattatttactgtcagtcagagtttggacagtttctaaggcatagaaagagaggtaaatttggctcaccatgaagcactgtttgtactcaaagcaacctgggatttaaacaactggaatgcatacaattagtaacactcctggtgttattactaacagcttaatattctgccaaaataaaagtatttttccttaccaaggacttgtgaaaatggtaagaattgctttgaaaccaagggaggccctgttgaggaggacccaccataagaggaggtgagagcacccattcatgcctatgatcttccctggtgattaaagctcctcttcctgtcactgcccatctgtgggctcccactgaactgcagacactgctgtctgctctcacctgggtgagaacagtcaccaggtttgttttcatgggagcttctggtcctgttaaaacaatgaatactaaggtttctcagagaattacttcctctgatgttatcttttatatacaataataaaatttcacgcatgttgtcaacaaacgtgcgtcaattagtcagtgttccagaaactgggaaaaatggtcaataactcttatatctgctatgaagcggcctgctcagggaatgctgcttatgaagcaaaggatgctgtgcaaagactctctgcaagcactcacgagagaaaaattccggtggctgcaacaatagcaaagtggactcaatatgatatatgacttcaatgttaatttaaattactgaaaaacaattgttcacttcttaaaaagcactacttatacaaaaccccttttagatgacagctgaaattttccctctttcatgacataaatattagctgtaccaagtcagctatcctcgcgcctttctgatagacacaggtgaaggagcttgacagacaagtcaacctgcttgacatattagcatatgggtctgattttaatgagtcctggaacgcagtctgcaagctcgctgaggtgacgatttgatgaaagcaagacttaatccctgcaaaacttggtctaacttcatgtcagggattgaaaatgctggctcttggtgggttacattttcagaaaagaggtagcgctgtcgactcaaaagtagggagggctcctagcaatggcaagctttccatggccttgcagccaccccccacctcctggggacaggctcttccaccttcggcatcaagggctccagcgaggtgctgagtgctggaagcagggactgaggtgctgggaaatttaattagcttgtgtgaaacaaaacaggcctatggcttaaagccacttcagaagtgtgaagaataatgattgctttttgagaactcccatttcccaagaatgaacaagcctggggaaagatgagctgcctagttttttgttgttggtttatttttattttttattttattttttcaagcattttgctggtaaggcttctacggtttttgctaagaaacgtttacctttaccaaaataaatagttctcttagtagagttctccgcccagagcaaggatttgcttgaccatgaagaaaactagtacatggaactgtagtggaagtgtcatttttttaatcaaatgctacatttgataacagaaatattataactcagagactttttaaggcttctatgaaattgtatccaattcagcaagcacacatagcaaggcctggaaatgaacttaggctcatagttttgggtagggggaggtattacggaatccgctacaggtaacaaagacagatgaaaataacttcagcttaaaaaaattgtgccaagtactgaaacagatgaatcccagctagtatatctggatcaggtttttcataggaggaatttgggctgtacctcaaaagacgaacaggactgtcagaaatgaagatgatgggaagagcatcttaggcagaggaaagtaagtgaacaaaggtataaacgtgtgtttggggagagtaggcagaaatgtgactaccgtagggaggccagtgtgggaaagacggacgttgtggaaacgtggagacgccaaatcctctccagtgaaagaaatgagactttcttcaggaggtaactgggggaggggaatcggggaagctgtaggcagctgtcaagcagaggaatgccgtcatctgggttgaacctcagaaaaacaaccggccaaaggatttaggatgaacggaaggagagcggagtgagaggagaaagccagggctcagcagaggaagtagttataaagcaatacaaggaagggacaggtgtgagacgccacagacactgatcgctaggatgtggacacttagaagattttaaatttcaagcctgaggaggaaatcagataagatgaaaacaaaggagaggaacaatgagaagtaaaaggggccagagctacaatgaaaaagaacagctaaaggcagattcagcacacccaccagaaaaaaaaacaaaaacaaaaaacaacaggtcaaattagtcgataattaattctttttattttgtattgcatgctacctactttaaaaataaaaagacactttaaatgtctgaaggcagaggctaagggactctaaccctgacattaatttggaagaaaactgagccatggaaatatttggaaatatactgttttcaacttgggtttaaattttacacttttccatgccatagcatatggatcctcaccattctttttaataagcacactcactgtatagatggatgtgccacaacttaatttatcaacccccttctgaagggcagtgggtgacaagaagaaaaacgcatagtgttgccgaacagcaagaatgtgcagggaaaagctgatgcctcacatcaactatgtggctcatttcctcccttgtgctttttttgactccaattctgccggaagagacacagggatacagaaagcagctgtccaccctggtgtgtccctctactgttctttttcttcccctcacagcgggcgcacactattccaaccaggcaggctatttacttttaagtgtataaactggcaggttactctttgatgtttgcttggcacttaaacagaatcacaaacaagaggggccaccatgaccttgccaggagctcccaaattagagccaggggcaagacacgcctctctcagtgacactgcaaagaaagataccgcctcatggacagatcataagaaaactcagaaatcagcatttactaacatttgggtgcaacacacctcaaactccagatagtggtctttcagtttgtactcatcgacgtccttggctttgaccttcttgtcggggggatatgagcggtgctcggccagctcggtggtgatctgcttcagcttactttcatgtgacttcagttgctcctcctgcaggaaatcatgatgccatttagcgttcaaaaaaaaaacaagtcaataacaaagcacagcatactttaaaaaatcccctgtgctgaatgactttaattcactaaaacagcccaatgtgcctctgctgccacatccttccagctttctcacgcccctgtccacatatttcatatattccttcccgggatggcaatcaaggccaacctctttaactaggtcccttgtcataaaaccaaatggcttccgagctctttatcaggtgtaaatgcccctgagttgggaccaggccttaagagatgccctgacaggcatgtcaccagctgaacagttaagcagctagcatggaagctgcacaccttggctttcccatttcatgcccactcagcaatgctgccagcttttccatccatcacaatgaatgaattgtaattgtctatgtgcatattttttttcctttttgaaagaagcagagctacgaagaaaaatttcttctctgaagcttaccagatgatattctaaaacatgcagctatctcgcttttctcttaccaaagcagcagagttcttagttccttcaacttgattggcccaaagcaacccgtcaattaaaatgtatctacctatttagcaattattgccttagtagcattattataggtaccgtgtaccaatgcaatatggttgatcctacatcaaaggatttccattctaagggtaccatttatatcaccttagcaataggctacccaaaaagatatgttactgaaccttctgccagcattttaaaaacattcttggaattctcttgcattcttgaaaatgtatgactccttactgttctagtttcacatgcaaattatccaaatttcacaggtacaataagataaatgggtaaaggcaaatgaaacagatctgactaaattaggtgataaatgtattttatataacaccaacataattgtagaacacaaaaatcttgtagaatgaggggaataattttttacataaacagaaaatgaataactatggacagtaaattacaaatatataatattgttgtaaattagaagaaaacgtgtccagaaattatgagcgtcacatataatatcttacggacttttgtaataatgtacatcttaaaagccaaacaacaaaaacaaaatccaagtcaaaaaccatcaaaacagaagaaaacaatgacaagtaaaaagcagaggacacgaatggaaaaatgaacaagaaaggtagcatgaacacgtggagtgatctaaaaatgacaagattcatttctaaatgccaactataacaaaacaaaatgaaacactccaagaagtcccagaaaaggacgaaggagaaaagaaacctattttgagattttagaaaggcgtctacatctccaaacctattatttgtatactgataatgctgaaagtcaaaaatgcttcaggtagcttttatttacaagttcttactcatctattactttcaggcaaggagactatcaactatgttatggattgaatgtgtccactcaaaattaaccttcagtgtagctatactcgaaaatggggtccctaaagaagtaataatggttaaatgaggtcataagagtggggcatatatccaataggattagtgcccttataagaggagacactgtgtgcaagcaccaatggaaggccatggtggccatccacagccctaggggagagccctcaccagacaccaactctgctggcaccttgatcttggatttcccatctccagaactgtgagaaaatagatgtctgctatggaagccacccaatctatagtgttttgttatggcagcctgagctaagacaaactatatcaatagtttttatttctttcaaagttgttttcctttgtgtatttattgcaatatgtaaattacctaatagacttcttgacaaatgatatttagtgactggaccacttcaaaaaataaaagcatgatgtattttccttcttttctaaaaaaagttttaaatatataaaaagtcatattgaatgatatatgaaaaacacccatgaatctaacataggaatttaagaaataaaatataaataaatggaaactccctacacatgtacgtgctcatctcattccttttcagtgttattcatatataaagatatgtaaccataaaaatacagaagtgtagccgggtgtggggtgcctcacgcctgtaatcccagcactttgggaggctgaggcaggtggatcacaaggtcaggagtttgagaccagcctgactaacatggtgaaaccctgtctctactaaaaatacaaaaattagccaggcgtggtagcacgtgcctgtaatcccagtgactcaggaggctgaggcaggagaatcacttgaacctgggagatggaggctgcagtgagtcgaggttgcgccactgcactccagtctgggtgacagagcaagactccatctcaaaaaaacaaaacaaaacaaaaccagaagtgtattctctaggttttatacttgatataaaaactaattaaaggctttcttttgtaatttttttttcactcaacatgtttttaagatttatctacatgtatgctctagttcctgtcttttaaacattgcatagtaccccactgcaggacacattacaattttgtttaaggatatttagcttgttttcaggtttcctgttgtgggattttttttccctgttataaatgatgttgcaacagacattcttacacatgtctcctagggaatctgagcaagagtttttctatagtgtgtcacaaagtgttggcatttctgggttttagaatatgcgcatctttaagatgactgttttctaaagtgtttttatctgtttacatttccacagcaggtctgaaagttctctttgttttacattcttgtcaaaatgtgatgttattatacttgtaaattgttgctaatttcataggtaagaaatgataagccactgtgatttgaatttatatttccctgaatatgaatgaggatgagattttgttcataggtttactgggtttcctcttctgtggattactggacccatttttctattgggttgtttgccttttaaaaaatagatttgtatcagtatagttatttataatatatatgttaagaaatcaaactctttctatttgtggttaggaaataattagaatccaataattagaatccaatgatagaatccagtttatttaagaaaaaataggattttaggtaatttggtaaaagaatttacaaacttctatttttttttactttggatctatgcaaatatgctttcagatgtttgcttcttctaaaagctttagatttaggctttccaatcttgaatattcaaatgtctctttttctgttgaacaaatcccaatttctacttattttaatgaggaatacaggctagaatgacaatatgtgcaacatcttatgtttttcactttcctcccaataccagggcttgctcgggtttgttcactgttaccaagctatggtacgtaaatctgtttctacagcagcataaagggctagtcatttaggctatatttttacaaaggaactaaccgaggaagtgctgatgttcaatgagaaatgcttcactactatttcactggcttcataaggcaggagtcaataaagtaagctcaaaataaagcattttaaaatcacatctccttaaatctgtccattttgaacagtgaaatagaaatgccaagtggctcttacggacacagcttgaccatgcaaattattccagtgctagaatcccatgataagaaagatacacattttacacacacacacacacacacacacacacacacacaaacaaaaaaacaacaacagcaacaacaacaaaaaacaatggtaaaaaacaacgggagagaggctgcagccatggagatgtcacattctcagactcaggacaactacatttgtaatagacacgatgaagaaagacaaagtaggaatttgcttttttattcccccaccttttgtctttgcttttacagttctttagggatgcatacatactgtttttagaagacaatactagcaaaatagatttcagagatggcagaaaaatattacatttgacaaagaaaaggcatggagatagaaaataccacaaactcataaaattgttttaagttaggaagtgataatttttaaaaaatgaaattgaaaatactagatacaagaaaagttgttgtggttatatgtcaatagatttaaatcagtaagacctttcataatatatacaacaacattttatctaaaaggcaagttttcgaagtcacttaggatttcatttacttatattaggggttaatccccaaagtatataaggaactcaaaacaatacaatagcaagaaaacaaagcaattaaaaaatgggcaaaggactttgctatggtttcattgtatccccttcaaacttcatatcgaaacttaatcctcattgtgtagtattaagagatggtgccttttggaaagtgattgagtccctcatgaagcggtaagtgtcttatagaagtgctggagtgatataggttagacccttttttgcccccgtcttctgtcatgtgaggatacaacatttatcctcacaaatgctgtcaggaaaatctggaaaactgtaagaaggctcctcaaaaaactaaaaatggaattaccaaataatctagcaatcccacttctgagtatgtagccaaagaaatgaaatcagtatctcaaaaagatgtggcattctcatggtgagaccatgccgtatcttcttcaagaagagggaacagctcttggctgcagcattattcacaatagctaagatctagaagagatctaagtgtcctttgaaaaatggataaggaaaatgtggtatatatacacaatggagtattatttattcacccttaaaaaagaggaaattctgtcatttgcgacaacatggacaaacctggaggacattttgctaactgaagtaagaccggcacagaaagacagatattggatgatctcatatatggaatctaaaacaattgaactcatagaaataaggagaatggtggttaccagaggctgggggcaagggactggggacatgctggtcaaaggatgaaaaatatcagacaagaggaataaattctgttgtgtatcatgatggctagagttcataataatgcactgtgtatttcaaacttgctcaaagaatagaatttaagtgttctaaccataaaaaattgatatagcaaaacatcacaattatacctggaaatacatataattattatatggtcaattaaaattgttaaaaaaatatttaatttttttcctatttatatagtacttaggttttgagaacaatttcagaatttcctttaaaatattaagctctaatgtcatctctatgaagacagtattgcttaactgatcaggcaatgggaacaggcaacttggctgttgaagatcttgcagtgtgagtcaagggctgacttggagttacagtccttctcccccggtgcaaagcccaggaccaagggccagaaattagctttttatctttttataccaagtataagatttacatagtacttatcatggagagaaggatgagagagaagctgtgaaaacttaaaggaaacaataaaatagaaatgcagatggctccaagagggaaaggaggaagaatgagagagaaggcagagagaatcgggaaacagagaacacatttatccatccgcgaacctcaccgagcgcccatacagcaggcactgtgctgggtgctgggaataagaagagggaacagccacagtggctgccaccagtcttttcctccaagctgtgggatacagaatcctagatgttctaaggtggaagagaacctggccactgtcctttctaccctctttgtcttagagaagatggagatccagagagttcaagtaattgctccagttcagacaaaaggacagagtggcagaagccacattctcccaacttctatcatgaagtcaccttggaacagccttctgaaatccaaagggctgtcaacaacatagcttcagcacattgtcttacttgacagatcaatcctgaactcagctttcagagctcttggtaaactccactgctgccgggtctcctctgctatagctctcaaacgtgcaggctggactcagggttactcaccttgctccaaattccactcaaaacctctgttacaggctgggcctggtgactcacacctgtaatcctagcactttaagaggctgagatgggcggatcactgaaggtcaagagttcgagaccagcctggccaacatggtgaaaccccgtttctactaaaaatacaaaaattagccgggtgtggtggcatgcgcctttaattccaattgcactggaggccgaggcaggggaattgcttgaacctgggaggcggaggttgcagggagccgagatcatgccactgcactccagcctgggcgacagagtgagactctgtctagataaagaaaaagaaaaagaaaaagaaaaagaaaaagaaaaagaaaaaacaaaaacaaaacaaaaccaaacctatgttactctagatcacaccacttcttcctcttctgcattacggcagcacttaaatgtctacgtcatatgcttagcacaaaatataccctgacctttgtgtgagttttatctcctttaccgattacaagctcttaaaaaggcaaaaaaggtcacttttttccttcccttaaatcctccagtatccagtaaagtgttgagcagagagatagtatgtggcagcttttggtttatagacattacctgcctaacatgaacaaataccttaagctctcagaagttgagggccaaggcaattgtctcacctgtttttataatgcccacaaaacctaacatagtacctgctatacaggatcttcggtaaacagtagctgaacaaatagatttttttttttaagtgaagatacagaggggagggcttagactgtttcctttgtgctgtcttaaaggagacagatgattttcagggtaatcatgtatctagggatccgcagtgcaacttagaagtcaaattgctaaacactggaaactgttcaaaacgaagtggtacagaatttagaatacagaacacctgtctttgagtcagtttgagggaggctcaatccaaaagattgtttcataatttcatgtttaagacagctttagaccttaaacacagtatttaatgagtataagcaaaatagcttccacatgatttaattacttgttttattgggtacttaatatatattaaatacagacctcgaagaaatgaatttttaaaaatctatccattcaggaaaagtatgggtaacaattaaggccacatcaaagagtttgaatgtgaaaaaatgaatcagttaagggtaagtgacataattagaatcatattttagtcagaactgtaaagggtggatcagaaggacataagattactggaagagagatcacaagtggttacagaaatcatctgggtcagattattccaaagtggggtgtgtgtagcccaggcaagatgacccactgcaaagagttttaaaatcagtattgagatacaattcacataccataaaaacacccctgcatgtctaacagtgctgaactcgtttatgagttttcaaaaattttaatagctccttaggcactgggaaaaaatttaaagttttcttcttcttttttttttttaatctaagcactacaaaatgttaaggtttactaatatttattactgggattgacagtggaaaatgtagtttattttctttaaaaaagcatcatatattaaaagatatctgctgaaatatttagtattgggataaggtgaatagtcaaaaaagtgagtagaccagtgatctaggtagaatatgacaaaaatctgaagcagtaggtgtagaatatgaaagacattggccaggcacggtggctcacgcctgtaatcccaacactttgggaggccgatgcgggcggatcacctgaggtcaggaggtcaagaccagcctggccaacatggtgaaaccccgtctctactaaaaataaacacattagctgggcatggtggtgcacacctgtaatcccagctacttgggaggctgaggcaggacaatcacttgaacctgggaggtggaggttgcagtgagccaagatggcaccactgcactccagcctgggtgatagagtgagaccttgtctcaaaaaaaaaaaaaaaagatatttagagggtagaagtgacaggactttatgacagaaactgtggaaatgggtgggtgggggcgcagtgaaggaagcaactacaagaatgacctcctcccctgaaatcccactgcccgtaaggtcagctccactcacctggctctgagcaccactgccttgtggtcataccacaggacaaaaggaggggtgggggttacttcagcgtgagaatcaagcataggactgctttgcttctgatcagtatccatcttaagtctgaccaaaaaagtatttagtacccatggattcaaacttttataagacaatggttggaattctaagaaaaaagacctagatatcaggaaatgaagatgtcctggggcaccattctctaaagaagcaaggaaagacctagggtaggcacaggttcctacagtgtagggtttaagtgggatctggagccacctgccggcctggagtggaaaagaaacacacatgtgtccctgagcccagcctggacctgaacgacctggtggggctgggaaatgtgcattttctgcaagtcccgacatagctgttgtgcacactgaagtttgaaaagacttctctggtgggcagaaagggaggttgtgagcagactgtgaacagggccggccatgcatttctgtgtttggagagctacaccagaaggagaagcaaaacttgtattttcaaacaagtctttccacccccaatagaagaaaaatgtgctctggcagcactgtcatgaaaaacaaagaaggcgactcctcctacacagcagagttgttcagaaagtaccacgctgcactggcaataatcaattttaatgattaaggctaatgtgttttgcataaaagacaagaataaattaaagcaaagcccacaaatgacagggtgacaaacactgtgtcttgaaaaagcaccaaacaatcttttaattgaacgtctaatttttccccacactgtttatctttctttatcaatgtttccagcaaggcactcacatttttatacctgtattttgtaaagtaaaattatccaaaaaattgtggcatttaggggagtcagagccaggttgtgggagtatggggaaaaaaagatagctggtctcacggcttcacatccactggctaaagcagtggttctcaataggagtgggttggattttgaccccagaagatatttggcaatgtctggagacatttttggttgttagaactggggggtccctattggcatctagtgggtagaagctggggatatcgctaaacatcctacaattcacagaggccctcacgacaaagaattatccacaccaaaatgttaatgctgctgcgctcgaatatgcctgggttaaaggatgagagctagtctttgaggtactggaggaatcctaggggcagccagacatcttccaggatttgctggaggcacactatgaccccagtatagatatccccaagagcctcaggtgctactccaaatacatgcttaattttacatatgtgtttctcaaagctaaaaatcttatctttagaaacaaaccttatgactcggcaaagaaataatacagagctttggatagaaaaatccttgctgggcagggtggctcacgcctgtaattccagcactttgggaggccgaggtgggcagactgcttgaggccaggagttcgagaccatcattgctaacacggtgaaaccttatctctactaaaaatacgaaaaattagctgggtatggtggcgggcgcctgtaatcccagctactcgagaggctgaggcaggagaatggcatgaacccgggaggtggggattgcagtgagccgagatcaagccactgcactccagcctgggcaacagagccagactctgtctcaaaaaaaaaaaaaaaaaaaaaattccttaaaaacattctagaaccatctcatttttctagatggaaagctgaggcccacaaagcaaatgctgggtgatgcaattcagtggggtggcggagatcatctcatttctttccaaataaattaaattcctgaaatgatacggttaccttgtcttacatgatactgcaggatatttctttttggttattaccttcttatttaaaatcttcaatccctaattgtgattatactacatatgcatgtttttgcatctctgtggatttatgtccaaaatgaaggaaaacatttttaaaaattatgcattctatttttggttccagtgtaagtcatctgttagaaataagagtgcctaccatgataaatgtgtgtgcttgcctgttctggggaaaacacgcaaacagatgaacacattcattttcacgtacatatcacttactagtatacagtccctaaataggaaagcagtacattttttaaagtataaagtaaacagaactgtagattttagtgagggaaaatcaaggaaacactcatatgttgctctaagttacattcaccttccatgaatgacatgcttattatcagccctctttagttcaactcaccttctcccctggatcttttatagaactgaatgtgagaaagacccaaactactgaaaaagaacaatgggaaagtccaccgtaaaattaatagagcaaaactcaattttggaaggtttttttttttgcttccagttacttgattttttccctccccttatatcgtgtaatgtgatttaccttttatgcgacatgctctttatgtggtatgctgcttatgttaagtatgcatatttaaagcagagaaatgcatttgctttaagagttcatattttagttggatagatggagatgtctgccaacataccttctggtcatcagtaagagcattccttttcttttaaagttgtagtgtacttattacccttaaaaattcaatgccattgtgtcctgcaagaactgtacagtaatagtaatgcttacaagtaagcattcaatatatgttaatgataattatgaattaaaaacagaagaatctttcctgaaaccacagattcttccttcttactactagtctttctgtttttataactatggcaacacttgagcacattttcctcctccacttccttattaccttccattcattcccccatcaaagaaggccaatgtggtttgtcttcccatgactccaccaaaatgttcttgctaaggttatccaatgatatagtttggatgcttgtcccctccgaatctcatgttgtaatgtgatccccaatgttggaggtgggacctggtaagaggtgtttgcgttatgggggtagatccctcatgaatggcttgatgccacgcttatgataatgaggtagttcttgctttattagttcaagtgaaagtgggttgttaaaaagagcctggcactttcccttcctctctctcttgccatgtgacacatctgtttccctttccccttctatcatcatttgatgcttcctgagattcttaccagaagcagatgctgatgccatgcttcgtgtatagcctgcagaaccgtgagccaaataaacctctcttctttctaaatgacccaggctctagtattctttatagaaacacaaaatgggctaagatacccagtgacctcccagccactaaatatcacatttttaaatctaaatcttcatggaaccttttcccccctttcttggcacaacattctccctgtttgtattaaatctaagtaactttttggaaaattgcttatcaagtgccttagtctgcttctgagctctggccactgcaggaattggagacagaaagaagaaaatgatccaagaaaggagtctaagaagcaaggggggaaatcaagagacagtgaggtgagactccagaagcaggtcagacaccacagtccccagctgtccaagccacaatgacagcctgtttcctctacttccatgagccaccagaagtgtccattctacactttcaaggtctctcaagcactttcactacgatccatttcttctgcagctaccttggttatctctcctctggattactgaaaattcctttaaaatgggcctttctgcttctagtagtaccttcttcttcttttttttttttattatactttaagttttcgggtacatgtgcacaatgtgcaggttagttacatacgtatacatgtgccatgctggtgcgctgcacccactaactcgtcatctagcattaggtatatctcccgatgctatccctccccactcccccgaccccacaacagtccccagagggtgatattccccttcctgtgtccatgtgatctcactgttcagttcccacctatgagtgagaatatgtggtgtttggttttttgttcttgcgatagcttactgagaatgatgatttccaatttcatccatgtccctacaaaggacatgaactcatcattttttatggctgcgtagtattccatggtgtatatgtgccacattttcttaatccagtctatcgttgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcaatgtagaaaaatcacaagcattcttatacaccaacaacagacaaacagagagccaaatcatgagtgaactcccattcacaattgcttcaaagagaataaaatacctaggaatccaacttacaagggatgtgaaggacctcttccaggagaactaccaaccactgctcaaggaaataaaagaggatacaaacaaatggaagaacattccatttaagttttcgggtacatgtgcacattgtgcaggttacttacatacgtatacatgtgccatgctggtgcgctgcacccactaactcgtcatctagcattaggtatatctcccgatgctatccctccccactcccccgaccccacaacagtccccagagtgtgacattccccttcctgtgtccatgtgatctcattgttcagttcccacctatgagtgagaatatgtggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacgaagctggaggcatcacactacctgacttcaaactatactacaaggctatagcaaccaaaacaccgtggtactggtaccaaaacagagatatagatcaatggaacagaacagagccctcagaaataatgccgcttatctacaaccatctgatctttgacaaacatgacaaaaacaagcaatggggattccctatttaataaatggtgctgggaaaactggctagccatatgtagaaagctgaaactggatcccttccttacaccttatacaaaaatcaattcaagatggattaaagacttaaacgttagacctaaaaccatagaaaccctagaagaaaacctaggcattaccattcaggacataggcatgggcaaggacttcatgtctaaaacaccaaaagcaatggcaacaaaacacaaaattgacaaatgggatctaattaaactaaagagcttctgcacagcaaaagaaactaccatcagagtgaacaggcaacctataaaatgggagaaaattttcgcaacctactactcatctgacaaagggctaatatccagaatctacaatgaattcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaagtagtatcttcttctaacaatttctcatattgtaatgagaataatttttaaagcaaaaatgtgatcacattactgtcctgcttaaaactattattattattattattattattattattattgagatggagttttgctctgtcgcccaggctggaatgcagtggcatgatctcggctcactgcaacctcagcctcctgggttcaaccagttctcctgtgtccacctcccaagtagctgggattacagtcatccaccactgcgcctggctaatttttgtattttttactagagacagggttttaccatgctggccaggctggtctcaaactcctgacctcaggtgatctgcccacctcggcttccaaaagtgctgggattacaggcatgagccactgtgcccagtcttaaagctattattttaaggatgctgggaaccacagcagcatccaaaatcctacacacgacaaacaaggcctttcatgatttggcctttgctgacctctgcagaggtacatttcttgctttttctcaacactgtgctcatgtcacagttaataacttgtgtgtggttcctgcatccagcgctctcttctctaggccttcgttcctctgatggctctttttcctatctcgtcccacacctcacctaactgcctctcatcctttaagctgcacattaggtaccacatttcctccttcacctccaaggccaggctagataatgtcccttccttgaacctccacagctctctggacttatccttcctgtacttctatcaaatcattttacaatgacttccttatttatatttgccacaccttcagcagaggatctggccttcatctgcctttctatctccagggccaaaaatagtctctgatgtacaacaggcacacaatacatatttattaaattaatctatcattgataattgctccctctcttgccatgggacacatcttatgatatcaaagatgtatagggagctagttaataccaacacttggtcgatcatagtaagataaaactgtctctatgtaataagaaattcacaaagacatcaaagtagcttccaaaatctttaactagtcaatggcaagggggtactacagacaggtttaaaatgagcaaacctagctggtaggtagtgtccttagaagagttttaagtgaaaaaggacatgataaaatatggcttttagtaagattaatctgaccacagaaggaggcttatgtaaatacacttggagcagagttctggtatactttatcttcattagcttggaaaatccaaatgttccattcagctctgctctgaggggtagggcaggccatttcccattgtaatatgaaccgtggattcctgaaaatatttttgtatttctagcactaaacacatcctggaatatggtaaatgctcaataaaaatgagctaataaatgaatgcaagaaaagcttgttaccaagccagattatgagctggcagttaaaacaaacaaaacatcaagtattgctcataatgaactaatataaaccttagaaactgaatcaaagtacgtgtcctactaactgagactcaattatgtcagcttcctacatgaagtgtaaaacccagtgtactgcatatctgcctcatttatatgatacgctctcacagggcaaggtctcacacctgcccccaaaacatggactactatccaaagacaaatatttatcacattattttacaaagtactttttcccaaggtcaaagcactatcaagatgattacctgagacagttttgttgtagtggcaggcagaagtgggcggctaaacttcttctgagagccgattgctgctggaaatggtggtgcagaaaatacagctgccacacaattgattttgtttatccacccttgcatttcctctgggctcctatgagaaatagatatgtttatatcaggatattgccatgtctaagtagcatcacactttgcctatttcacgttactgatttgcaatggcatgtgaaaatcatttactcctcctggtacaactaatccctgacaaaacttcattagagatgaacattgtcattcgacgatcaccaaagaagctatgatcatcacagtgccagactgtgattctctccctaggaaacagaagggaaaaaagagaaacacttgacaataaatattgattaaacccctactttctgtttgatacgaggctaggccaaaaataaattataaaatttactcatctcttctaattgtactgtttaattttaaaatctaactgaggaatgcattggtagagggaaggtaaaaggatttatctactttggaaaacagctgacaggttcttcgaaagttaactgtgcatgtatcatacgtcccagcaattctactcctaagtaactatccaagagaaataaaaacatatagatatgccagacgtggtggctcatgcctgtaatcccagcactttgggaagccgaggtgggcagatcacgtgaggtcaggagttcaagaccagcctggccaacatggtgaaaccccatctgtactaaaaatacagaaattagctgggcatggtggtgcacacttgtagtcccagctacttgggaggctgaggcaggagaatcacttgtacctgggaggcggaggttgcagtgagcagagatcacgccaccgcactccaggctagggtggcaaagtgagactccatctcaaaagaaaacatacagatacacaaagatttgtatgttagtgtttatagcatcatcattcctgagtcaaaaaagggaaacaatccaaattgtccagtaaatggataaacaaaatgcagtaaatgcacacaactgaacagtatttagcaataaagtactgacacacactacaatacagataaacttccaaagctttatgttaaataaaagaagccagacacaaaagaccacatcatatattagtctgtttatatgaagtgtccagaaagggcaatactgcagaggcagaaagtagatcagtgggtgcctggggctggaggtgagaatggcagtgactacaaaatgcgcacggggatctctttggagtgatggaaatgattcaaaactagattgtggtgatggctgagccattctgtaaatatgctaaaaaaatcactgaaatgtacatttcaaactggtgatattttatggtacgtaaagcatacctcaataagactatttagaaaacccacctgagaggaggtgaaaatcatctgatgtgatcatatttttaatttatgtgtcattatatccagaaagcccaagattcacagcacttaataaatatttgcaaactcataaatgaatggtagaaatgatcatgaatcaggacagattatctaccatacacataatcaataaacaaaaagtaaaaaaaaagtcagccaaagtcatttccttcatcaattactctgagagaaaccacacaaacaaacctgagaccactctaaatgtcagctcctcacggcaccctctctaggctgatctctctggctccattattatttcaatggactgttttttgcatcaattctgtccaaagtaattagatctccttagttattacatctggtatttttgattgaaaaaatcagggaacagaataatttgaaagtttctttatgcccaatagctgtaattatacatccagctatgggtccctgtgtgatgttaaccatcccattcctacactcaaaaaccccgggcaacttgtttccttataacctccccctaaaactggcaattcatcccatttccttgctcacagtagaatgacatcttttccttctagtataatcatggactactagagctcagaagggaaacaaaaaaataaacatttacatttattgaacagttcctatgtgccaggcactgtgtgaggtattatacacacttatctcactgacttctcactagaactctgtaagataaacgttatcccccacactagtgacgagctgaggttcagaggttaaactatgtgctaggagaaagagctagagaaacagtgttatctaggtctgttttactcattttgcgataaaacttgtctactaaaaccctcatattttattgatgaggatactgaattctagagatggtaagtggctgactaaaagtcaaagggctactttgtaacaggtaaaaatgtaaatcctgggtttctatttttttttactctaatcttcttaggcagttatttctctaatgtaagcagttgatgactttgattccaactcaaaaaatttcccctgcagagcttgattttgttccttgcaataaagtagtgctaagtgaactaaaacacaaaatcaaataaaaaccaacaaaacatactgagtttgaaaaagcaagaccctccagtcggcagttttaagtttaaacacgtttggtttcttctcatagtccgtggccttggatgccaatgcgtggtgcacactcacagcgtttttcaagtcctcttcagacaaggccttttctggcttgtattcatcctatagatggacacaaagaaaataaaggcaaaaatcacgatcagatttcaacttaattttttaaaagcaaaaactaaaaaaatagtttttaggaaatccaagtaagtgaatgaaaaaaatgaaacaaacggtgagtaaaaacaaccttataaatgttacagaacattatgttgtttgaaaaatttgctgagaatgagaaaatacatctacccaaggcatttttttaaaaatcagtttttttaaaaaactgatatacaataattgaggtaaatagctaagtaaggccaaaggcagaaataaatatctatcgtacacattttataatgaacagaaatgagacttggaccaatagtgtgatttggtttcaggattaaatggttaaaagcacaaccttacaggtaactgtcaacagaattataccgaggataaaaacaatgccattgtgttctttgctctgaagatattacatgttcctgttactttctgtttagactaatattatcaaaagaaaaatgaatagtaaaataaaataattactccagctcttctgctgaaagaaaagaggaaaatcaataatcaggtgaaagcttagcttgttatcaaaaactgaaaaataggtaaatgcatatgctaccaactgttagatattttctagagtttaaggcctcccttcctccttcccatattttatcaaaaacaagataaacatgcattctgtaaaacacacacgtgtacccccgaacacacacaccacatcaccttctaattagtagtaaaagcctaaagaaagatattgtctgttttcttatcagtctgcttttacaaattttcacaaaaacaatgccagtcctccatacttcccctccctttcatttatcccctccaaaaaccaagcagttcaaatgtactattgccatcaattcaaattgagtcaaaaataatccttcatgtgacaatgctgtgaggcaaaggttttccctctacaatatgatgtaaataccagtggtaatataaagattatccacatttataatattaaacgacaaaattgttactttgggattgcaacaagtcttactttattaagcctcccaggataagaagtgctattgacaatgacagtcttctcgagtggtatgatgaataaaggagaatttaaaaaacaaatacaaggtatttatatgtacctgttactaattcccactaattcataaaactataatctagttatgttttaagatctgccttgtcattttttaaatgagatttttctcagtaatttagcattccaaatattcacaaatctccttccagggaaattttcatcagagtaggaatttcaactagaggtagcatgactacaaaacccctctggccttataattacgctataacagaacccggcacatgtggctctccacgcagtgtaacttagattccagacaaaaacatgaggtaggtaaataactggaatgaggagaaatgatgagggccaaaatcacttgagggaatttatatgccacctccatttccatacatactgatcccctaacacacctaatgattgagtttgcacaaaggttagcctagaaatttgtgtgtactttttttttttttatattctaggtccatgatttaagcttttatcttaattcctcttccctattttctttgaattaatattttgttgttgtttgaatttcttaagatgattacctagttcttttgttttccatatttcttctttggttaagaaagaatttaaggttacaatttttcctctgagtatgggttacactgtgtagcagagtttgggaaagaagagtattttttcattgctttctagatagtttgtagttttaattttttatctcttctttaatcttagtaatatcaaataatgtgcttctcaaatttaaggtaaagttttagttatatattattagatattcataattttattggcttatgaccagagaatatggtctagaaaatctattttccccaaatttggtaaggtttttcttgtggccaatcacatgtttgattttcgttaatgttccataaacatacaaaaaatttattctttgaggaatgaatgtgtctttatattcaagtttattgactcggttcctctgcccttacatcattttttctactagtttatccccttcagacacgtatattaaccttttccacttcaagttcttgttgcatttctgataagttttatacatattttagttgctatgttgtctggtgcatttaggtttataactatcatcttccttataactatgtgccacttattacttaaaatgttcttctttatccgtttaatgcttagtcatataagatggaaatttaaaagagtctttcttttacgaaaatgctctgtttatctattcctcacccacatcaacaagataagactttgaaaaatgttttgttctgcaatcttactaaaattatcttgtgttatgcattttctgtttcaagaagccttattttgaatttagattatacattctgagtctcccctcatagatttaactgcatctatgtttcctcgctcacctgcttctttcttttttccatcttgacctctctcctctcatacctttgctattttctcttctctcaagtattttctttaggtaggtggtatactgttttattcttatcctcaagtatctttcatttctttgataggtatagaactggatatagaacatatggctgcagtcttcttcattggttttacttattgtctggagatgctattctaccatcttctagcttccagtttaatacaagtccaatgccaatctaattattttctctttttcttgtttttttctcttaggaatcacatatgggttttcctttaatcttaggattcaggattttttgctaggctatgccttacttttcttagccatccatttagtctgaaactaaaaagtcccacccttattctcccttatgtaaccattcacttgggttgataattgctgacaaaactaataaacatagttgtgcagactgtagctaagacagatttaaggtctccagctacggctgcatccagtgccaacctacaattcttttacatctccatgatttgtgaaattcttcctcagctttttgttacaataccctcctggtttctctcctacctctctgatcattattttgctatctcttcttcttcatgcccttctatgtaaccgttgggatggtttgaactccagatatatatcacaatgtctaacaaactgctacaggtgaataggaaacacaaaaccaattggtagctattactattgaatgacttagactgtctcatttggagccactataaatattcttcgagtatattatctgctgatatcttcatttaaaatcaagctcaaaggatgacattcttatgctactcttaaaaatgcaaaaaaaaaaaaatttaatgctacatttattacagacccaggaaaaagctaacagtaattgtcaccttggaagaactgcaccattattttaaaagaggactctattccaaggtagtttcctaaactctaaggtaaactgccagattaccttatactggaaggagaacactatatacggcatcagtggaagacaggatctatttaattagggctaaactgaagttgaaaaattttaagtctaggaagcttccgcttttctagttgataatacaattttaccattttttcttaaaaaggcaaaatgcaaaccttaaaatattttcagcattctgaattcctactagaaaataaagctccaagtccacacacacacacacacacacacacacacacacacacaaagggcaaaaccaagagtagagtggaaacattagggttgacaattggattaaaaaaatgactttatcctactaagttcattctgacatctttatttttcactaaaggagaggatagtgtttaaatggtagaattgggcaggaagaaataacggataaatcatcgtaatcaaaccatttcaaaccaaggactatttgctgtgcaaactaaatgtgaaacagtgagcaagataaatccaatcaagaaattttctgtaagaaaagaaaatgctccacgacatctaattactatccattttctcaaataaatgaggggtgaaaatgatgactaaaaacatgttactctctcgtgttccctgcaatctacatcgttttatgtaacaggattcattagagcactccaccatcccaataaacaccaagaatgtgatttcacaatgctatttattttaaatccattaaaagcatgaaataaaaagctttttttccctgagaaacttgttaattaaacctcttgtgaagttgaatcttaacacactaacataaacatcatctacatatgtacaaaaaattggcatcaagtctgaaaaattgtactttcaggtaatataaactacaatttggaaaatgaccaaattgtaattaaaattcttatcaatttaaaaagcatattaaagactccagttttcaatgtactatttacttcatgcctcattaaataggtaaaatagctacatgtacttaaaacaattttaaacacagttgaaatggtcttgatttccactgagagaatataaaaagggaaagtgagaccacattgttacttggagctatgtggaaattaataaaaatgttagtaattaaagcaagctgggtcctaaattgtctattaattcatggttttgaaactggcattaaaaatgttttttataatttgatgaatatcttttttaaaaaatgctaagtatgtctgattaggcgtctttctaaaactcattcagcttcgtcctaataactatttcaacatgtaaaagagcacagaaccagcagtttcacaaaaggaaataaaaacgccatgagctcacaagaaagcaggatgagtgacaggagaccaggccagagatggacctgctccgggtgccacagtcttgggcacatcagctccagactgattgctgtcatcacagtctgggaggccttgaatcctcagtggcttccttctgtgcctgaaccaagccctcccctgatgcgacccagtaaacttttacaaaacctactggttttgtaaaaaccaaaaagtttaattccaattaaacttttacaaaacctattggttgagcctaggaggtcaaagctgcagtgaactgtgatcgcaccactgtgttccagcctgggtgaaacagtgagaatctgtgtcaaaaaacaaacaaaaaaacaagcccccaaaacaaaacacaaacaaacaaaaaccccttataggcaggtggaacaaaatctctcttccgagtaagccagagaataaagatgattctgcaccaaggacacagttcctgatctgtgatagtaaatgtacgttttagataacgaactgatttttcacttctaaagacagggtaaaggtaaataaattcaggtttgaacagctgctttctagaccctaaagataaaatcacatagagattcttgagagcctgatctgcagactacaataatcaagaggtgaactctaagtaattcactgccatgcactaacgagccacctacacccgtcgctcttaaccattccatcaatcatctctagggcagttcagttttgtaacaaccagaactggaacaagaataacatcacaagccttacaaaaatactttcaagagagaagcagagactggcagggacagacacaaagcccatgacagaaactgagagagaaactctgaagctttgtgatagcaaaggcttgtcaaagcacttggctagcggatgactcactctgtaacgaagtggatatgaagttactacccaaatgtcaaccatgatggatcatcagaaccaacaggaatggaatcattttaatgtcaattaaaatgcacattcaattcatagcactttctaatttttaaagcacatatgaactattagtattatattaaaataatatttgtcttttcttccatgaacgcttcacattcccatagtaataattaactaccaatagggcacacattttttaggtactcttgggctcaggggcactgcaagtactagaaaaaacacagataggagtgtgctcttacttagctataaaacagacagaaacactgtaccataaaagtcctattatgccagatcatgactgatacctggactctggaacagttttgaaatgtgcaaatatttaaatcagcccctatgctggtgttgtatatcacaagctctatctcagagagttatagcaagtagaaagaagtgttcacccgaatttattccattcaccctgtgttttctccaaccttcacctatacacttggtttacatcatgttaactggtgctttttcaccaggtgattttaagagtccactagccattcattgcataatactggtcttctcatccacactgtcaggacaagtgttttcagggaccagacgctatgtttatttctcacatagctcccaacatgacattttgtaaagggatctgacattactatcgtgatactccgtggatttactctttgcttgaaagtgaaaggcatatgtgactaagtaacattaaggaagtggccagaaaggaaaatgaggcaaatggtgatgaggcagattgtgtgtaactcagagaagcaaaacaagagctctggataatgtaagaaactgtctgggggaaaggaacaaagataaggacttactttactttagagttcaatcaacaacaggaaagaaacaagattcaatggaaatgagacagacaccggggacttattattttcaaaagtcacaggaaggggaatatgagaaaaagaggagtggagtggatcaaactggaaacttctgggtgagcttctcgagagtagttgtctatgtcctctctgcctctgcatcctcaactctccaatctgccttccacgctcaccactgcactgaaactgctttatcgataatttcctacttgctgaattgacgtggcactctccaattccctatcttaccttttcatgacaggacacatttcaaacatctcttaacatctctggtaccagttttctctctggcttagttttcttcctagctgtctggccacattgcacaggctcctcctcctttctcttcctcctagggcacatatgagtatatggtccactggctctgtcctccatcttctcctcactcttggagtgacatcatctacttgcatggcttaaattaccaattttttgttaatgactgttcagatctgcatttctggccccttcattggctccagatcaaagtatgcataattgcttactggacacatccatttattattccacacactctgaattcaacacctcaaactaaactctccaagtagagctatgtttccccctccatcttacccctgcccttgttcaagttaatctggtctctgtgtctttgatagaacctgtttccaagtcattctccaacctgcagccacactgatctttttttttttttttttttttttttttgagacagagtctcgctctgtcacccaggctggagtgcagtggcaagatctcggctcactgcaacctccacctcctgggttcaagcaattctcctgcctcagactcctgagtagctaggattttacaggcacgtgccaccacgcctggctaatttttgcatttttagtagagatggggtttcaccatgttggtcaggctggtcttgaactcctgacctcatgatccacccgcctcagcctcccaaagtgttgggattacaggcgtgagccaccgcatctgacccagattgatctttttaaaatacaaatataaatgctgtgcatggtggctcacacctataatccctgcactttgggaggtcaaggcaggaggatcgcttaagttgaggaattcaagaccagcctgggtaacgaagtgagatcccgtttctacaaataatagaaaaattagtcaggtgtggtggtggtcccagctactcagggggctgaagttggaggactgcttgatcctggttggggtcaaggctgcagtgagctgagacaccgccattgcactccagtttgggtaacagagtgagacctagtttcaaaaaaataagtaaaataatcaggtcactccccatttaaaacatgtgatagctccaactgctctaagataaagtctcaactctttaacatggttctctaggctcttctgcctcaaacaccactgaacctgcagttccccaaacacgctgtatcacatctaagtatccatacacgtttgtctctgagttcccttatatgactagcttccatttgtgtttttaagtgtggggttagatatcactttcttcatgaactctttcatgagcttcccttctcttgctcaggttaagtgcccttccatatgtgtttccatagcaccctcctctctttgtagcatttctcaaattgcactgaattggccttttgtttgttaatttcttcagaatgaagaagaaagctcctttgggcaccgtatcttgctcacaatcatatctctagtatacaacattctagaagacgggcaaagtcctaatcttatatatgcactcattattgacttgcttcctaggtaaatttatggccctctgtatcagaaaggtagtttactagccaaagttcagctgatactggatacttaagccatattttaagtgtcaatctgagagatataaaataggatgccaacagttccacatacttcatggtttctgggaacaatagacctgaaaaaggtctatgttagaaaatctcaaagtttatgtactcaactaatagaagatacgagacattttccagtgaaagagtggaaagtctcatatcccagtgaaagagtggctggagccaggcaagtgcaatcagagaaagggcaaagccatcattctttattcaagtcagaggctgaaggaaagttaatgcacagttgctgtgcagtggccaagttagttgaagctgggtgaagtcataacagttagagacctctccccacaacagcattttaaacttccagtaattacaaggctctcacactagagtgttcatatttacttaagaagacactaatgggaaaaatattagcttggctagtaccatctttacaatactgagtaggttaatcaactttagaacgccagcttttcaatttaaaaaatgggaacagtatccttctatgagattgtgaagctcagatggaagaagtaacctacaacctattatactaacaaaccagtctcatttctggctaaatggccaatgaagcaagctggctcaggcaatctgccaagccgtttcctacatttgtgatgtataatgctctgatctgggagtggttattcttttagatatgaaatatacagaaatgctctgcagggctatgtgggctttctttaatacgggaatactgctcttaaatgtctcttcaaaaaggtggggggctccttgtgcttatttgtttcatgtttttgctacatggaacgggtatgtagagcctatggcttattttttcataaagggactatctaaatatccagggttgaggtggtgagagggagagggagcggaggcatgtgtctgatctttggtaaaatttctctaactagaagacaagtatgtagaagtcatgtcatatatataattaatgtctatgggaatgaggaatggggtgatatggtatttttgacctgtgtttatgccacatcgctagctccagaacacgaagccctctgccttgcctggcactagtgctaggaggatttatggaggcatttgtctcctatctgaagtggaaacaaaggtagaagaaattacttatttttcaataaaggtaccagggaaagtaagggcctttatttggatggttgagaaggcctaactcttaatcatttcatacacagactgctgtaggaagattgtgaaaagggaggaaaataaggtctgaataaagccagtcactttatttttattttatttttgagacaggctctcactgtcacgcaggctagagtgcaatgacccaatcttgactcactataacctctgcctcctgggctcaatcaatcctcctgcctcagcgtcctgagtagctaggaccacaggcaagtaccactatgtctggctaatttttgtattttttgtagagatggggttttgacatgttgcccaggctggtcttgaacccttgggcttaagcaatctacccacctcagcctcccaaagtgctgggattacaggtgtgagccactgtgcccaaccacaccagacactttattccttatgagatgactaataatcaagaaaggactaaaagaaaaaatactctcatttcttataagagtcgtcaggaagggaaccaatatttactattaacctactgtgcaacaggtgttttcatgtatttaatcatttctttatatcaaccatgcaacatcatttcccctcattttacacagaaatgagttgaggttcgcagaggataattaactgctccaaatcagcaattagttaagtgacagacttggagtttgacaaggcatgtctacttactggagtatgactcttcgtaactcttcaaggtgtgactcttcttttggaagagccttttaatgctcttccaagagatatattttcctagggggatctgaggaagctggggagagcgatccccagcctaacaaagctcttactttaatacctaagaggctgccgacactgtgcccatgtgttcaggaggcatgcaacatatgggagcataaacacagggcggccacaaccttaagaggcatgagatattatttattaatgcttcaacttcctgtaggagtggccaaaaacctttgcaacaagccactttggctgggatgggagtagtgaaagaggttgagcgaatggagactgtgaggacttggcactcgctcctgtgtaatttcagctgtgcctagttttccttctgatgactattgtgacttttttgtttatttgtttttcggagggggaaagcctttactattactctccatttgtaatgaagaaatgcgaattgaattattcttgaattgttctatatgggtaaaaatcattatacgctattacgtagttgagaagtcttgatgaaaggcttaaagtaactgatgagcaactaataatgaaatgagaccctaaacagattgttattccagtgggtggggcagggggtggtttgtgtatgtgtgtggtatatatgtgtttacaatgaagggaaggtggtcttcaaagccagccattatggacttccggaatggctggaattgccagccattatgaattctttcgaagaccaatttgattcatttaatcagggaagcagtggccctgtttccttctgtctcaggcagtactacccccctcatttatccccaaggccgagacgttggcagccgcaagggggaaaatggagggcactcaggagggaagttaactggaagcccttggacaggattccttgatgctgagaaatgtatatggggtagaaaggtgtggagaaagagagaatggatgtagagcctgagtgtgctagtgaggcccttaaggatagacgccggatcctgggatctttgcatccccatctctggcaaagcccctgttacacaggaggccaaatgagtgagcttttgtcaaactgaatgacactaactttgggccagggcttttttctcctctcctcacccaaatagtgggggattggctgaagaagggaagaagaaggagagacatttctgctatactggaatcctaggagtgtaaatactggcatcctaagagcacagagcggagaacaacatggcactcccaggtcacatgccccacacaggtcctgtgaggagggctgcttagcatgggggacactatgccacctaagtcctttgagtacctgagtataggtggcagcggcaatgacctctcactcaaagagcttgaaattccttgagggaagaaaacagttctttcgtaaatgggacactttatgacattgtgataccatctctttaattttcgtgataccttcatcatttgaaacataatttttttcatcatctttctactgcttgctactccccctccagcctataatgcaaatgtaaaaagtagtttgccactctttgaatatgccatattctctcatatctgctattttcacccttctcttgctaaaatgctttttctcgcctgcctgcctggcaaactcctgcttatctttcaggcatcagttcaagtcatgttaattcctcagggaggcatcttctgacctttgcaagtatgcttagggggccttcttcagtaagatttttccacgcctctattaattcatctcattgcttagtgaatgctcaatttatctgttttcctcctattttgtgagctctgtgtaggcagggattgtatcttagttgtctttggaagcttagaattttgcacagtacctgatgtgataaatagctttgggaggatataaaacccaaactgtataaaccccaaaccaccttgtaatcatataatttactttttgtgtagcatctgctatcacatgctggtagattaggcttccaaccagggggacggattaaccagcagtgggacattagtaactccctgtaggatgcacacatcaccaggattagcccttaacacatgctacaacctggccaaggggaagaagtttaactatctactactcctgtttctgctggatggctcgataccccaaagaacgctatgatgcaaaagtctgctcagcagcaggcagtatcctattaacctaagagggagtggcatttccagatgtagatgcccataaggtcttccttcttgtacagtctacctacctttttagtttttagttttacagattaagaagaaactacagaaccaggtagaaaccacacaatcaggtagatatagccatacaagacacagaactatgaagtttaagcttccattgattgaggaattagtctctaggatctgtgcaaggtttccaggaacatatattagttctgattttttaaaaaagagcattaagaagagagtggagactggttattaaacatggccacccttttgcaggcttattctcattgtaagtagatagtttacagctatgctagcattcttatgatttaactgaaatagcaacccgaacaataacccatgattctactattcactcttcataaatgtataatttccttactgccaggcttttctctttataaaagcaatttcacccaactttgcccaaatgcacatttgccacactccagagctatcataaatccggagaagcaaccttcttggagctctaatccaagctgatgctgaagcttcaaagtttacaaagttgttcccttgtcaatactaacccattctccatcttgatgactcaaactcccaatacatttatctgagggagaggacagtgatgtaggaaaagctggtacctttgaaacagcatctttcttggcatcactcctctcaaatgttgaatgtgagaatagtgttctcttcccaggcccaccctgagatggagtgggtggaaatccggtggctaggtattcagagaaacggttttgccaaaggcagctatgccccttaacacagattttagacaaaataaagaagtgacccaagagagtggaatttatgctggggaaatggctgtgatatgtgaaatttaatttcaaagggttcttccttgcagagacaaaggtagctaaaaggaccagtgtgggcccagcatgtacacacatgctgatctggcagaggccagagtagctgacttataaactagaagcttataggactccacaggaaaacaagcttatagactccataggaaaataaagacagtatgagatagccagccacctaagagcatggataatctccaagtatcaacaactgcctccatttctcccttgtcatgaccctcaaagtaatgtgagaattttagaaggatgcggcaaatcatttactttgtgatctttgggtttcagctaactccatatctctttctacaaagcctattttcccaaaaagagatcatggtctaaggtgaagcattccatgctccaatattccttacctgatgtattccaaaaggaagatgacaaaagggtttgtgttagatatggtccttcctaatttggacacttgaaaacagttcagataaaaaataaaacaaaaaataattataaaaatgttgtttacaaagctgctctggtaatatgtaaaatgttaatgaaagatatgggtttccagtggcagggtctggagaaggggtggcaggcaccagatccagccatcaaagtggcaagaagcagccctgaaatgagccaaggagatgggcgaggaggcgagggcttctaagcagaaacaaaaagaaaagacaaagaaactctggagctgaaagcaaaggctgtgggcaagggtcccctgcccaaaaggttgatttaagaaatctgtccacaagtaagttgttctttgcgtctgaggtgatggtgatccttgccttccgttcttacttaaacatctgtattccctgccataacatattttgccacctacagctaaaatgaagtgctgtcttggaatctgttgaacatttaaaaataaacttttgtaaaaaaacaaaaacaagcaaagaaaacaacaacaacaacaataaaaaagcaaaaaagatacagtatagttgaaatataaagtcctttaaataaagatctgggtggacaaaggaaggctagttttaaaaaagaataattctttcaatctcatatatggcattattataatattttgaaaaatttaaaataacaataaatcaaatgtattccttcccagtctccattccaaagcagttgatcatctcagtggtgcaagcgtgcataccatgaggggtcgccatctgattcagtactgcggatagtaaatcaaacgggaggcctctttgccagagaaacacaggtgtggaaaggcaactacagcagtgtgtaaagagtggaaggacatgtgttcgtggacaaacaccaaaaacaagaagttcaaaatgaatcctttcagatcctttcctctgaatacccatatgtcaataatacactgaaaacagacatgttgtcacaaacttctgtaaggaatgacattaggtataatctttctggaggtaatttagaaatatgttttcagaactgtaaacagttcctaccatgtgccccatgacacccctaggaatcttaagaaaataaaagagatatgtgcatgtgtgtgtgtgcagtgttattttataaatgaaaaactaaaaaagagtatgtctgaaagtgggggaaaagttaaattatgataaatctatttaacaaaaaatactacatgcatttaaaaatgaatatgtttataaatgatctagggacagaagaaacaaaaccataattacatatcatttcacagtcaccaaataccagattgatgaaaaccaaaaatgtttctaaaaaacttttaataagaaactgtttatgataacatacagagtgaaaagaataagacgccaaaactgtgttatactatgattccacatagatttaaacagtctcttcctgggagtgctgttagcaagacagcagaataggtagtcccagctcccatctccccaataaaaatattgagtaatcaatgatttatggaccaaaatacctactaagacaataccaaaatccagtgaagaggttgtagtaccccaggagagcacaaagccaagaaacccacgctgaaacaggtaagaagagtgatttcatcttacccacatcaacccctccctgaagctagcatgcctcagcaccagaagagaatgccctggcccctgacatctctgatgggggaaaggaaagaggtctttgctattctggcttttcagagggctgcctgggtaatggcttaatcttggttcaattggaatactgagggaactgcaatagtgtggatacctgggcactgctaagaacaaaggaaagtggtgggtggttcgctgcagtcagcacagcttgatgcaattgggagaaaaggtggtcaacctgaagcttctactttgggagggctgaagaaaggtagagtgtgtggccctcatttcagctcttcttggccccaagggactaatttctttctcacctcactcacagcactaacagaactagcatagcttggaagcctgaaggacacttagaacagagtagagagacaggtggcttgctgtggctggcacacttagtgtacttgatttctcccttgggagggagagagagaggagcagagtatgcatccagcattctggctttttggagggctatctgagggagtggtatctgactctcctgattcagggaactgatggcatacacttggtggctgcttagaacaggggacagctgggtagcttcctgctctaaaatcagataacttgcagtgttgcagacagacatcaaagggtgcaaggattatgggctcctgaaaaaggattcagagttccctaaaatctgttgcaaagatgactggtgaggggcttctgctgtagcaagccagtctctatactggaagaggtggctgattcttcaaatgtgcagatcccaatacagctacaagagacagaacaaacaggaaaacatggttcaatggaacaaaatgaatttccagaaattgaccgtaaagaaacaaaggtataagaattacctgcataaacactgtaaagatgctcaacaagctaaaaaaagatgaataaacaaaatgagaatatcaacaaagagaaaatatttaagggaactaaatagatattttcaagctgaagaatatagtaactgaaatgaaaaattcagatgagaggctcaagagcagaaaacaaagaagaaagaatgagcaaacttgaaaacgggccatttgaaattatccactcagagaacaaagataaataagaatgaaaaagagttaagagagccttatacacatcattatgcagaccaacacattatggaaatccaagaaagagcagaaagaagaaagagggcacaaagcttatttaccgaacacttctgaaatctgaggaaggaaacagacatccagattcgagaagcctaatgacaaccaggattaatggaaataaattacactgggaccaatgaccaaattataaaaagtcaaagaaaaacagaggactttgaaagtagcaaaagaaaagtgattggtctgtgtatttctcagcataaatgatccagggccagaagtgactgtgatgatatgttcaaggtgctcaaaaaaacaaacaaacaaacaaacaaacaaaaacacttgccacacaagcatattacatccagcaaaactaccctttaaaaatgaaagatatatagaccaatggaacagaacagagccctcagaaataacaccacccatctacaactatctgatctttgacaaacctgacaagaacaagaaatggggaaaggattccctatttaacaaatggtgctgggaaaactggctagccatatgtagaaagctgaaactggatcccttccttacaccttatacaaaaattaattcaagatggattaaagacttacatgttagacctaaaaccgtaacaaccctagaagaaaacctaggcaataccattcaggacataggcacgggcaaggacttcatgtctaaaacaccaaaagcaatggcaataaaagccaaaattgacaaatgggatctaattaaactaaagagcttctgcacagcaaaagaaactaccatcagagtgaacacgcaacctacagaatgggagaaaatttttccaatctactcatctgacaaagggctaatatccagagtctacaatgaactcaaacaaatttacaagaaataaacaaacaaccccatcaaagagtgggtgaaggatatgaacagacacttctcaaaagaagacatttatgcagccaacagacacatgaaaaaatgctcatcatcactggccatcacagaaatgcaaatcaaaaccacaatgagatatcatctcacaccagttagaacggcgatcgttaaaaagtcaggaaacaacaggtgctggagaggatgtggagaaataggaacacttttacactgttggtgggactgtaaactagttcaaccattgtggaagacagtgtggtgattcctcagggatctagaactagaaataccatttgacccagccatcccattactgggtatatacccaaaggattataaatcatgctgctataaagacacatgctcacgtacgtttattgcagcactactcacaatagcaaagacttggaacgaacccaaatgtccatcagtgatagactggattaagaaaatgtggcacatatacaccatggaacactatgcagccctaaaaaaggatgagttcatgtcctttgtagggacatggatgaagctggaaaccatcattctcagcaaactatcacaaggacaaaaaaccaaacaccgcatgctctcagtcataggtgggaattgaacaatgagaacacttggacacaggaaggggaacatcacacaccggggcctgttgtggggcggggggaggggggagggatagcattaagagacatacctaatgcaaatgacgagttaatgggtgcagcacaccaacatggcacatgtatacatatataacaaacctgcacgttgtgcatatgtaccctagaacttaaagtataataatatatattatatatatattatataatatatattattatatacatattatataatatatattattatatacatattatataatatatattattatatatattatataatatatattattatatatattatataatatatattattatatatattatataatatatattatatataataatatatattattatatataatatatattataatatataatatatattctatatattatataatatataaataatataatacattatatataatatattatataatatataaataatatacattatatataatatattatattatttatatattatattatatatatacaaaagaaagaaagataatattttcttaggtaaacgaaagttgagagagttcatcactgctggacttgccttacaagaaaggctaaagggagttcaacttgaaatgaaagaatgctaaacagaaacaagaaagtataaagctcaatagcaaaagtaaacagagacaggacttggtatccgtgggagatttgttctaggacccctgatggacaccaaaatccatggatgctcaagtcacttacataacatgacacagtatttgcatatatcatatgtatatccttctgtacacgttttacatcatctctagattactcatgatacctaataaaaggcctacacatcacttcattggcatagattcaacatagtactcagcatgtagaaaattcaagttttgttttttgaaactttgtggaactttttttttctgaatatttcaatctcaggttggttgaattcaaatgcagcaatcactgatatgcagtgctgagcatatgtaggaaaaatatacaatgctttaatgttgtaatagtggtgtgtaaatgacttttaactctggtatagaaattttaaaaaaagtattaaaatactttacctataaatatacattagtgggaacagaatacaaaaggatataatttgtgacggagtaaaagtatagttttggcatatgacctgaaatcattatcagcttaaaatagatcattataactgttttatgtaagccccatggtaagcaaacaaacaaacaaacaaaaaaaaccctaaaagatacccaaaagaaaatgagaataaagaaatgttattacaaaaaaaaaaaaaaaggaatactaataagagtgaagtaaaaaagtgacaagacagaaaataaatagcaaaatagcaagagtgtttctctatcgataattactttaaatatgaatggattaaactcccaatcacagctgggagtgtggttgaatgtattgagagagagagagacagagagacagagacagacggagggagggacagatgcagagagagagagaaaaaaaaacccaagtataagctgtctacaagagactcactttagatttaaagacacacacacctgaacatgaaataatggaaaaaatattgcatgcaattggtaacaaaaagagcagaggggtagccatacttatattatacaaaataagtaaaaaactgtcaagagagaaagaatgacatataataatgagtcaattcaccacacagttgtaaccattattagtacatatgcatctatcatcaaggcacgtaaatatatagagtaaacattgacaggactgaaggtagaaattaacaatagtaggagatttccactccccactctctataatgtacagaacttctagacagaagactaataaagaaacagagaacttcaaaaatgcaatacaccaaatatcctagcaaacatatacagaacattccactcaacagcatgagaatatatattcttctcaagtgcacatggaacattctctgggatagataaaattctaagttacaaaacaaatcttaccaaatttaagaagactgaaataataccaaatatattgtccaatcacaaagaaagggaagtagaaattaaaagcagaaggaaaatggagagttcacaaatatgtggaaattaagcaacatgatcctgaacaatcaatgggtcaaaaaaaaatcaaaaaggaaattggacaataatttgagaccaacaaaaatggacaaacaatatgccaaaacttgtggaaggaaacaaaagcagtaccaataggcaagtttatggtaataaacacttaacattagaaaagaagaaagatttaaataaacaacctgtttttacaccagataaagtaatgcaaagttagcacaggaaagaaacaataaagattagagcagaaataaacgaaatagagaaatgaaaatcaaagtcagcacaggaaagacacagtaaagattagagcagaaataaatgaaatagagaaatgaaaatctaatcaaagattagagcagaaataaaagaaatagagaaatgaaaaaataaaactaaaaatttcttttcaaaagatcaacaaaattgacaatcctttagctggactaagaaaaaaacagagaacactcaaataaataaaatcagaaatgaaacaggaggtattgcaattgatgccacataaactaaaaggattctaagaaactgttatgaacaattatacaccaacaaattgggaaacctagaagaaagggataaattactagaaacctacaatctaccaagatgaattacggagaggtagaaaatctgaatggatctgtaataataaggggattgaatctgtaatgaaaaccctcccaacaaaggaaagtttaggagcagatggcttcaccagtgaattctacctaacagttaaacaactaatgccaatcattctcaaactgttccaaaaaattgaagaggagggaacacttccaaactcattttatgaggccagcatgaccctgatatcaaaaccagaaaacagtactgcaagaaaactacttgccaacatccattatgagcataaatgcaaaaactctaaacataatgctggcaaactgaattcaacagtacattaaaaggatctacaactatctgatctttgacaaacctgagaaaaacaaacaatggggaaaggattccctgtttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattattgggtgcagcgcaccagcatggcacatgtatacatatgtaactaacctgcacaatgtgcacatgtaccctaaaacttagagtataataaaaaaaaaaaaaaaaaaaaaaaaaaaaggatcatatacaatgaccaagtgagatttatccttgggatgtaaaggtggttcaacatatgaaaatcagtcaaagtgataaaacgcattaacagatcaaatgataaaaattacacaaacatctcaatgatgcaggaaagcgatgatattaatatcctttcatgatttgaaaaaccctcaaaacagatacagtttcaaatgatcttatatgtagaaaacccaaagattccccaaaaacctattagaataaataaattcagcaaagttgcaggatacaaaatcaaccatcagttccatttctatatgctaacaatgaacaatctgaaaaggaaatgaataataccatttacaacagcatcaaaaactattaaaaaatacttaagaataaacatgatcaagaaggcaaaagacatatacactgaaaactataaaacactgctgaaagaaattaaagaagacacaaataaatgaaaagacattccatcttcagggattcaggattcaaagatttaacattattaaaatgtccatactgcccacagcgacctacatattcaataaaatccctgtgaatatcccagtggaattttttacagaaaaagaaaaaaaaattccaaaatttatatgtaatcataaaagactctgaatctctgaataagccataaatcatactgaaaaagaagaacaaagctgtaggcctcacattcctgatttcaaaacatattaccaagctacaacatcaaatcaatatggttctggcataaagacagacacatgcatagaccaacagaatggaacacagagctcagacaaattcaacacatatatggggggaagctggaacccttatgtactgttgttcaggtataaaatggtacattgctttggaaaaccatatggagtttcttcaaaaaactgaaaacagaaccatatgaccccacagtcccacttctgggtatttatccacaagaaatgaaattaggatcttgaagagatatttgcaccccatgttcattgcggcattactcacaaaaggtggaaacgacctaagtgtccactgaacgatgaataaagaatatgtgctacagtaggctccccttatctatccatgtgggatgtattctaagacccccagtggacgcctgaaattttgaatagtacgagaccctatatatagatgacccttaaagagaatgggcttgaactgtacagatccactaatatgcagactgttttccatcaaatgaggactaataatatggcacttgtggggcgtgaaacccgagtatgcagaagccaacttttcttatatgtggattcaacagggctgactgcaggacttgagtatgtggggactttggtatttaaggggcgtcctggagccaatctgttgtgtgcatggagggatgacggtatactatgttttctcctatacatacatacctaacataaaatttaatttataaattagtcacagtaagagattaaccataataactaataataaaatagaacaatgataacaatatgccaccatcactgttctctggggctagtaagtaaaataagggtcacttgaacacaaacactgcgatagctggacagctgatgtcatcacagagatgtctattaagtgattaaaggatgggcatatataggatggctatgctggacaaagggatgattcacagctggtcaggatgcagcaggattgagaaagatttcattacgctactgagaacagcatgcaacttaaaacttaaaatcgtttatttctggaattctccgctgaaaattttttaacatcagcaaacaaactgcagaaagtgaaaccacagataagggagactaccgtacatacatatactggacctcatgtaattatttcatcgagttttgtggattttttatctgctttacttttaccttttgcaagtaaagaactgttcccttcagtacagcataaaaggttttccatcctcgttttcctcttggagctagaaagggggaaaaaatgtaaaattttatttgacatcagcattttagaaagagaatctaaatgatcaacatggtgacagtgtttcaatattctacctagctaccgaaagtaataacaataagaactaaaattttctgagccttatggtgtaccaggcggcattctaaaatgttttccatatacgatcttaatatttacaatgctcctaccaggttggtgctatttctctcttcttacaaaactgaaacacaaggcaataacttgctaatggtcccacaactaggaagagtagaaggctgaaaaaccaggtagcatggctgacaacagactgggtaagcacaggaagcatactggaaatacatagcaatccaagagaaagcttaaagagctcatgtaccagagcctttatagcttcttcagagactctagaaatcacgaagtagtctcagaatatgaaaggaccacttttggcatttctcccatacccccctcaaccagagtgcaagtttaaatgttattactcctattgcaacctgtgcatatctctactgaggatcttgctgtaatgtactattttcgtctaaatgtctctttcactagactatgtatgacttgacaggaggtatccttcatctttagaattcaccaaatcgagtatactgcaagacagacattaaacacaatcatacaaattatccaaaataattaattatttcagaagtccttagatttcttctgtttatatttttctggatatgaattctctactgacttgtataaactcttacaaattgttctaaagcaaaaagcaatagattagcaaaacagtttaggatttattatcttaatacaattaaaatctataactggaaaatgttattgcttgaatatcatttttctaaacatgtctgctgaaatagacagggagagccatttactcatgctcttgtatcaaacatgtggctgtctgtggtctgtctttaacctggatacctgattacattagaaagtacattattgtcaaccaaatcctttaaatctcttttgactgaatactcaagaattcttagacttggaactaggtgaatagccacttacagaacacaggcaatcctgccaacaccatgctgagatatccacctggcaagaaaggattcaaaatatccaccctgcaggtttccaagggagataataaatatcatcccttctgcctccactaggtgaggcttaaaggtatactaaaaatacatataaccaaaaaaaagcataccattatttccgttataaagcaaaaaagcaactaagataaacagataaccatacatcacatataaaataaatattcactacattgttcaatagatgtgaaattctgatactgccaacatgagcactgcgcacacagaagagaccagggctgagagggctgctgcagagcagggcctcaggtggcacagtgtgcaggaggcacctgacttgaaagcagaccagctggtttccagccccttcacaatctcacctggtctgaaaactatcctcccacccaccagcccctaacaagtcactctactgctgtacttttgcttcattttaaaatgtgggtaattcctagaactgaaggcaaagcattggctaatgctggaatggaacctggagaaaatatttttgtttttaacagaagagccataggtcctgaagtacaaaggctttccccgagccctaaaactaatttattggcatcttgcgatccctttagttcaaaaatctacacatctacgtttctactttcgcagtagatcaattaatccaagtacatgtttacaaaattttaaacagctctttctcattactacactaagcctactacaaagagattccaaagagctctccaagcgaaatgtgattttaaaagtcacccatgagtgactaatgcccactaagtcagttacttagtaactgacttacttattgtactcacttactgcagtctacttttctatttcccacagaagtataaaacttaaccttatctttggccagttacaatttagtaatctaacacatggatgaaacaacctataatcctcccaaaaagataactagggagcaattattcaacggtatttagttggtgtgctataaaagcactgctctaagtgctctgacacttattaatccatttaactcacaccgtaatgctaagagtaaggtactattgatacttccatcttacgtgagacagatgggtgcaatcaagcagaattcaggggaagaagggactactgtgcactaaagtgggctgggaaggctctctagagcaggtgcaactgctctgatttgacaaccacacatacagtgccgctgttgccactggacccttggtgaggctcttcaagcaaaacacaatgagctggatgctaatgaatgacaagcactggtcctcatcatgaggactgtagaaggagttaaagtgatttcacagcacgtgtgttttattaaacacacagaggtccgtaaagagttgtaacttcacataatgaacttgatgagaggaagagtgaaaagattactgacaggaaacctaatgcagcaactgacaggctttaactacaagggctgtggggaatcaataggctgacatcctttaatatccaggtatcttccgtgagaaagtgtttactgagtttgattaaaagacaccattttacatgtgagcccatcttttcactgcagtttttactgtgcatacttaaggtccaaagacaatcaattgctttccttcttgaaaatacaagaagcttttagggttttgattccaacaatctgcctctaaccttactttggcttttcttttttttaatgctattgaaacaggcatcattgtttttctataacatgctactgtcagtttaatgtttacttttatctttattgatcacttctttctgtacctcagattgctttttggaggccattttcaattacttcttgaagtctatcctttagaagttcctttagtgaggagggtcttttggtggccaatcttctatttttgtttgtataataaatgtccttatttcattaaaaattccaagttgataactgctttttcttatgaagacattatttcactatcttttggctaacaccattgttgcaatgttgatagtgtttagatctgtgtgcccacccaaatctcatgttcagctacaatccccagtgttggaggtgtagcctggtgggaggtgattgggtcatgtgggtggtttctcatgaatggtttagcaccatccgcttctcgtgacactgagtaagtgaatgctcgtgagatctggttgtttaaaagtgtgtagcacctcgcccagtttgcttgctccttctctggccatttgaagccctgttcccccttcactttcagctatgactgtaagtttcctgaggccttcccagaagctgaacagatgccaacatcatgcttcctgtacagcctgcagacccgtgagccaattaaacctcttttcttataaattacccagtctcaggttttctttatagcagtatgaaaatggaccaatacagaaaattggtactgtcaagtggggcattgcttataaagatacctgaaaatgtgaaagctacttttgaactggataaaaatcagaggttggaagagggtggagggctcagaataatacaggaagatgactgaaagtttggaaattcccagagactggatgaatggttatgaccaaaatgctggcagtgatatggacagcaaaggcaaggctaacaaggacacagatggaaatgaggaacttactgggaactggagtacaagtcacttttgttatgccttaccaaagaacatggcttgcactgtgcctttgccctagggatctgtgtaactttgaacttgagagtgatgatttagggtatctggcagaagaaatttctaagcaggaaaagtgctcaagatgtggtctggctgtttctaacatcctatgctcatatgtgtgagcaaagaaatgacctaaaactggaagttaaatttaaaagagaagccgagcataaatgtttgaaaaatttgcagcctggccacgtgatagaaaaaaaaaaggcctattttcagaagaggaattcaaacagactgcagaaatttgcataaattaaaaagaagccaagtgctattagccaagacaatggggacacggccttgaaggtatttcagagaccttcacagcagcccctctcgaggcctaggagggaagaatggtttcatgggccagagccagggcactgctgccctgtgaagcctcgggacactgctccttgcatcccagcttctccaggttcagccatggctcaaaggggcctgggtacagcttgggctgctgctacagagcatgttggccacaaactttagtggcttccatgtggttttaagcctgtggctacaaagaggacaagaactgaggcctgggagtctccacctagatttcacaggatatatgaaaagtctggatgtacaggcagaagcctgctgcagtggtggagccctcatggagaattccctactagggcagtgtggagggctaatgcagggttaaagccctcacacagagttccaactggggtgctacctagtggagctgtgagaaaagggccattgtcctccagacctcagaatggtagagccactgacagcttgcaccatatatgcctggaaaaaccgaaggcagtcaatgccatcccatgagcgcagctgcaggggctgaaccctgcaaagccacagagacagagctgtccaatgctgtgggagcctacccctcataccagtgtgccctggatgttagacatggagccaaataacaattttttggatctttaaaatttaatgactggccttctgggtttcagacttctatggagcctgtagccccttttttttggtccatatattccttttggaatgggaatattttcccaatccctgtatccccattgtatcttgggagtaactaacttgtttttgattttacaggttcataggtagaaggaactagctttgtctcagatgacacttcagactttggatttctgagttaatggtggaatgagttaagactttggggaacgttgggaaggcatgattgtattttgccatgtgagaaggacatgatatttgggaggggcctggggcggaatgatatggtttagatctgtgtccccacccaaatctcatgctaaattgtaattcccagtgttggaggtggggcctggtgggaggtaattggatcatgattcatcaatggtttagcactacctccttggtgctgttctcatgatagtgaatgagtgctcatgagatctggttgtttaaaagtgtggagcaccccccttctctttctcctgtggccatgtgaagtggtgctccccctttaccttccaccataattctaagtttcctgaggccttcccagacactgagcagatgccagcatcatgtttcctgtatagcctgtggatctgtgagccaattaaactactttataaattatccagtctcgggtatttcttcagatgagtgtgagaatggactactacagatttctaccctgagtctaaatgctatgtctaagcacaggtttctttaatttacacagactgctgttctttgagcttcctgtgtattattttgaaaaacctgtagacattataactttgaataatgtctctcctctatcatcttcatgattgtaacctgacactccattctaacttctcacttcattccacttgtgacttattcactctttcatattctccatctctctgtacttgtgtgctaaatgctgtgtaattttatcttcagtactggtaggccacctagatccaaaaatgtcctgaaggcttagcatccccagggttggccacctccccacatttgtactcatgctttattcctggcctaacaggatttccctttcattgttacaggcttatccattcagataaaagttatctaaaaatatttcatctatcagttttagatgttttattatgggagagtttcagaatctgtaggccatcacattgcaaaaaatagattctctattgcatttttctttccttctttttataagaagggaagaatttatgcacaaactttgttatctaggaagaattcatttggagcaggatgcaggagatattgcagagtgagaacaaggagagaaactggaacaaggggaaccagtaaggaaattattacagtaggtgagataagagaaaaaggccagaacatgaatagaggcatacgatacattaagataaaatggaaggaaagggaaaggcattaacattaactaagcacctacactgcagcactctgagtgttgggctaacgttatacctatacgttctatgtgttccaaacaatcttttcaggtaggtattattgtctctgttttatattttatgcccccattattaactatatttacaattctgaaaggtagagtatgcccccaaggaagctacccatctaaggatttcaaagctactgtacaggacaattaagtaaatattttctaaagatacattaagaaatagaaaatatccaggtgacaattctttgcagtggtcggtctgctactcctgtgaggtgggcactgaaggcaggaagagagatgatgagataagagggaaatataaccaggtactttctctaatctcactcaactataggaccttcaaaggcatccctgctcatgactacagatctcagaacagaggcacagtctctgtgcctgccccctcaggtgctcccagctccacatttctgcagaatagttatctaatattactaataattacagaagtagtaatagcacagcaaatgattgctgaacacatactgttttaggcactgttccaagatttgacctgtataaacaaaagcccgtaagtctatgagggatccacggttataacctccatctcacagatgtggaacctatgaccaccttcctctcacctcctatgaaccggcagcacttgtttctccatagcactgggcgttttcactctggtttccatacagagaaaggccagctaaactagattcgggaggcaatgtcttggataaatctgggatctaggagtgatattaaaattacttaagagctgaggctgggcacggtggctcacgcctgtaatcccagcatataacaagactccactgctacaaaaaaaaaaaacaaaacaaaaaaaaaaaggaagtcaggtgtattagtacattctcacattgctaataaagatgtacctatgactgggtaatttataaagggaagaggtttaactgactcacagttcagcatggctggggatgcctcaggaaatgtacaatcacggcagaaggggaaatgattatgtccttcttcacatagcagcagcaaggagaagtgccgagcaaaaaggggaaaagccccttataaagccatcagatctcaggagaactcactcattatcatgagaacagcatgagagtaatggcccccaacaattaaattacctcccaccaggtgggaactacaattcaggatgagatttgggtggggacacagccaaaccatatcaccaggcatgctgatgcatgcctatattcccagctacttgggaggctgaagtaggaggactgtttcagtccaggaggttgaggctgcagtgagccatgatcgtgccactggattctatcctgggtgacaaagtgagatcctgtctcaaaaaaaaaattatttaagagttgattcaggagctaccttgagctgttgggaaaagcactgttccagtcagattgaagggacatccacagtaaatggtctgtaccagtacacagtctctgagtatcagctctggcttgggggctgcttcctgaccagtatgggtgaaattaagaagtgaatgaaaccaacaagctgctgtgatcgttattctgagtcaaactcacatacacatgaagaccacatttctgcaatagaaaaattggcagttcctccaaagatgggtgatattggagccatcactgaatcttaaatattacaaaccagttattattttctctttattactaatttgaagaaacatatttggaaatataaagtacagtgaataatattttggctttagttattaccactgatttttgtaaaagtgaaatgcttaacggggaatgaaaagacagtatcacccctctttcataaagaggaagatataaaatatttctaaacaataaaatattcattaacgagtaataatggatttatgccagaaaagtttttttttaatccaccaaaaggtataagcttcatgcagaagtttatatttgcatgctatactctccaacttttcttctcaactgaactggaaatggattgtgtttaagattttactgttccaattttctatttcattcaaatggcagagcatttgttcctacatcaaaatcttgtcctgttttttgaccactcatctctctgggtgccctgatcatcttttttttccttttcctcatgtttactatcagaaagtcataatatggatagaaagtcataatatggatagaaagacatagtatgagcattgcctattgttttcatttaacatattaatctttacttcctgtctgttgtcttgaaaatattctcccattgttccatgtaaaatgacaaaaaaaccattttattcccctcagagtagagagagagaattagccatatacacattaatgagaagtaatttatttttcagggcctcaccaagagtcttggcgtgaaggccgacaatgcaaatcctgccaggccaagaaacaggtatgtggggatgaggtagttctaatgcaaaatatcttgaatttcctgaggttaacggagaaagatattcacaatataaagcaatcccaatgatggcattccaaaataaacccagcactttaatgaacttgaaaacaaagatatacttagcagaagttctgtactaatataagtgagacatcatctatactagctgtaaaaagcacaaggcatttttaagactgttctattttctcagtgatagaactaaacaacttaaagtatctttaaaacaaaatccttaaagtatgtagcctaaagcatgaagaaacaggctaccttgataagaagggagttctgaagttctaatcaatgacacagttgaagatacaactcacgcagggaggagtctgctttctgcaattgatgtgcaaagaatttaaataagttcatagatgacagactcacagatgattaagtgaagttaagggtaatcctgtatattaacctctaactttcttttacaaaatatcctcaggcatcacaagatattctattacatcttaattaatagagcagctcaggcacttttagattactgcttgaagcaatcaagtccaagctgagcaaaggaaaatttaccactgggctatgagtcacacagtattccagtattcagcaagtgacagtattaattatccctggtttatagcagcgtggtagcactaaaacagtactattactactatatattcctaatcacttatctttgaaacacttaaggcaatttacacattacaaaaaaaatcacttaatccttatagtctttctcttttataaaaggatgctttgtcaactctattttataaaggaaaaaagtagggcagccttgtaggaactgttaaagcaaactaaatatggccttaggactctatacttctttatttgagtccttgtggatgaactgcaacctaacttaataggtagacaagattgaaaacctaacttaggagtatgcacctgtaacaatacctgagtcttggccaatcccagtggttgtacttcaaccactcatacactgctgagtgttcgaactgtattcaaataaggtacgtgctgagctgtaaccaacccagttgtttctgtacctcactgctgatttctgtatgtcacttccctttgtttgtctataaatttgttctgaccacgaggcatccttggaatctctctgaatctgctgtgattctgggggctgcctgatttcagaatcattcattgctcaattaaactcctttaaatttaattgggctgaagcttttcttttaacagaacctatacctattgcttttcccagaaaattatttccttttcttatataatagcaaccaatgcatattttgatagagaataagaaatgaaaacaaagagagaattggaagaatattctattcaaagtgttccctagtggggtgctgttcattctggatgtggctctattcctataagaggtctcaagacttttaccctaaaatgttctgaaatgccagaaagtatcataaactgggagctaggcacttagattttattcacaccatgatgcccactatttctccgcttttggacaagtaatctaaacatctctggttaaaaatctatacaatgaatctactacgatgtgccataattactttataatgttgttgagttaatctgggtacataagattattaggacacataccctacccctaaataatttacatatacaggcagtaacataaacaatgaaagttaatttaacatgataaactgtataaactaaatggtagcatggcactaacctaagacaatcacagtggggattccaggaggtaaaacaaggaggaggtcattaattctgcttatgaataggatttagaggttagagaacactttaaatgagggtgtaatttaatgtaggattttggaaaaaaaaaaaaaaaaaggtttttcttttaaccttcaccttttgtacagtatgttagcaggaagacatggaatcaaaatgtggatcccaattttggaagtctcaaaacattgcaaatgatcatcatcctttagcaagacagcctaagaacaacagttaaaacacataattttttattttttaagaggacacattttagaaccagagaacctggtttgagatactggcttcacctgagtgaccttggacaagtcacttagccagtcctatgctttactttcttcctgtataaaacagtttttctgagacttagatgagttaatatatgcaatcctttggattttttttttaattaaagatactgtctgctaaagaaaatgcatcaaattttcatgctaaaacacaaagaaagactttttttctcacttctgtgaaaataagctgtgaaaataagcaatttaaatctaagttgctggaactttattagagccttaagggaatgtgattaagggacctggatggatcacattaacaggcagctgtaacctaggaagctgtaagctttgcttctctgattgtttgtctgattatagattagcctttttccttatctacactgttttgtaaaatgttgcaaatgactaaaaggcagcagggaagaccccttcttgcttaactgttgatcttcattacagattaatttccctcttacctttctcacacaaagacttgatgatgactatcacattgtctaaggtggaatgttaaatgaactcttttaaattgtgaagtaaatgataacaagctgtaaagaagaaaaacaagctgtacggaaaagaaaaataactaaattattataacccacaaagcagccttacataaaaaaaagttacaatcctactaaatttctttgtttctgcccatatataagcaagaccttaagtttttacttcagagcactggcctcatttctctggagtccatgtttcccagattcttgcttgaataaactctaaaattggattctgatgctttcagttacttcaggttgacatttcattcatgtattcggaattttttttgtaagtcaatgtttgagaacaccgctttaacgttactgatgcatttttttttttcttttgagacggagtcttgctctgttgccagactggagagcagcggcgtgatctcggctcactgcaacctccacctcctgggttcaagccattcccctgcctcagcttccccaatagctgggactacaggcgcccgccacccgcctggataatgttgttgtattttagtagagatgggtttcactatgttggccaggatggtcttgatctcctgacctcgtgatccgcctgcctcggcctcccaaagtgctgggattacaggcatgagccaccgcacacggcctactgatgcatttttaacagaaacacttagcacataccacccttaactgggaagagagctaagtgtgacacatttactccgattaatatatttattgttttcattttgtcccaagtcctgtattgacattggagatatcaaacatgaatgcaaacaataaaagtagacaatagaagagacaaaagctgttggagaactttctacccaaaagatgagccacagagtcgctcagatctaacttaaaaacaagtatctttccccacttggccaggagacggtttcactggcagccattactagacgtgcaggaagaatttacatggcttgggctgaggttggaaaacaggtcagaacacaagagcatgcatcattagctaagggttaccggaaacgtgtgtgggaagcaacaaatcccaaaatgactctcactacatcatttttttcaggaaaaatataaacaccagtgatagagacaggaggcagccaaggacccctcctgcccccaacacctgacgaaatgccgccttcaagcctaaaacagcatgagggatgaaaaaccagactgccggtccggatgaagcccacccttttccccaaatgattctttctgaataacgcccatctgcacattgggaggagggggtggggccttgggaagtttgcactgtttgcaggggggaggagcctggtctctctcgtttctgtgtggtaaggtgggatttaatccctgagatggagagcctgttagcaggactcttatctcactttgctgatgcgtatttcctttttcatttctgcctaataaattccacttgtcacccttctacgtgtctgcgagcctaatctttcctggtcgtgtgacaagaaccccgttttttttcctgcaacgctagagtcacagaattattttttgaatcttaatgaatgatacctcacattctctatggctagaatgttcctctcccagataccatgacttggccccttcacttcagttaggtctctgctcaaatgttatctgtgaaacatagaaaacggcatcactacagttcagggctctaaagcagaatccattctcagggctgcctgcaccactggcaaccttgcaaaacaacccagtaccttgccttgaatctttgaagtgcacctaaccaccacaaccatgatatcctgaaaaacagctgaatttcaccagcgctgcaactcctaaacagcaacaataaatgaactatggacttgtgctaagccggccgcctccacccatgataattccttcaaaacaacttgtgtaatcctttagtttcctttgaaaaaccctcacttggtttggaacacaatttggcttacagccaaatctgtgtctcctgaattataattcctaagggcccaataaatgtcttgtcttactgcattgcggtctggtttgtcatctcttcttagttgacatgcctcatcctggggtttcctctaatcactctctgcaacataggacgtgtatgcttccttcagtatttcctaaccttgactttacttttctttgggtcagttaacagctgtgtaacttatcacaaagtttttattaagcttctccagcattagaataaaaccttgaaggcaagtacgttggtttgttgctgcaaccacagagcagattaaccccttctcccccatcccccccccaaaaaaatcagatgtcctaaactagcatgtagatggcatcattcaacaaatattaccgggaatttttttttttttagtgcttaatcttttaggtaaaacgcaggatgcttaaagagaaaagaggaggtagaataaaactgtggtcgattattccaataagacattgaatatgggaataaggtatcagtaaacacccaggcttaaaaggaacaaataaggcttaatacattactgtgggttttcatgggttaattaaagaatgaacatttgtgacaagtgacttcaaacttctatcaaacaaatgacatttcatatacatatttttttcttttgagacagggtgattacagctcactgcagcctccaattgccaggctcaagcaatcctcccacctcagcttcctgagaagctgggactacaggtgtgcaccatcatgcctggctaattttttttttgttttgttttcatagacacggggtcttgcaatgttgccccggctggtctcgaactgctgggcttaagcgatcctcctgcctcagcctccctaagtgttgaaattacaggtgtgaaccactgcacaggcctcataattctataaagtatatctgactgaaggaatatgctggagaacttgctgtttttaataatcacttcaaaaagttaggcataacaaaaatttcctgaaattcaatgttagatatgaattctaaatttcttttcaaagaatatgtcaatatgttcaattctttgccgtctacttttaaacttaacttcctcgtaaagcaacctttttcgattacctactccaccctgactcattccaattacctactccaccctgactcattctgatcacctgctgcaccctacattccaatcacctgctccaccctaactcattccaattacccccaacctgctctgccctgactcctgccaaagcactcacccagtgactctctttaaattagtcaatcggaattagtttagcctgtgcggtctaaccctagccaataagggaatgacacagcagcaagggccacgggcatcagggataagaaccccttcccctcccttgtccaagtatgcgctcaccattgttccatctgtaagggcgcacccttctatatagaagtaacgtgtcttgctgagaattaaaaagaaaattttatatttgagtgatattttcttttgcagcactgaaactttatatataacatttgataagttcgtttatgtgaaaggtgtgaacattgatcaagaaaatcaagcatactatgatttttttcataatatctagagcagtttctagacctttttacataccttttaagagcagggtgttaaaataaatgtaaggttaaatcatcgcagtctatctgagaagggcaggtaactgctgaatcagacaagtgggcttgtcaagtgacagcaaatcaggtttcctcaacctctgaagcaccccagaagccagggaaggacagagcgaagaccctgctgtgcacgcatttctacaactagcaattcaaataagctattgtaattgtaaaacagcccaaggcccacgggcatctttaaaatgcctccgggcaaaaacagctgaaggtcaataaaaataactcaaagtggctgatgagcagcctccagacagaatctgttctccaaggaatataacagcctcacttgcttttccccaacctaggagctccaaaagtgacttcaagctttgcctactgataggtgttcctggccctcattacagggcgagggctctggcttaccactcacgcgcaggagccagaaaacggtctgctacagactgcacctgaggtgatgctgctccacgatggcctcttagcttttcccaactcagaccacgtttcttccatttatcagatgtccagtgcgttcaagtgctcttcactgaggaaaaccaaaatacccgaccctacaatacatttctttgacatatttttgagatggcctttcagaggccctgcaaacagaagtagctctgcaaagctatcttttgtgggggagatttgcatctgtggagagaatctgtattgatggtggccaggcattctccgaggccttccctcgtctggatctaggaaagattaactcagtgtctgacatctttaagggtctgaaagaaacattcaccatctattctcgctctcatcatgcctaggttttaccacctacttgtgagatttcatttacttaacaggaacacctttgctagccaggcctcatcttcctctcttttcttttctttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccaccacgcccggctcattttttgtatttttagtagagacggggtttcaccgttttagccgggatggtctcgatctcgtgacctcgtgatccgcccgcctcggcctcccaaagtgctgggattacaggcgtgagccaccgcgcccggccatcttcctctcttttcataacctgttttgatccaagcccccattctttctgtaacttcaattataaggtaaaagtttctctactccattgagggtcgtgtaatcaatctatgattttcccctgtgtgcatgttaataaatttgtacaccttttctctcattcacctggctttggtgagttgatttttcagtgaaccttcagagggtgatggggaagtttttttcctggatgacccctacagtatagaaccttctaatcattttactatgtacacacatgcaaaacaaactgagatattatatttgttaattttaaacttttctactggccgggcatggtcgctcatacctgtaatcccaccattttgggaggctgaggtgggtgaatcacctgaggtaaggggttcgagaccaacctgaccaacatggtgaaaccccatctctactaaaaattccaaaattagctggtcgtgatggtgggtgcctataatcccagctactcgggaggctgaggaaggtgaatcgcttgaacttgggaggcgcaggtagcagtgagccgagattgcaccattgcactccagcctgggtgacaagagcgaaactccatctcaaaaacaaacaaacaaaactcttatatttatatatcatacattgtaagcccataataaaattctaagctcccaactgcctgaatgaaccctactcttggtgaaggggattccaaaggaacttgaaaaaccagtttaggacatgacagaaagggggtgttggacatgcctcattatgccctcctccctttggagtttaggcacaactgaccagcactaacactaaaatggagatcccgacactgacaaaacagactcttagtagcactaagataccaatttcaacctgactctaatatagcatcacatgatggatagcaggtcctaagggaaatcaaagtattgtaccccaaaatgcattttctttgacatattttgaaatgatctgcaaagccgtctctagtgggggaaatctgcattctatagagaatctccctcccttgctaaatcttttctggagagtctagtatcttttaaggtccagtaagagacatttgacatctattccctctgaagtctattatttagagacttcatctatataacaagaaccttggcttccaccccaccaccccctcaacttaactcaaatatttatttatgctgactataactcttcagataaagcttaagtctttcaagcaattgacaatcaggaaatctttcaatccgtctatgacctggaagcccctgcttccaggtgtcctgcccttctgggctaaatcaatcaatgcatgccttatatgtgttgatttatgtctttgcctataactttggtctcccaaaaatgtatacagacaggttataacccaaccaccttgggcacatgttctcaggtcatcctgaggctacgtcatgggccatggtcacttgtatctggctcagaataagcctcttcaaatattttacagactttggcttttttttgtcaacaatatcatttttaaaaatgatggcaaatgatgaaattctattgctgtatctatcatattttacttattaaacattttattggccattaaactgtttctaaaatgatgttattttgtaactaaaataacaactggattccttctatgtaccaggcagtgtactacacaccataacaggtattagccgtatttgattgctctcaccttaaggtttttgcattttttttttctaatgggatattcttttcttttctatttttgtaagacggagtgcagtggtgtaatcatggctcactgcagacttaacatcctgggctcaagcaatcctcccaccttagccccctgactagctgggtctaggggcgtatgctaccatgtttggctaactttttattcttttattttgtagagatggggtcttaatatgttgctcaggctgtggtggaatacgcttatccatgacctttgtgtccaaagatatcacggaacttccttttgtaattcagttctcagccgagtaacaaggcatatcctctatctctactcctcctcaccaagagtattactggcatactgcttgagctcaaagtgttttttaaaaaataaatcaatgatctatcttgcttcaaagctcaaattcttaggtctatctagtgtaaacaaataaaaaatcctaagccctccaaccaactgcatggaccccctcttgaccaaaagaaacctaaaaaactgaatgcctgccacgatgggatggaagttcagatgcacctccttatatccacttccttttcaagttcaggcccgactgaccagcattacggttaaaatgcagatcaaaagactgatcaaaacagactctgtgtggcaataagataccagattataaacaagacctaaggccactggggtatgctggctcatgcctgtaatcccagcattttgggaggccgaggcaagtgcatcatctgagataaggagtttgagaccagcctgaccaacaaggtctgacccacctctactaaaaatacaaaattagccgggtgtggtggtgcgtgcctgtaatcccagctacttgggaggctgaggcaggagaacggtttgaacccgggaggcagaggttgtagtgagctgagatcacgccactgcactccagcctgggcaacaagagtgaaacctcatctcaaaaaaaaaaaaaagacctaaggccgtgtggccatgtgaggcaaaggtgaagtcacaccctaaccataaaatttcactaaatggatttttattaacctggtataacgtggcttactccccaacctgactctggtatagcatcacatgacagcagaccctgaaagcaatcacaatattttaccccaaaataaatttctttgaactattttgaaatgaccctccaaagccgtcctttgtgggggaaattaacatctttggagaatcgccattgatgcagccaggccttccctttctaggcctttcccagatgtaggagagattagctaagagcccaacacctcaaaagtctgaaaagagacatttatagtctgtttctctgagggctgccacccatgaggctgcttctacgtgataagggccgtggctcccagagcctccttaactcaagcattcctgtctactcttcaagtcctcagacaacagcttaactctctcaaccaataactcaaccatccctaaaacccacctatgacttgtaagcccccatttcaagatgctcaccttttggggctgaaccaatggatacctttcatgtactgatttatgtctttgcctgtaactcatctccataaaatgtataaaaccaaactgtaacctgactgtctcgggactacttactgaagggttcttgggtttgtgttttttttttttttttttccccaggctgtggtcactcacattggctcagaataaacctctttaagatattttatggagtttggagggccaggcatggtggcttacacctgtaatcccagcactttgggaggccaagcctggtggatcacttgagcccagtagtttgaggccagcctgggcaacatggtgcaaccctatctctataaaaaataaaaaattagtggggtgtgacagcacattcctgtggtcccagctattcaataggctgaggtaggggggactgcttgagcctgggaggcagaggttgcagtgagcccagatcacaccactgcactatggcctgggtgagtgagcaaggacctgtctcaacaaaagaaaaaaagagaaaacattttgcagagtttgatatttccattaacattagtgataacatcttttgcatatacattcttatccccatgattaattcctttaggaaactagtacggtatttttaatttcaaattttcatcagattattaaagaatttgacacactgcattaaattaccacaacagggatggaagaattattttcttctttctcctaaatgttaattaaaccgaaatcataaacagaacgagtcagcagtgaaaatagaataacctctaaaaatcacatgcacagtgaaaactgaacattcctctttcagaaaaatacttcagagattctgaacacagattttttggtgctataagattggcagtttatattccattgttcctagtcaagagtattgcttccagccaggcacggtggctcacgcctgcaatcccagcacttcgggaggctgagaagggcagattacctgaggtcaggaatttgagaccagcctggccaacacagcaaaaccgcttctctactaaaaacacaaaaattagcccggcatggtggcacacacctgtagtccctgttactcaggaggccacagtaggagaattgcttgaaccagggagacagaggttgcagtgagctgacatcgtgccactgcactccagcctgggcaacagagtgagacaccgtctcagaaaaaagactattgctcctgatgagaatgatggcggaggacctctttcaaccgactttattgccagaaagcatggattttaaagacatgagccatcattacggaatgtaaaaacctagaacttaatcttttagtctaaattttgaattgtgaatggggtatttcctatctaaaacagccaatattccattaaaactagagagtcacgtgacaaggtgctcctgcgcgttcacatggctgccctcacagtgctgttgtttggccttgtattaacatcttaaactgctccgttacacaccctgctgccagagaacagccaagtgccaagggaagggaaaaccttagcctagttttaaaataattgcttggctttgcctgtacttaaagagtcttgctctaacaggaggacacaactgtcttttgggaaaaaaaattccacttttattatctcttaattatagtgtcgctgttcccaatgttacacgatagcaaagaattctgcctgcattaccattataaactattttcagtatggatgactcagaataaattctactttcttaaatttgacatgtgggactaaattttctaaacttttgatgacaggcaggtgtgtaaatccctctaaagtgagtgaacctctccaaccttgtcaaggtgctccacaccactccttgtatccacagtatttacaatgagattgaaaagctgaaccacacatagttctcacctccttaaaaagcgatgaatattttaatatttcaaattcagaactaatctcaggactgtacaatgactaaagaatctataaaagaatgtgattaaaatattttaaaattattaaagtgatatgtccacacaattagcctcctttgattcatttcttcccacctcctctgttcccattttacaaaaaaaccttttgaaacaaattacttctccgagtcgttaagtgacattatatccctaaacaatgtgcttctaccactgtgtcataataggctgtaaacacactctcagttttgtgctgtgctagatgagaatttaacaaacttaactatgccattccatcttcccaatatacttacatagcttttatttgtatctgtattgattacctctgtagttttatggagcataacattattattattttagtgaaaaattttttccccagctttagtaaggtgttattgaccaataaaaattgtacataagtgtacaatttgatgtttttacatatgaatggtgaaataattaccacaaggaagctaactgacatacttttcacctcacatagttgccactttcttatgtattaatttgacaaataatgactgacattatttcttctttctccagtacaggcagcatcttctgacttcctctctgtaagaggagcttaacggatctctctccctgctccctcttagttctatccagttttacctcccaccttctatcatctgtactcttacaggttcaagttgcacaatatttatattttaatgtgtaccacaattaaatctttcacatatctaaatgtgagtaaccaaaattctattactatggtaagattttaaattattaattatgctataatgatggcgatcacaaagtcattttttcttttcaattttcattcaaaaaatctttttgtagagacagctataaccatatggtccaggctggtcttgaactcctagattcaaacggtcctcctgccttggccttccaaaatgctgggattacaggcgtgagccactgtgtctggtcaccgttttctgtcgctacggatttttgtttactgagttttctaattgtaattttcctgtgcagattttaagaaaaacatccttatatgtttctaaattttccatgcaatcagatgttctattgagttttaaaaattttatttataggccaggagcagtggcttatgcctgtaatcccagcgctctgggaagccaaggcaggaggactgcttgaggccaagagttcaagaccagtctgggcaatatagtcagcccccgtctccccaaaaaaaaaaaaaaaaaaaaaagaaaaaggaaaaaaaaaaaattagctgggcatggtggtatatgcctgtagtcccagctatctgggtggctgaggtgggaagactacctgagcccagaagtctgaggctgcagtgagctacaattgcatgtaccactgtactccagcctgggttactgagcgagactccatctcagaaaaaaaaaaaaaaaattgtaaaacatataagacttcaaaaggttatcaagagtaataaagtaggtatacatgtactaccgccaaatgtaaaaaatatatattatcaatatagtgaaaccactgggtacttgtcagtgactgcctgttattctcctttccagaagtaacaaccattctatgtttaataatttcaatatatgaatgtattcttactaaaaatagtattgttttgcatgctttcaaatgttatcttacgtgcagattcttctgcaagccgctttttttcattcaacattaccactggtgagattcctccatgttgatacgtggaactctagctccttccttttcaattatatggatatacaaaatccattcaatctcttattaatggacatttaagtttttaaattttgagctattataatgttgctataaacatgacttctgtaacactaagagtttttataggtgtatacacccttatgactaattaactgagatataagaataaacatttccaactttattattgccaactgctttctgaagtacaaatgataccactaatacttttgcagggtagaagagggcccattgctccaaatccttaccaacacttggtattcttttaatttttgtcaaggtaacatgtgaaatgacatttcactatatgtttaatgaatatccttgaatatcaataaggttgaatatgtcttcatatatgtattgatcatctcagtttcattttctgagcatggcctcttcaagtttttgcccatttttctactgagttgtattttttataagtaatttaaaatttctcgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacatatgtaactaacctgcacattgtgcacatgtaccctaaaacttaaagtattaaaaaaaaaagaataaaagaaaaaataatgaaaaaaaaaatttctttataaatattaccatggatcctaatcctttattggtaatatgctacaagtatcttaatctgtgaattatctttcatttttaagtacaattttaatataaagtctttacttttagtgtaattatacatatcaatttttttttactgtttttgtaaatatgtatgtatatacgtatgcctgtttatatgtagagatgatgtcttgctatgttgcccaggctggtcttgaattcctgggctcaagtgatcctcctgtcttggattcccaaagtattgggattacaggtgtgagccactgtacccagctgcttttataaatcttaagaattcactttctacccaaaagtcatgaagttactgtcccacatgttcttctaaaaatcttagaaccttgtttctcaaatttttatctttaatctacgtgaaactggtttttgtgttagaactgaggtggggaatacacacacacacacacacacacacacacacacttctcaacataaattacggaagaatttttgcttctaattatctgacttactttctatatcatccatcaaatttttataaacactggagactgctgcttctgggttctcttttccaacccatcatcctatctgtatgtcttattatcttggaaaatgtcaacatggccctactgtacttctcccccttaatgtatgaggaagtttggtataaggctacagggagctgtgaaaactatggtcaaccagaaaatgcctacatccaggcaattcagtgtttaaacagcactgtgttggccaagtaaaagaaatgttcaggcttcactgtccctagcttgagacctccagttatctaaatacatgctacacagtgacagactgtcccaactacacaaaaaatgcagaatttaaacatttcataagcatattttctcatcggaattgcttttaacaatatgctactattagtttggtataatcagatttttgttccaccagatacactgctattctatactacatccttggttaagatgcttaggatcagtgtcttcatgtataaaatgaggacaataataatatctgctttataggaccaagattaaatgtattaatgcatgaaatgcttaggataaagctctaatatttagcaatcatttaattatcactattgttattgtgtagatcatttatattttgggtatgttgtttccagtttctttcttgatttccacaagtatgttacatcatattgagaaaactaagagcttatactgaattttgttttttattgtatctgacaaaacccaggagatgcgttttgttttccaaatttgacttttcaaagctttcccttaatgtcagatttaataggtctttgtaaaaatacatacttctaagataggtacaacaatttgtctcctggaggcagaatttctgaactgagcataactttaaaaggcaaaaaatgaagaaaacctccaaggtttaaaaatatggatgcagtctgacaaactgaatgtttaaagttaattaaaaaaaaaagacaccaaatcttgagtgaaataaatggtccatttgagacaagtgtatcagcatttaaaacaaaataacctttccatgcagctttgattcaaattttcacttataaaacactttttgtaatatttgtcatcagagcacctggccaggtttaaatttacatacaaatgtaatataggtctacctatagtgaccatgcttaatcaaagtaagtatttagaaaataagtatctactttttgtgtccaaaaaacagcattcaggattctcagaattatttggagctcctattccaggaaagctccactgttgttttcatttttttctgtgtagtgtaaataaaaagtgatgtgttttatagcaggttgtgtaagtccttactataaaacatttctctaatttgtttatagtgaccatctctcaaaagaagaaggcaaaaacattcagaaacaattaaggcattctggtagatttccaagaaggagcagcagccaaatagttagataaacctgttcaaccagacatgattgaaaatccaacaaatgaggttggtgggggagacaggattagacgggaaggaaacgaaagcttttctacatctccaaatatataactaaactgtttgcttttacttgaatgcttagaattccttattaatttcatagttcagtaaatattaggtcttaaagcgggaagcaactggaaagacgtttcttaacaaaagggatcatgaatcagcttagttctgcttatgcccaagaaacagtaactgctatagaaactgccctactataataacttaaaaagtctatgtaagtatataaaacaaaactttttagacatttcaaaacagaaaacattggattataattctgaagagaaagaaacaaatgagttaagactggcttactgcttagagaaagagtctcggttccaacagtggaagagggtacctaaacagagcctgtgagtcatgctgagttgaggaggtaagaaaggagtttagtgatgcggagataagaaaggagtttagtgatgctgagagggctagaatttgtagagctgcgtaaaacagaggggagagttacaaaaacagatggttctgaagacctgcagaggatactctgctcttggctgtagcatcgatcttagcactagtgaaaggaaataattcaaggcatgggaaaaataaagtagtgggatggacaatttcaagggctcacacagggctaagaagaatttatgttttcatcagctagagtggatagactgtgtaatacatgccatattggaaagaggctgaagaagaacaagaatgccttattaatggaaatatttaaataagtcccagaataaagactgctctggatccaccagaacaaagggtaaaggcaagcgtctaaagaattcagttaatctgcaagttacttacccgcacaccaggagaaaatccagtgttttttttagatgaatacaactaaaagtagcacctgaaaaatggaaaattcacaatgtctggcactcaaaaattacaaggaatgcaaagaaaaaggaaaaaaaaaccaactatgactaaagccagcagaaaaaaaataatgcaacagttccagaaacgacagaaaggaaggttatcaaagagaagaaccttaaaaaagcaattataaacagaataaatatattcaaggacatgaagaaaaacatcaacctgataaggagagaaacggaagatataaaatagacccaagttgaacttcaaagataaacatgctgattatgaaatgaaaaatgaagtaaatgaagaataaaaactatcaaataaagtactgaaatgacaaagagttaaaaatattggaaagagcttcaggaaacccttgggatagcactgagtatcatatagcaaacaagtcccataacaggagtggaggctttaagaaataatggctgaaaaaaacatgaacctatgaatccaagaaccccaataaacaccaaataaggaaaacataaagaaaatcacactaaggcatcacataataaaattgatgaaaaccagagatagaaaaatcttgaaagcattcatagtagcagaaaaagccatcttgggtgcagaggaacaaagataagaatgataggagactttttttgtctgaaatcctgcagggcagggaaaaatgaaacatcatctttaagtattgaaaggaaaaacaacctgccaaaggattctatacccagtgaatatacattcctaaaattaaggtgaaaataaagatattttcacactgataaaacatgagaaaaattcctgacagcagttatgtgggggtaaaagtaaaaaaaaggtttctgcttaaagcaaaaatattaacaatgaactactttaagttttagaacatagaattaaaatataggacaacatcacaaaggctaggaagagataaggggaattaacttgctataagggtctcaaaccataaatgaagcagtacaatttgaaggtgaactgtgacaaattaaagatgtacactgtaaaccttgcagcaaacactaaaataattaaagaagtacagcaaacaggccaatagtgacaaaaaacagaaccacacacaaaaaataatcctacacaagaaaggaaaagaccagacggaataaataagaaaccaacagtaagacggcagatttaaagtcaactatactaataactactataaatgtaaatggtataggcactctaattaaaagacagatactgtgatttacaataaaaagcgagacccaccaatattccatataatagaaagcaattttaaagacacaaccataaattaacaataaaaagttagaaacaaaatttgtatagcatgcaaaaactatgaaggaaactaaagtggctgtattaatattagacaaagtagactccaaaataaggaatataaccaggggtgtcggacgtcatttcatgacaaaggggtcaaatcatcaggaagacataatatatataggtataagggatgcaaaatgatatagaaactttagaaatttcttaaaaagttaaagatatatttagcatatggtgaagcaatcttactcttttactcctaggtaacttctgaaaagaaatgaaaacatatgtacgtgcaaaaacttatatgtgaatgtccataggggctttatttataacagttcaaaactggaaacaaccagaatgctcagctggtgaatcaataaactgtgggatatccaaataatggaatacttattaagcaataagaagagagaaactattaattcacacaacacctaacaatatacatgaatctgcaaagaataacactaagtgaatgaagccaaacacaaagcagtcccatgattccatttattgcaattttagaaaaggcaaaagtatagggcccaaagacagataatcatctgtcataaccgtcataggatgggagtaatacgagaagcaattactgccaaaagtacagttaaacttttctgggtaatggaaatgttatttattttaattgtgttgatgattatataactatacatttttcaaaactcaaactatatactctaaattggtgaattttagtttttgtaaattattagaaaccatgcacattctggattgtaaggctgaattatctgctaacattaatgtgatttggaaaccttgggaaattgaaatggggatatccaggaagagcctgaggaattaaaggcagctgaaacttccacgctcctcctgatagccccatggaaaaacagaggttaaaagtcctccagtgataaagcaactgacaggaaagaagcctggagatgggcacgtcttaacccatccatatattttccctttggttctgaggcaggaacagagatagaaacaagcagaggcaggttcctttggaaagcaggacgaacttcctaacttgctacaaagacaaaagccccatgacacttaaaactgccttgaccaatcagaaattctcaagacagttaactaaggctttaaaggagatacaatggcagaaaaacttctagcctggtacaaggtgtctgtgatgtctcaactgctaagcaatcctcaggttctgtatctatattcatatgtattaggccgctgagggagaagagcttctacccggagaatcctccaatagaggaggtttcctgggccactgggtccaggaaaacagtggacaaggaaaattttatcagtagaatctgggactttggaataaactaaccaattaagtcaatccattgctaggaaatgaatcaatgaaaagatgctcacatgggttaactgtgctatatacctgtctagcaggaagtagtaaatactccgaataagtgatagctgttatacttcccctttttgacttttcttgaattgaaattattcttttttttttctctagtactttatgtgaggtatgtcagatacagtcaaccctccatatctgtgggttctgcaactgtgtattcaaccaacggtggatggaaaatattccctctaaaattctgtctgcattgaatatgtacagacttttttccttgtcattattccccaaagaatacaacataacaactatttacacagtattagatattataagtaatccagagacagtttaaagtatatgggaggatatgcatcagttatatgcagatactatgccattttatatcagggacttgagtgtccttggattttggtacctgtcagaggccctggaatcaatcccctacagatattaagggacaacggtattttcgtatttttcacttagcctatagatttcagtgccatccatacctgactgaggggaatgaacactatcaacaaatcttagccttggagacagaagctgcagttgggcaggcatgttacagagagatggtatatttgtggttgtaaaaggaaaactgcaatgtttggcaaaagtattattcaatgtatgaagaagggtgtgtctgcacactggaaagaaacaaatgggtatctattgctttgtgtgccaagaactcccattctctgagaccagtatctcattcttactgtcattgcaagcaagtgggggctgtcaatcacaatattccatcctctcagtgatacaagtcagaatcctgtcctagaacagactaaatgagaagttagggaagaagaacaatcctctttggtgtcaaaattaaacacgtgatctatagcactgctaataaccatgtataaaggacctcattccaaagaataatgctgacacaaaaaatcatgcagagatagaaatggagagtacgtcctggtgacaatccatcttcaggtgtgcccttttgctaagatggattcacttgctgtcacaactatatgagtgagttctgatacaatgttgtgggataaaattaagtagtctagtaatctagtatataaggtgcacagaagatatggtggatgcactcttaaagaacttgggaacattaagaaatttgttcagcattgctaagtccatgtcaaagccaccccactgcaatgtttctctccatgtaagctaatagaatatgctaacacattaagaaaaaggatccagctacagatagaaacagtggtactatccatctcttcaccccaaagataattctgagcaaacatgtcaccttatcttactctgttcaagtatatcaaattgctatttcactctgcaaagattattctaactatataagcatgctctattcttctcaaactccaaacaccatcattgatcaagataatcatgcctcacacttcacagaaaaatcagaagccatccaattaggctccttcaatttcccaaaactaattatactatgctctcctacatctcacctgtccaccttctcaaaggcgagtcattccacatatgtactggatatgaattccctccctccatcctttgtctctgggaccttacaccattaatttttctatgcgttgcaaattcaacctttccctcaaccaccagaaatgtaaacttcatgaagacagaaaccttgtccctcctgctcaaccctgtatttctggtggctggcacagcaggtagtcagtattatttgttgaagccatgactaaataaatgaatggatagagaatgaataaattgaaaggagttctccctttctaaagttctataattctgcttagagaagagcaggtgccacattggatttttaatttagggttagaggctttatccaatttcaagaatgtgtctatagataaacataattttttcatccttgactttcagataaattccctttaaattttgagcataaagataaaataaatgaaatagaaaatgacaacgcatgatacttactcttctttccatccatatctgcatgaattttccgagccaagaatccacttttgtacacagcagcatttggatcatgaggaatgtccaaaaatgggttagtagtacttccaatacgactgatggtctttggatgtgttccgttagctttctcctcagtactttctgagggagacttttttttctcttcatcatctctaaaagggagaaagcacaaagactgagtcaagcacctatcataatattcaaagaaaaaggtaagttattgtaaaaaactacattgtattccaatggtgtatcactttttataaccaccaccatgataatgacagacaccatttgttaaatgtattctgtgtgccaggtgttaatgatcatggcaatatcttataagactgatattaatatcctctattacagataaggaaatagactcagtgagtttaaatgtacaaggccacagatttagtgatgaacagataatgaagatatgatcataaaatccctaaagtcattggtcttttcaccgtttacaatgctttcatgtttgtcttctttcaaacaagtgggagtttattggcaggaattatgattttgacttacgtatttctacagggtctagcatagaactaggtgtacagaaaacagcaaaagtgttagagtcagtccaatggacaatagtaaacaatatcccccaaataaccaggctagtccctaatattaaaaccccaggcaaagctactatggattagaatggggatgccaggcacagtgctttggcatgtgacagctgctactttctcaaccgccataaaaatagtccccaacatctattgttcccatctttatgtccatgtgtacccaatgtttagcttccacttttaagtgaaaatgtgtagtatttggttttctgttcctgtattaattcgcttagaataatggccttcagctgcatccatgccgctgcaaaggacatgatttcaacctttttctatggttgcatagtattccacggtgtgtatgtaccatattttctctatccagttcaccattgaagggcatctaggttaattccatgattttgctactgtgaatagggctgcaataaacctatgagtgcatgtgtctttttggtggaatgatttgttttcctttaggtatataaccagtaacaggattgctgatttgaatggtagttcttttttatgtactctaacaaagtacttaaaaactgctttccacagtagctgaactaacttacattcccaccaatgatgtataagtgttcccttttctctgcagccccactggcatctgttaatttttttgcctttttaataacagccattctgactggtgtcagatggtatctcattgtggttttgatttgcatttctctgatgattagtgacgccgagtattttttcatgtttgttggccatttgtatatcttcttttgagaacagtctgctcatgtcctttgcccacttttttagtaaggttatttagttttttgcttgttgaattgtttaggttccttatagaagctggatattagccagattaacagtttgcaaataaccacaatatattttaaatatatcacaaaaccagaagtgtttgataatgacggtaatcagagaaaaacagccttttttttctcttttggtattttatcagtaattgtgagataagtgaaaacaaaactggactcttagaagaaatggatattttacttttattttgaaagaattttagatttgtgaaggacaggattcccctatgcccagcttctcctaatattaacatcttatatattaataactatcgtaaaaaatttcaaaactaaaaaattaacgtaagtttaatacaatgaattaaactcggcttcatttggatttcactagtttaccatttttttctattctaggatcctatccatgatcccacagtgcattctgttgtcatgtctctttagcgtcttccagtctgtaacagttcctcagtctctccctgtcctttatgaccttgacactttgaacagtattggtcagttatcttgtagaatatcctcagtttaggtttttctgatgttttctcatgactggatagacgttatgcattttttggggaaagattccatataggtgatgcatctttctcagtgctttaggtccaggggatacaagttttattacttgttagaattaaccatgatcacttggttaaggcagtgtcccacaggttcctctacagtaaagttactatttaactttgtaagtgtttttggggagatatcttgtaactatgcaaatattgtgattctcctttacccactaactttatcttgtaacaattattattacggtgttttaaaggttccctcatttattctacattcattaattgaaattcttctgtaagtatggacacatggatatttgttttattctttaggttataatcaaatactattgttatttaatttgttgcttaaatttttgcagctttggccattgggagttataataaggtgtgctcctatgtcctgtgaacatgcctcatcttctaaaggacttctttactttcaggtaccacagaacgccaagctcatcttaaattttccttgtcctggccctgaaatcaaccacttctccaaggagccttggttcttcttactggagaacagtatttagaaatcaaatctcggggctaggtgtgctcattgctttggggtcctcccaatagacaaagctagggagatacagttatgtatcatataacaatgtgtggtcaacgatggacagcatacaatatacaaccattgtcttgtaaaattataatgcagccaaaaaaaatcccattgtctaacacttaccatactatgcttttcagtgttagagtatcctacttctatttattaaaaaaaaagttaactgtaaaacagcctcaggcaggtctttcagtaggtgttccaaaagaaggctttgcactatttacaacaccaaagacttggaaccaacccaaatgcccaccaatgatagactggataaagaaaatgtggcacatatacactatggaatactatggagtcataaaaaagaatgaattcatgtcctttgcagggacatggatgaagctggaaaccatcattctcagcaaactaacacacgaatagaaaaccaaacaccacatgttctcactcataagtgaaagttgaacaatgagaacatttggacacaaggaggggaacatcatacactggggcctgttgggggtggggtggagggcaaggggagggaggagagcattaggaaaaacacctaatgcacgtggggcttaaaacctagataatggtttgataggtgcagcaaaccactgtggcacatgtatacctatgtaacaaacctgcaggttctgcacatgtatcccagaacttaaagtaaaataaaataaaaaaggctttgttatcataggagatgacagcttcatgcacgcccctgaagaccttccagtgggacaatacatgaggcgaaagacagtgatattgatgatcctgacccttgtgtggccctaagccagcgtgtgtatttgtgttctaattatttttattatttaaactcttaggctataaagtcccatgtgttctaatttttaacaatttttttaacaaaaaagtttttaaaagtaaaaaaggcaaaatttcaaaaataggaaaacacttataaaataaggatataatgtttttgtacagctgtataatgtgttttaagctgttattaccaaaaagttaaaaagctaaaataacgagtttatgaagtaaaaaagttacagtatgctgatgttaatttataattgaagaaaaggtttttaaaaagaaatttcctgtagcctaagtgtacagtgtttagaaagtctacagtactgtgtagtaatgtcgtaggctttcaaatccattcaacactcactcagtcactgacccacccagagcaacttccagttctgcaaactccattcatggtaaagtgccctaaacaggaataccatttacaaaaaatctttaatgccatatttgttgctgttcattttttgattactgtttgttttctgtttagatatacaaataccattgtgttactactgcctatagtatttggcacagtaacgagctatacaggattatagcctaggagcaataggctataccatatagtacacatgatgttcacacagtgatgaattcgcctgatgacacagttctcagaacatattacagttatgaagtgatgtatgactgtatatataagtacactcacgtgtatacacacatctatatttgtgtatccatccaaccatcccaattaatttatattaacaccaccaaacctaagccagcacattccagccttctcccacttgcttatctgtacatcttcaatagtgagaaaactggctttcacgatctgcaatatattgatttgttcaatctcagtaaacatataaaagagttccaaaattgctagcctacacccatgtgaggaacaaatttatgtactagagtacagtgtttgtgtacatttcttttgtcttacactgttttccaaagttatgggtgagctctttttttctcactctcatcacaatggttaggtgaaaaacacattccttcgttatagtctgaattctactttgtgtttatcatatcctgactgattttcttaaaaaataagcatttttgaaaatgcatttcttgtgatgttcagatttaaggatttagataatgtatagagtcatgtacccactacaatgccaaatggaacagtcttatcaccccccaaattccctcacactgttatttggccaactcctctctcccatcgattcctggcaactgacttccatccctatagttctgccttttccagaatggcatataaaatggtttcttgcatttggcaaaatgcatttaagattcatccatattgtaatgtgaatcgatagtttgttccctaccattgtaaagtaccatttcattttatggtcgtgccagtttgtttatctattcatctaccgaaagatactgagttgtttctagtttctatattttatttttacaatgaaaaactatttgtatctacaaccaataccataataaaaatataaaaatacagtactgccagtctctcatagatcagaatcaatctggaagaaagatttctgtccttcaaattgattattctattatcatcattaagattcagtactgggcccagcatggtggctcatgcctgtaatcccagcacattgggaggccgaggcaggtagatcacaaggtcaggagttcaagaccagtctggccaaaatggtaaaaccccatctctactaaaaatacaaatattagcccactgcagtggcaggtgcctgtaatcccagctacttgggaggctgaagcagagaactgcttgaacctggcaagtggaggttgcagtgagctaagatcacgccactgcactccagcctgggcgacagagcgagattccatctcaaaaaaaaaaaaaaaaaaaagattcagtactgttacagcccacagctaacatcatactcaacagtcaaaggtggaatgtttttcctctaagaccatgaacaagacaagaatgcccactctcaccacttttgttcaacacagttttgggagttttaggctgagcaattaggcaagaaaaaaaaaaaaggaagtgactgtctctgatgctgacataatcttatatatagaaaaaccgtaaaaactacccctccctgacaactgttagaactgctaaagtcagtaaagttttagattaaaaaaccaacacacaaaaaatgagtagcatttttgtacactaactactcaaagaattaagaaaacaatcccacttccaaaagcattaaaaacaaacaaacaaaaaaaaacaagtaggaataaatttaagcaaggaggtgaagatctgtgtactgaaaaccgtaaaacattgaaaaattcacaaatcaatggagaaaaaaatcccatgttaatgaactggaagaattaatattgttaaaatatacctagtaaccaaattccaatgtcattttttatagggatagaaaaaatactaaaatttgtaggaaactagaaactactccaaacagccaaagcaatcttcagcaaaaaatcaaagctggaggcatagttttttgactgtaaaatataaagttactgtaatcaaaacagcatgatactggtataaaaacagaaagcccagaaaaaaatcccaagtagctaaggtcaactggatttctggaaaaggtttcaagaatatataatgggggaaactacagaatcaggtgccatggcattgaccactgcccttccgtggcttgtgccagtctgaaatccaaactatgacaccatcccctcttcgatccctactttaggcaaaatagaaaccagtcacatgggcagcctacagacaggccagaatattgttatcaagtcccactctcttccttgcatcccaagagagggagtaagtaattgggctgcttcctaaggactatgctataccatgctgtggagggagtcgggtaagggcaaataacattgctttgaagttttctactgttttaaatgtggcttttttttttaattgagagtttgcctggttgctgtacatctttggttttcagagcacatgtgaagttctttcagatggtcttacttgcttatggaatgtttccctaagaaaacaagggcctggagcttcctagtccaccattgtgccccatttcccttttattgctctagtcttagtgttatgggtttaattcagtccccacaagagaaattaaagtactaacttccagcatttaggaatatgaccttgtttggaaataagatgattaaagagtgggccctaatctaacaatattgatgtccttattaaagaaagaaatctggacacagacacacacatacagaaggaagaccctgaagctaccacaggctaggagagaggcatggaggagactcccggtcatggccttcaggaggaaacaaccctattttcaccttgatctcagtgatcaagaaccatgagacaataaatctgggtttttaaagcccatttgtggcattttgttatggcagccaaaggaaatggatatacttagatgctacctcaccacagcttcagattaattttatcacttttgcagatgggagtgtgccctagagaagaaaaactgggacaactgtgtctcagtacttgctcttccataaacttcactgtgatcctgaataagctgcagcatctctctagatctcagcctcctcatatgtaaaatttgaagcttgctctaagtcagtaaatacaagccatgcaaagcctgtccagggagtgggagcccaggatgagtagaaaggtctctggaatccccattcactttcaaaaaacagctcttggaagcagactgtggtcgtgaatccattctagttctagtatttcatgattgtagaactccgttgatatagaccaatacaaaaccacaacaaaagatcaggatattccatgtgtctccacagcattgaccctaaatggaaacctatgctgctaagtgtaggctaaatactgcaaaaagcctctcccctaagatatggagcaggtaccccaagttttaccatgcaaaccctccacaacaacaaaactgcatacattgttaagtgatacggtttggctgtgtccccacccaaatttcatcttgaattgtagttcctgtaatccccatgtgtcatgggagggaccagtgggaggtaactgaatcatgggagcagtttcccccaggctactcgtgtgatattaagttctcgtgagatctgatggttttataaggcccttcaccttcacttggctctcattcttctccttcctgccaccatgtgaagaaggacgtgtttccttccccttctgccataactgtaagtttcctgaggccttcccacctctgcggaactgtgagtcaattaaacctctttcctttataaattacccagtcttgggcagttctttatagcagcatgagaatggactaatacatcagtaagactggagggaagatggcagaagaaagccctgttctttcctctctatttaggaagcagaactaattagccccactgacctacctttgagtgtctcaaaagagaaactcgacacttgcccccactacttctttggcatcaggtaaaccgctctatcccttttgccttactatgtggcaaacccagtggggcagagctcacctctgctcctttagttctgatttcacagcctgtaatatggttaggctggggagctcagcaggcttggtggccactcaggtcccagtcacattctccagtataactttctgcaggtgccttgcactctgcattacacagcagaggcttgacttcatttcactcagctctctgctctgtgtatacactcctctagccagaacattacagaagggtaggggttataaatcaggtcccaaagtccaccttgtactggcaatcattaccatgatccctgtaatttaatttcctcaccttacaaccagcctagaagctagatgttaccaagtccctgctctcctccaggaagcaatgcttgggaactggtatccctgggcatcagggccagctgagtagtgatgggaaggagctctaagttgccaggcagtgtgtgctaggcagtcctgatatcatgatgattaagacccctcgaggggttcatcatccagtaggggaaacagatacacaaaatattggctaaaacattttttataaaatactatatgtctccacagagctgtgtacaaagcagtacaggatcagagaggagggaagagtctgtatcaaacatgctaaattataatgcaagaaatccttgttgggtgatggaaatggggtgataaactacggtggttgttacacaagtgtgcaaagttacaaacattggtgtagcataaaattggtacacttaagtgggtgaattttatggcataaaaattacacctcaataaagcagtttaaaaaataaaggtggtggttgaatgcaggggcagaacactaaggtggctcacatctcaatactgtgatcagatgattgcaggaaaataaagcgaagaatgaacttataaaaaatgtgctgagttatcatggggtttctattataccacatcacattataccacgaggcaggatgagtctaaaatggatctttgtcacttaccaaaaataaaaaagaaagcatgtagttaaattttaaaattctgctgaaaatatgaattgcattctattctctaaaaataccttattttgacacaggaatcctaaaagtaaaaaagagactatgctttattaaaaatgttaggcttcatcactagccttttaataccaagaaaaatgctgccagatatgagaaagatgtaggctagtaacttggctttctaaataaaggatctgaccatatgtacaatgactgtagtatgctttccaaaccaagacaaacttaaccaatggttaaaaaagtttctgaaaatacactggggtcaagccacatgttaggtattcccaaaagatctattggaaaatttttaaggggcaactaaaaataacttccttgagtattcttgatctggctaaattttctcacctttaaaaaatatacatatatgtataaattataatgtacgagtacataaatgctcaatgaaacaactactgtctaaaatgctcctcatatacacattaaaaatcattcagaaactatatttattatatatcatcttgtatcattcctcatcaaacatcaagcacttagcaattgatatagaggatataagattctctatccttagcatactaagaaaaatgctttctttacatcccagcctccataattctttgctcctcagtgattctaaaaatgctttaggacaagtaggctactaacataatcacattccatctgctcaccaacctgtctgctctgaatattctgaagataatgtgaaatgaagataacaatatttgtaaagtacataactttcatcatatttagaaatatttaagcttttcacaataaaacccttaaaatttctaagtatccatctcaatctcattatcaagagaaatgccacttagacatgaagcaaacaatgtattgtcattttttaaaaaaatttggccttttaaagctaagaactgggtggcaaatctttccagtttcctatacacctgagttcagctgagaaaacaagtacttaaatcttaagtgtgagctcagattaagtatgagatatgctttaggttcttgataaaattacatttcacagagccatatgagagagctgtcctagtccattttgtgttgctaaaacagaattccactggctgaggagtttatcacgaatggtgacttatttcttacagttctggagactgggaagtccaaagtcaagggtcctgaatctgatgagggactcccttgctacatcatcccattgtggaaggtgcaagggcaagaaagtgtgagagaggaagagggctgtgaacttggttttataagaaacccactcctgcagtaacaaccttaatccactcatagccctcatgacctaagcacctcttatgaagccttgcctaatggttgggggacatattcaaaccatagtattctgtctgtggcctctgaaatacattcatttcatcacagtgaccccagttttaactctttctagcaccaactcagaagtccgaagtccaaactctgacctaaatcagatacaggtcaatttgaggcatgattcatccttaggcaaatttcccaccagctgtgggcctgtgaaatcaaacaagttatctacttcaaatactatggtgagacagacatagatgctcccattccaaaagggagaaataggcaagaaaaaagaatgaacaaaacccaactccaaaaccaaatagggaaaacaacattaagacttaaagctggagaatagtttcctttgatgtcccaaatcctgaaaacactggaattggggttgggcccccaaggcctcaggcagccccaatcctatgacttcactgggcttagacgacccagcagctgtcatggaatatcccacatcttttgaaatctaggtaaagaaagccatgcctctacagctcttacattctgtgtgcctgcagaattagcaccacatggatgctgctaaggtttatggcttgtatttcctagaacagtgggctaagctgtagctaggccggcttacaccacggctggggtagccaaggaatgctgtgccagaatgtggggagcagagaactgagggggctctggtggagagcaccctgggcccatcccttgaaaccattctgccctcctacacctctgggactgtgatggaatgggcagcctcaaagatctctgaaatgttttcaggggtcattctcccattgtcttgatctcttgtatccataacaatatctttgcaaatggttgcttggccacaactgtggtttgctttcccaagcatgctttatcattctttgtaaggccaggctgaacattttcaaaatctttcttctgcttctcctttaattatcgttctatctttaagtcattcctctcatatcttactgtatgtggttaaaagtagctacttagctccatcaacattttgctttgaaatttattgcaccagatatcttagctccttgctcataaattctgccttccctaaagcccttggacaagaatacaattcagccaagttctctgtgactttattacaaggacagtctttactccagtttcaaataccttgttcttcatttctacctgagacctcatcaaaatggactttactatgcatgtttctactaacattctaattatgatcacttaagtaatgtctaagaagtcccagatggtccttaaatttcttgtcttctcctgagccctcacccaactgcccacaatgctccgtttgcagcagtctaggctttttctagcattcacttcataactgtcccagcttctgtggattacccaattccaaggccccttccacattttcagcttattgttatagcaacagccctaattctcggtaccaatcttctgtcgtagtctgttttgggttgctgtgaaagaattccacaaactgcataatttaaaatgaacagagatttatttcttacagtattggaggctggaagttcaaagtcaagtaaggggcctgcatctgatgagggcctccttgctggggtcttctctaacccccacctgctctcttgtgctttgctgcccttctcctagtaaggcagaaggtcaagaaagcgcaagagagcgagttggggatcacagttgcttttaaaacaaaactactctcacgataactaacccactcccttgataacattaatccattaattagggcagagcccttttcccttatgacctaacagtctctaattaggtgttacctcctaacactgcattggggattaagtttctagcacatgaactctggggacatgctgacaccatagcaagagtcttccttaattctaaccactgaaaatctttttcctttaaataccaaaatccagaagattaattcatgttcaatatcatttttagctaacaattttttaatttaaaaatactttactgtagaaaactctaataatcaatagctaacaaaattaagtggtctcaactctttagttcaatatttccttcaagttaatggtcaatttttcataactatggcatttctgtttcttttcttacagtcagggtgtctttgctgaatataaatagaacaatcaaaccaataatatcctttacataaccactatacatatatagatttaaccttagttattcttcgtatagattgtcttgtaagtttgttatgctagtactaacattagcattattattttaccaagagtccagcgtgacacagtatctgccatgttaggaatttgagtacagtgaaacagagagcaatgacaatgagaacactaaatctcattctagaatttcaatgaggtgtaatgagtatctagaaaagtcatttaattgtatgagcacctcaagtggagaactgagttttattccttctgtttctcccaacaataaatgaatgcattattccttctttgtagtcaaatatctcgtgcaaataattttatcagtttttccatggtgagttgtctctacctatgaccctaaatgccaagctccctacctctctctgcacacactcaaattaaatttttggttatatatttaaaatatatgttttatctataccattgtccagcttaatattttaccaagagtccagtatgatgtagtttctgctggttaggaatgtgagtatagtcccatagacagcaatgacactgagaatgttattctagtatttcaagaggcacaatagcaacttcttcttgccttagttttcttgttagtaatgattgccaacctacagatggctacattgaagtttaaaatgaaaattactttcattttaaagttccctcataaatgtcttcatcccaaataactttttcgagcaagaaagttttccttcattaatctacatctactattaagaaacactactctgattaacaattttatatatctatattcactagggattaaggatatacagttatttaatgtagtaagtcattgcaaaaaaaggaaattaccatgagttgcctttttgaaagaaaaccaaataattttatgtcaaggtaaaaaatattttaactaaaattaggaagaactcttttcattaggatgtaagttcaattctaaaaagtacacacaagggattccaacttttcttcatggctgattctaatgttggcaaataaacaaaatgaagcactacaacaaaaaaaatgaaaaacttaaatgaaaggcgacaaattatattaaaaagtgtaaggtggtacaactaaatcagtctaaactaatagaaaaactcttgggtgaaaagaaaactattcgtccttatgagattaccaactctcacagagaaacaactgagattacattttaattaatatgtattaatacctaaaatgaaatgagaatcaatgctgagttaagtaaaatatgataagggaaccaaataatgaaagtaaaagagccctagaaggcttctttactcggaaaaagagttttcttaagagttcacaaaacaaagagactttggaactagttaccaatttcatatttaggccattgggttgaatgaacaatcaaggtacccacataaaaaacaggtaatagtaatcccattgcctctatcatcccccaagaatacacacagagatgtacatgcacacactcacaccttcatgggcagtgttaaacataatggcaaagaagtgggaggaaatctttgcaaaattttctctacttcctaatttcagcaaatcagccaacaaagaggcagcactgatttcctgaaaagaccagtcatgacttaaatttgcaacaaggaaatgaaaagccaaactacaaactgttggtatttaaaaccacactttctaaagctcagggctatcataacacatgactggaaggacagaaagatatcaatgtgctaccacctcacctaattagccagaacaatttaatatgtgagggcagatgggaaatagtttaacttattagcaaatacagcaaatgttttaaactgttattgttataaaatgagttgtagggcaatatgaaattgcaggaaagattattccacgatgcaaagttgtaaaatgcttatccagagttaaaaagaacaaatgtgctaaatgacaaagcaaggccaatgctgctgtaactaaaacatggagggtgcacaagtgcagagggaatccagaagttcattatttaaaactgttttttttttttttttggctgactttattaaaatgagccaatacatgatttttttttttttttaaactaggataagggagtgatttggtttggatctgtgtccccgctcaaatttcatgctggattgtaatcccaaatgttgaatgtggggcctggtgagaggtgactcgatcataatggcattaccccctttagtactgttctcatgatagtgagtgagtgagttaagtcatcatgagatctggttgtttaaaggtgtggggcacctgccccctctctctcttcctcttgctccggccatgtgaagtgccagctcccccttcactttctgctgtgatttaaagtttcccgaggcctccccagaagctgagcagatgccagcaccacgcttcctgtgtagcctgcagaaccatcagccaattaaacttctttttatataaattacccagtctcaggtatcctttatggcagtgccagaataaacgaattcagaaaaatgggtcccaagaagtggggaattgctataaaaaatacctgaaaatgtagcagcaactttgggaactgggtaatgggcagaggttggaagagtgtggatggctcagaagatgacaggaagatgagggaaagtttgagacttcctagaggcttcttaaattgttgtgaccaaaatgctgatagtgatacggacaataaagtccaggctgtggaggtatcagatggcaatgaggaacttattgggaactaaagcaaaggttatgtttgttatgcggaagcaaagaacttggaggcactgtgcccctgccctagggatctgtggaattttgaacttgagagtgatgatttagggtatctggcagaagaaatttctaagcagcaaagcattaaagaagtaacctggctgcttctaacaacctatgcttatatgtgcgagcaaataaatgacataaaactggaacttatatctaaaagtttggaaaatttgcagcctggccatgtgaaaatttgcagcaggctgaagaaatttgctttactaaaaggcaggcaagtgctgatagcaagaaaatggggaaaatgcctcaaaggcatttcagagacctttgcagcagcccctcctatcacaggcctggaggcttaggagagaagaatggtttcataggccagtccccgggaagtttcactgccctatactgctccctgcatcccagccactctagctacagctgtggctaaaagggccaaggtacagctcaagctgtcactccagagagtgtaagccataagccttggtggcttccacatggcgttaagcctatgggtatgcagaatgcaagagttaaggcttcggagcctttgcctagatgtcagagaatgtatggaaaagcctggatatccaggcagacatctgcggcaggggtggaaccctcttggagaacctttactaggggagtgcagaagagaaatgtggggttggtgccccaacaaagagtccccaatgggtcactgcttagtggagctgtgagaagagggctaccatcctccaaaccccagaatggtagagcccccagcagtttgcaccctgcacctggaaaagccataggcactcaacgccagcccatgagagcaaccgcagggactgaactctggaaaagccacaggggcagagctgcccaaggccttgggagcccactcctcacaccagtgtgccctgaatataagaaatggagtcaaagcaggttattattggagctttaagatttaatgactgtcctgccggggtttcggacttgcacagtgcctgtagcccctttcttttggctgctttcttccttttggaataggagtatttagccaatgcctgtacccccattgtatcttgggagcaactaatttgtttttaattttacaggctcataggcacaagggactaggcttgtctcagataagagtgagttaaggctgaaatgagttaagactttgagggactgttgggaaggcatgactgtattttgcaatgtgagaaggacatgagattttagaggcgccagggatggaatgatatggtttggatctgtgctcccacacaaatctaatgttgaattgtaatccccactgttggaggtgggatctggcggtaagtgattggatcatgggggaagatttccccctttggtgctgttctcatggtagtgagtaagttattgtgagatctggttgtttaaaagtgtggcacttccaccccaccctgctctggccatgtgaagtgctgactccctctttgcctcctgtcatgactgaaagtttcctgaggcttccccagaagctgagcagatgctagcatcatacttcctgtacggcctgaagactgtgagccaattaaacctcttttgtttacaaattacccagtcttaagtattgctttgtagcagtgcaagaacagactaaaacagggagatttcttacaatttgtaaacactgttgtagaaagcagcaataaacatgaaagtcaaaggatgaaagagaggaacattaattttcctaatagacaatactgaacttattttattttcctatttgtgttaatcgttgtattttctgaagatcctcatgcagatacattttaaacaattccaacataagatataaactcccatatccacctcaactcacctcatcctacgccatcccaatcacaaagagtaattactcactttgtttatcacttagactggaaattttttaaagccaagaaaaatgcctcaatgccttatatagttttgttctccccaaattatcagcaggctgcatgatgcaagtaggtcaacaaatagatgcttcactaataatgaacaattgagcaaaggaacttggaaaggcaaatggtcatggtcctatatgacgtagcagagaccttccacaagtcaatttgactcactgcactcttcattacagtttttgtatttttatctttgtacagtcctccctctcccctaaatctcatgttgtgttctcattaggcaaggatctgtgtcttattcatatttgtatctagggcacagcactgggccaggcacaggagaagctggatagagattgcagaatagatgaataaataaatgatccttgctactaacttaaggaaaaactctagtaattctatgagcatttaatgagactagcaaattaatacaacattctcttaatgtgcactgtatcaaaggctagcacagaaacattcagactcactctctgctcttcaaagactttataagacggggtggctacagagatgccaggcagcatggtggtgccataggaggccataacagctggggaaaatcctggccttcccaccatactggacttggacctattgatgaacacttcttgacttaattttcctcatatataaagtaacaacaatggactacgtaagtacctttcaaaaaatttttcaagaacatataccttaaaaatatgaaatagaaccctatacatatattcaaaagagataaaagtggagctgttttgatcagctgaactaggcataatacttaaggaagcagaactgggtccccaacaattttcagtcacactcccaggtaaggccccaaggcatctccctgtaacccaaggttacactgaacccagtcagaaaaccaatgatataaaaacctataaggtttataacagttataacattctccggttctaacactcaataattctatcgtgatttcctctaaggttctaacatccacatcaagatgcctcctgcgcaagtcttccatgcattatcctacaaactttgtagcatcaccacctttcctgtaactattttctaaactacacattgtaggcttatcttttaagaaatgtggttccttcattaccattaacatcctttctatagccttttatggagccttcattacatataaacactatgatcagcaacagaggagataaagggacaaatccagacatgtatcatttccttaaagagcttacaatctaatggcacattactacaaataaccataatggggtgtagaaactgctggtgtcatcagataaagtaaaatggaagcttaaggctgagatcatacttctggttagcaagatcagaaaaaacttcaagaaaacagatggaataggagctggactgtgaaggatgataggctttgaacataaaatgattatgggatacaggttcctagcagaggtgacttcacgaacactgaatggagaacaaaatcaattattggcagaacgtgaagggcctaattaaagttttacagcacataggaacttcacagaggttaaagtacagggaagattggagacagaaggccttgttgaggaggcaaacactataaatgcctgaaaaacaaaagaatggcaggagtgaagaggaaagatgctgtttggagccatttctgcaggggttcgaagtggtggtgtgggagggtgtcaaagatgatgtaaaggctaaaatccaggtaagccggaaacgctggtgtcattaatagaaatggagcacacacgacaagtttggagacagacgatgagcgctaagtgccagcagaaacatcctgcaggaaaatgcaaacactgaattgaaacttgggaaagaggtcagagctgtatatatatataggaagaatttttacagaaatggcagaagaagttttaagagtgaattgcaattgctgaggaggagactacattggaagaagacaattcaaagtgtccatctaacgctaagggataatatgaggaaaatgggtcagagaaagtctagttagagaggtatgggagaaacgggagagcacagtgttataaataattatatccatgtacatacacttttatcaaggaaaaagcttagttttttttttttttttttttttgagaccaagtctcactctgtcacccaggctggggtatagtggcacaatctcagctcactgcaacctctgtttcttgggttcaagcaattctcccgcctcagcctcctgagtagctgggattacaagtgcacgccaccacgcccagctaatttttgtatttttagtagagatgaggtttcaccatgttggccaggctggtctcgaactcctgacctcaagtgatccaggctcctcagcctcccaaagtgttgggattacaggtgtcagcgaccgtgcccagctgcttagctcctttgctaaaggatcacatacactgatagatgtcagtgttctcagaagtgtgttctaaataaaaagcaccagttttagtagatgttaaaaggtgctttaagacaaaaataagattcagtgatttaataaattggggtattggccatttatttcctacagaaattcaagatgtacatcaggtttttaaattcaaatttctcctgcagaaattcaagatgtacgttgattgaacaggatgataacagagagatctgtttaattttgtttgagctagcattcattccaagacttagttgacccataatccctttgttttatatctgcttgatagagcagtacttcttccacaggaggaaacactgaaatatggcaaaactcagaaatttacagaatattagaactagaaaaaatacttgtgatcatttcatccaattccttcattttataggtgaagatagaaattatacgataaccactatagtgtcttcttctaattcttgacaatgtataaaaatgtagtctatgtatatgcatatgaacaagagagaaaaagaaaaaaagacaaaaaaaaaaagaaattggagctttgaaagctacagcatcaggcatcaattgaagagcaacttgctttatgttcagtgttttcaaacatttcagtgtcatcctgaaggttacatgagactcaatatttgctcagtcttgcaaaagaggaaactgaggactacaggttaacttggtcagtgaaccagctactacatgaaaaagctgtaattcacaccaaaatttatctgactctgaaatccaggcttctgaacaagatgctctgctaacttcacaagaagaaaccagttactgggtaaactcccgcccctccacccttgggtaacacgcaagatatagctttcttgcatcaaactccgactacctataaatgaataaataaaatctgctgtaacaaattaaaaaaaaaaacctagatttacaaaacaggtcctcaagagtatatgtatttgttttttaaaataacttcataaaagaatcttcaatgtattctcttgcccagagtgaatatgatgatgccatttttatttattttctctagactacatattctgcatatgtcaggatgtcctttttgcatttcagcaagattctgactatatccttcacaaaattttcctatgaaacccacttttgttcatgagaaataagcctaaagaagaatgatcacctttgatagcagaccatgaattcttaatgatcagttttccttgaaatggcacgctgcctttaaatgagtctcatcatgaatatacatacagacacataagccatatatatatatatgcaaatattaaagtcttaacttttgactccctaacttgcaataggaccatgactctacagtgagtagacgcaattcaagtggtgctgatacttcaaaaataaattcctgcacattatatgtaatacacagtcaactattaacccatgttcctccaacgtgcagataacataacaagttttatctcccaagttatgattctgtaaacccgagttcattgtagaatgctctgttaggtcacgtggtaaaacaatacttatgaatacttagtaaaaataaaaaataaaatccacgaagttctaattacaaagaacacattttgacctaatttcctggtaatgtgattaaaaatttcatattcttccataataattttataaaaattaaaattttgaactgctatattgattagggaaattttaacaacagtggtattgttctacgtagacctaggtgtagctcatctttaatagtatttctcaaagtatgtaccctgaaacactatatgtcactgtcaaagagagtcaggaaacattacacattctattcctctcttggggactgataacacacattggcattggataagctcctagaagttctgaagtttaaataaaatagctttattcaatccatcatctcccaagcttattccattcagagaacctttttttggttgctgttgttgttttgtgcttagtatctatcagtgtcctagtatgattagtatcataggaaataaacctggaaagccatgatctatgatgataggaaggagataattaaaataagtggatgataccaaaaccatttgtattacattttgcaatacacactattcatcagcagatttttcttttagaatgttactttttaaaagataaatttaaggccgggcgtggtcgctcactcctgtaatcccagaactttgggaggccgaggcaggtggatcacgaggtcaggagatcgagaccatcctggctaacactgtgaaaccccgtctctactaaaaatgcaaaaaaaaaaaattagctgggagtggtggtgggcgcctgtagtcccagctactcgggaggctgaggcaggagaatggcgtgaacccgggaggcggagcttgcagtgagccgagattgcgccactgcactccagcctgggcgacaaagccagactccacctcaaaaaaaaaaaaaaaaaaattaaaagacaattaattacctacaggtacagcaaccattttaaaagcagaataggaacacactgagtaccaaaaaaccacaggatactctgggtttacttgtataaaaccgaaataggttttacttgtatctgggtttacttgtataaagccacaaagtaggtaagacacttggtgtaaaatgagaattggcaatgcatatttaatccttctctaagatcacttccaaggcataaagacagtaggaaaaaagtgagtagttcattattaaaaggctgacgtccagcacacttacactgcccattcaagcttctcattcttgattgagttgtacagagcctgtaaagagagaaaatgagatcacattattctttccattctgttccacattttgaattcagcaaatgaccaagtaattccttcataaaaggataggcacgaagccccccttgtcagtcaccttgcttttagaaaggtgaagaatacatggggaggcaaatgagcattgggtgaacaacgaacgtttcatgaaacaaagaaactttcacaaagttataactgtcttttatcaataaggcacagtactgtactacatttcattatagtaaaatattaggatgtgattaaaattacactgtgcatgctatttctcatattgaaaatatggtcttgtagtttcactcagttggacagtggagtactcatacttttttcttttcttctttttttcagacggagtctcactccattgcccaggctggagtgcaacggcacaatcttggctcactgcaacctctgcctcctgggttcaagtgattctcttgcttcagcctcccgagtagctgggattacaggcgtgtgccaccacacctggctaatttttgtatttttagtagagacggggtttcaccatgttggccagactggtcttgaactcctgatctcaggtgatccacctgcctcagcctcccaaagtgctgggattagaggcatgagccactgtgtctggctgctttttttttttcgttaatgaaagaaatagaattgttttcatggcaaattaaagagtaagatacttggtagggggactgaagccagacatggaaaagcatcttaggatagttttagagtttcgataccactgacttaatccagtttttattataaatgtaacatcccaattctgccttacagttaagtattacattttgggtgtgtgtggttgtggcagattggataaaaaacttctttagacccttggtaacaataatggtaaagtcagcacaagactgctaccctgattctcccagctctagcattacaaaggtccttgtagtcagcttgttccactataccaactaccgagaaacatttttttaagacacagggtcttgctgtgtttcccaggctgcagtgcagcgactattcatgaccatgataatagtgcacaacagcctcaaactccagggctcaagtgattctcctgcctcagcttcctgaacagctgggactacaggcatatgccacagtgtctggctttacctttgaattttaagtaagatgttataaggaacacacaaatgcatttctaaggtacaaaaccacaagagcaaattatatttaacaaaagaacggtatgcataacaatattatgatgatgttggaacatttttcctcaaagaatgacttggatcaattagaacttgaaggcttagccaagacttcatttactctgagatagaaaaaagggggatcacatgtcatctaacctcttgtctttcaaacaagaaaaggcaggttcagaaagttgtccaagcagcacagcagagcagaactgccttgtatttctatcctttcgcccttaacattgtctcattcaagtgtttacatgtgtgtaagcaaacaatgcacaccaatagtaaattcacttttcagcaaaatacttccaaattcagtacaaatttatttaagttgtagaatttatattatttacgactcaatacgtgtattcttagccagtatcttgacaaacttcatgaaagttctcaattgtggcttcatagtcaattcaactattgaaatattacagtagctaataaaaaccaggtcacattttatatttttcaggacatgataggtattctcaaacacaaaagggatagaacgtacaattaaaatacggagtatactgaggcacaaagactatgctataaattgcatatttgttttgaagaactcaggattactgaagagatccaatctatgatatagttaatgtatcaggaggctgaacacctatggaagtgcagagagagttgaaaactggctcaagtctcaggagggctttcgttggataaacgccttttaaatgaattatattacttgcatgagccattttgaacccacaagtaacagtgggctgagaaactacaaatgaaaagagacagatcattaaaggttctttagatgctactatcatactcaatattacccagagtaattcaaaatgtggcaaagatttttaaaaaatctgttcataaaggtagaaagtttaaatgaccgctaaacagctaaaatttttctaatacattcatttctgttctagcacaaattttttcaaatactttttccctcaagaatattttgttcaaagagaagtagaattgtaaatttaaaaattcttgctattcaatcagccagatatctcatgaagataatctattataaatcatcttgccgaattccacagacttgcagtattgcaggtcaagtcctctcactgtgtaaacaacatagaatagaattttttttgtagcatgccgaatccagacagtgggtgtcatccctattcttttcaattgcaaaattgcaaagaattttccttgttctttgtagtgctttatcacaattattatttttcttaataaaaggaagacgctttacaaatgcatccaaaacttaaatacactctcaacacaacttcccatctttttatctactcagcctagttaagaaatgaattcccttgattcttctttatctctaacctggcagtcattacttcctttcccgtgtagcctagacgtcatagtctctcacctccaccagtctagttagtatcttcgatttctttgttctgctgttgtacatgaaaatattaatagatactatataattcttttttttttttttttgagacagggtcttgcttggtcacccgggctggagtacagtggtgcagtcatagctcactgcagcctcaaaatcctgggctcaagggatcctcttgccttagccttctaagtagctgtggttacacctatataactcttgatcaatcctactctgatttctccgtatgaaaatcctacagattagttaagatttcttttactttcaaatgtcaaatacctaaacactaccttaagggtaaggaggcctaataattaatgtagtcagatcataaaaagtatgctctagtagcctcagggatccaggaatttctctctcatctcaattcgcctctttctaccccaaccatctgcagtccttgtttctccactacacaagaaacacatccaaaacaagcaacaccttttcacagcttgtctctctcaatagtaacaacaacaaactagttatttctcccagctccagtatgaaagttcccagtagaggttcagttcacctatccttcccatggacagatctgcgtggctaggagaaagttctatgactcggcccatctctgaagccaaggggactagggggttgtggggaggtgggtattaatgaagggcagcactgacctagccactaataatcctcctgaacttcgcagcctcccctatttgtatgtgactaattcagcactactagagaaaattaaacaatagaacaaattaatgccattgaatattcatcaactcaaacttcagcagggtcttcattcatgagcctctcgccatctcctctaaaatgcatctgcactagcacctatttctcctttctgatggtaagggaagaaccaacaaaatgggatttcagaactgaactcagagatcatgaaacaaaggtttccttatacggatgaggaaatgaaatcccatgttaattaacttctctccacattccataacttgtttttcacaaacactgactcaagtaaataacacttcatgtttacatcaactaagtacattgtctcctcctaagaccaaaccttatagcatcgtatatgcctggccaaagtcagagcccatttgaaaagataataagacttgtgcctctcttagaatatattcaaataatctggtaatgttctattcttaaaagatgagctttaaagagccaccgttgctaggacacatgcttgaagcgcctttgttggtgaggatgatgggctggctgcactgatcctatactcttagtccatttaggaccaaaggcatttgtcatgagaatggctaaaactggaggcatagtctatggctcagaaaaacaacttatctccagctatgtgaggggttatctggcctagctgcaagagggcagggtttggggagaaacattgctatggactggtagttagagctaagtggagaaagttaccacatggaccttaatgggacagggcagcccatatgaatacatacagtgaagcgataactcactgtggaaggctgaagaatggcacccctaatgtccaggtcccaatctctagaacttgtgaatgttaccttatatggcaaaaactttaaagatgtgattaagttaaagaacttgagatggggaacgtacgtgggtgggctctaaatgcaatcacaagtgtctttatagaaggcagacggagatttaagaaagaaaagaaggcaacatgaagaggaatatggaaattagagtaatacacacgtaagtcaaagaatgctggcgaccaccagaggttagaagaggcgaggaagagacttttcccctgaaccctccagagggtaaaaagccctgttgacctcttgatttcagacctctggcctctgcaattgtgagaatgcatttctgtttttaagacaccaagtttgtggtaatttgtttcagcagcccgaggaaactaatactctagcgtactagagaatagcagatacctagcaaagaatgatgatatacccacaggtggatttcaggaaatagttccagggtcagtccctaggacaaacagtctttccccacagtggtcttatctaaagatgtgacagtgcacaagaaaatcaaccgaggaatttttaaaaacactgattattgtgccctgtcctagatctaccacatcagctccttggacgaggaaactgcatgaatatttctaaatgctccacatgtaactctgattggaagccttggttaaaaaatcactgctttgcaagcttaccaatcttttatctaactgtaatttctgtaacttaaccccagagccagatcacaatcacatacctctctcgacactagccaggacagaatgactctttgaatttgaagatcatcatttttaagaataacaaagcaaagaaaattgcttaaattacagaggtaaacatattctggtctaaatttaattttaagtcgttgttcctcacttttggttgcttctcagagacgataaaatgcaattttattcaaggctttagtgctgtcattgccagcccacacagggctctctgaagcttttctacattaccatgcattgtgtaaccgtgagtctctctttctctctccaacatattttgcacagttgatggaattcgtgtattttagttcaatcatctctaaactccaatgaatttttttctctgtggttcctgaatcattatgaaaagtatggaggatatcacagcttccactttcagtgaaactgacagtgaccgcagtggaatttgtactcagaaagaattatgacaccatccgtaccacaattctctctttcaaatgctatgctggctctcatgcagatacttagatcaagcagactgttaagtatagaattaaatatgcaccactctggcagtgttatcagagaaagagcatgtttgaaaaagacactggttaaaaattaatgataaaaccagttattagataaatatcaaaatggttagaaaaactcaaaatactttgcaatggtcttcaacttctactatcgtctctatgccttaaaataatattgaaaaactgcactatctctcactataggaagcttctccaaaactaggatttggaattgactctttttttgccccctccgcaccagtggaggtccttacaccttgcgatgtaccaaataaggttataggtgagggttatgacttttttttcttaagtggcaaagggcaattgttaagcagagatgcaaaaggagaaatagcctgaaggcttgaccacaagagaattcacaggtagatccattttagggagaagtacatacagaagatgagtttctggaaatggattccctttaagctatttgtgttctcccgtacccactggacagttttcacatgcccaagtttaaagagcgccacattagagaatgtatattcataagcaacctggtcaacattcatcttttcagctcttatttagggtaatagaacatgcttgaattttttttttttcacttctatggtaagatgtagttttgaaatcgagtcaacatgtaaacagagctgaaatctgtatctcgggcaattagtcttatgttgtgatgtacttccaaacccagtcacagtcccaaaaccacctaaccatgaatagatgtcccagcacaaattcgtattaatgaacactagaaaattactcttcaagcccttatcttattgaaagagaatctgaagtataattaatatgtataattcatcatgtaatcatttttaagcacattccagaggctagggaggcattatgctaggtacagatgaatctgttctgtcttcagaggcctcttatataaggaatacaaaatgtgctgctaaccctgactgaactttacctagtgaagaattagtcagctaatggagtcaactaatttttttcctacttacaatgtgtgagacactttcacacacagtatctaatatgtgacattatgttatacatattttcttgagagaaagatttgataaaacagagaacagatccaatcttatgagcaaagaatttgaaacgggtgggtggggcacctatcactgacttgtacatttaagacaaatcaatttacctggccctcattttctttacatgcaataggagagggctgcataaagttagtgttctttgcccccttccagatctactattttacaattcagcttgagaaagaccttagctatcacccagccaaactcccaaactagtcctttctttagtctctgctcccttttcctgtgttcctcactaaatattttttgccatggtttttgatcaatagcatgactacctgctctcaaatcctaggcacagcttttacagattaataaatgcacattttaaaattgcaaatgaacgaacaagaataggagagggagtgggagctacagcaagaaagccagagaaatattatgaggtgggggaaggggagcaatgggactctgactgcttcttgtcaaatgcacctttctgagctacaacagtttgaaccaccatttcttcattattactgaagaaaaataaggtagccaaagacaatactaactaaacacacctgccaaagaatatggccagcatctctggggatgcacaaaatcaaacctgaaagtgaaggccgggcgcagtggctcacaaatgtaatcccagcactttgggagccgcagagggaggatcacttgagcccaggagttcgaaaccagcctagccaacgtggcgaaacccagcctttactaaaaacacaaaaattagccaggtgtggtgacacgtgcctgtagtcccagctacttagaggctgatgcaggaggattgcttcaaccagggaggtggaggtttcagtgagccaagatcatgccactgcactccagcctgggcgacagaatgagactttgtctcaaaaaaccaaaaagcaaaaaaaaaaaaaccgaataaaaatgtaattgctaattatcttttgtactaacataatacttcaaagttttactaatgtgtgtatgcattcatttatttattttgggggtggacttgatcaataagatgtattcaaacacagcacatttctcctaaactacttttgcttcaccttgagattaccttctattgaactggctgttgtgtctcagagaaagtgtcttaactatgctagtatgaataacactattctaaatgtaaacaaaacattaagattgctgctaagttctttgtagagtaaaggttttaagtatagggatacctcactgtattgtgctttgcctcactgagcttcacgtatacgataatgctttacaacttgaaggtttgtggctaccctgttttgagcaaatctgtcagtgacatttttttccagcagcacagtttcactttgtatctctctgtcacattttgacaattctcacaattcaaacatttgattattatatttgctatggtaatcagtgatctttgatgttactactgtaattgttttggggagccattaaccatctccacataagatggtaaacttaataaatgttatgtgttctgagcactgcactgaccagctgttccctaagatacaacaatactgaaattagaccaattagtaatcctgcaatggtctctaactgttcaagtaaaaggaagagttgcatgtctctcactttaaatcaaaagctagaaatgattaagcttagtgaggctaaggctacgctgaaggtgaggtttcttgcaccagttaaccaagttgtaaatgaaaagaaaaagttcttgaagaaaattaaaagtgttactccagggaacacacaaaatataagagagtgaaacagctttattgctgatatggagaaagtttaaatggtctggatagaagatcaaactagccacaacattcccttaaggccaaagcctaattcagagcaaggacctaactgtcttccaccctgcaaaagctgagacaagtgagaaagctgcagaagaaaagtttgaaggtaacagatgtcggttcgtgaggtttaaggaaagaagcagaccctgtaatataaaagtccaaggtaaagctgcaaccggtgatggagaagctgcagcaagttatccagaagatccagctaagatcactgatgaaggtggctatactaaacaacagattttcagtatatacaaaacagccttttattggaagataatgccatctaggactttgatagctagggagaagtcaatgcctggcttcaaagcttcaaaagtcaggctgactctcttcttaggggcaatggggcaatgaagctggtgaccttaagctgaagccaatgctcaagtatcattctgaaaatcctgaggcccttactctgcctttgctctttaagtgtaacaacaaagccaggatggcagcatatctgttgacaggatggtttgctaaatatttttagtccattgtcgagacctattgctcagaaaaaaggattcctttcaaaatgttactggtcattaacagagcacctcgtcacccaagaactctgatggagatgtacaaggagatgactgttgttttcatgcctgctaacacaacatccattccgtagaccatggatcaagaagtgatttctactgccaagtcttattatttaaatacatttcacaaggctgtaactgccatagatagcgattcctctgatggatatgggcaaagtaaactgaaaaccttctagaaaggattcaccattttggatgtcttcaagaacatctgtgattcatgggaggtcaaaatatcaacatcaacaggagtttggaagaagttgattccaaccctcatggaatgactttggggggtttgagacttcagcagaggaagtcactgcagatgtggtggaaacagtaacacagctagaattagacgtggagcctaaagatatgactgcattgctgcaatctcatggtaaaacatgaacagatgaggatttgtatggatgagcaaagaaagtagtttcctgagatggaaactacccccggtgaagatgctatgaacactgttaaaatgacaaaaaaggatttagaatatgaaataaacatagttcataaagcagtagcagggtttgaggggaatgactgcatttctgaatgaagttctactgtgggtaaaatgctaacaaacagcatcaaatgctacacagaaatctttcatgaaagagtctacagctgggtgtgggtggcgtgcatgccaatggtctcagctatttgagaggctgaggtgagaagactgtttgagcctgggagatcaaggctgcagtgagctgtgatcgtgccactgcacttcagcctgggtgagacagcgagacccagtcttaaaaaacaaacaaacaaaactaatgatgcagcaagcttaattactgccttttcagaaattgccacagtcatatcaaccttcagcagccaccaccctgattagtcagcagccatcaacatcaaggtgagaccctccataagcaaaacgatgacaacttgctgaaggctccaatgacacacataataaactacagtatagtgtaaacatacctttttttttgagacagtcttgtgtgtcacccaggctggactgcagtgtggcacgatctccacttactgcaacttctgcctcctgggttcaagtggttctcttgccttagcctcctgagtagctggaattataggggcacgccactgtgtcctgtttatttttgtatttttagtagagacagggtttcgccatgttggccaggctggtcttgaactcctgacctcaggtgatccgcccgctttggcatcccaaagttctgtgattaaaggcgtgagccacctcacccagctgtgtaaacataacttctaaatgcatacggacaccaaaaaattcctgtggcttgctttatcgcggtatttgttttattgctgtggtctagaactgaacctgtagtatctccaaggtctgcctgtttaaagaatttttcccctagttacaactgtaaacatctaatgaactgattagaacattaagtccaaatgctggttcatcatcaaaaaacaaactaagagttacaactcaaatatctcgtaacagataagtcaggaaggccagggagagactccgggggtttggagaaagctccatgtacaaggtaagctagcactcagctgtagcctgatttcaaccaagtgggaatgtagcttcactattgcttttttttggggggtggggggaagtagctggaagcacacattattcaaggctggcaaatgttcaagtatgtcaacagagagagcaatgtaaactactgtgggtgagacaagcacatccactatcaaagaggacaccaattttgaaacagattggaatgctattgtgtccagaattggtgggttcttggtctcactgacttccctcgcggtcagtgttacagttcttaaaggagacgtgtccgcagtttgttcattcctcccggtgggttcatggtcttgctggatgtgttgggagttttttccttcttgtgggttcgtggtctcgctggcttcaggagtgaagctgcagacctttgtgttgagtgttacagctcataaaggcagtgtggaaggggaccccagcgagttgccactggtggctcaggcagcctgcttttattctcttatctggccccacccacatcctgctgattggtccattttacagagagccgattactctgttttacagagaactgattggtccattttgacaaggtgctgactggtgcatttacaatccctgagctagacacaaaacttctccacctacccactagattagctagatacagagtgctgattggtgtatttacaaaccctgagctagacacaaagtgctgattggtgcatttacaaaccttgagctagatacagagtgccgattggtgtattcccaagcccttagctagacatgaagattctccaagtccccaccagattagctagatacagagtgcccactggtgcctccacaaaccctgaggtagacacagggtgctgattggcgtgtttacaatcccttacctagacataaagattcttcaagtccccaaatagatttaggagcccagctggcttcacccagtggatcctgaaccaggcggcaggcagagctgcccgccagtcccgccgtgtgcctgcactcctcagcccttaggcagctgatgggaccaggcgctgcggagcagggggcggtactcgtcagggaggctcaggcggggcaaggagcccatggcggggtgggggaggctcaggcatggcgggctgcagagcctccgagccctgccccgcagggaggcagctgaggcctggggagaatctgagtgtagcgccggcaggccggcactgctgggggacccggtgcaccctccacagctgctggcccagttactaagcccctcactgcccgaggccagcggcaccggccggccgctccaagtgtggggcccgcggaagccacacccaccaagaaatcgcgctggcccgcaagctccgcgcgcaacccgggttcccgcccaggcctctccctgcacacctcccagcaagctgagggagccggctccggcctcggtcagcccagaaacgggctcccacagtgcagcggcaggctgaagggttcctcaagcgcggccagagtgggcagagaggccgaggggttgcggagagtgagcaagggctgccaggactgccagcacgctgtcacctctcactgtgattagaaattgtaaggaggaaacagtaagaatcactgaacaaacacggcaaaatttccaatttttgatttatagacaaacttctgaatatttcatgtttcgcctggtatttctgacgctgcgatgatgttctagccatttcaaataactgatcttcctctgataataactatcaatgaggccccactatgtgatactgctaagagcctgactttcacttgatctcactgaactctcacagcagccatatatgagagaggtagtattattcccactctagaaatgccacagctgatgcctatgaaggttaagtaggctgccaaggtcatacagcagagctgggtatctcagacaggtctttcctaagccatagtctctgcttttaactgccctaatcacaacacaatattgtcaccatgtaagtatattattatgtgtactgttcacatacacacctgtgtacatatatacatactttaaagtcagtattatgtgtattgttcacatacacacctgtgtacatattattttaaatatagataatcagtaataaattttgcaactctgataaatgtcttgcctagaaatcagagttaataaagttaaaagtaaacaatgctatccacagtattacatttcttagcttttccttttgttatatcagcttaggccttcttattagtttatttaaaaaataatgttttcacagggaaagatatccatcatcctaagttcacggctaagaaaacttatgatcacagtgcacatgaattgatggtttatagttcaaattctcctttaacacatcactgactatttataacttgtctactccatctccctacatagcgtaccttgcttaatgcatcctcattgtattagtctattgtacaatgaccacaacaaatatttgattataacacatgctgatatatgaagggaaattgttttttgtaactactagacactaattagaatgtactttttctgatacagtagtctcccgatccttgggggaatatgttccaaggctcccagtggaacatgaaaccacgaatgggaccaaaccctatatattgtatgtttttttcctagacttacatgcttataaggttgaatttgtaaattagggacagaaagaaattaacaataactaataataaaatagaacaatgataacatatgccagcttcactactcttgcactttgcagctattattaagtaaaataagggtgacttgaaggcaagaactgtgatgctgtgacagccaatttgataaccaacttagctagtaagtgactgagggcagggagcatccacagtggggaggcactggacaaaggaaggattcgcgtccacatgggatggcacacgacagtgagattgcatcgcactacgccggatggcatgagatttaaaacttatgaaatgtttgtctctaaaattttccttttaatgtttttggacgatgtttgatggcagttaagtgaaaccatgagtaactacctgaaactgcagataaggggcgaatcccgtaatggtatagcatatggtataagtattaatacagtaaagtattttataacaactagaagactaattcatgtttgtaacacttataatagtaaaaataaatcccttaaaaccattcatttattcattcatatattcagttgaacagttatttatttaggcatcgtgaatccagtggtgaacaacagacacagaacttagatttgagtggggtggaagcaggtaataaataagaaaaataacagatgacgataattctgtcactttctggtaggctaccagataattattataaggtgattcaaataaggtcactggaaagagtagccgtagcctggatggtcagagaaggcctctgggcaaggaaacgtaagacgtgagtgaccgggagcagccacgcacaggtgtggggagcgaggtaagcagctcctgggcaccactgaaccgggtgggtctgagaaacccagcggggctggtgcggctggagcaaatgggcccagctgtggtgtgagcaggtcccgaagggcttttaaaccagaaaagttagaggtttattctgtgctggccgggtgaccactagaggattttaagcgggagggtgacctgctgtaattcatgtttttaaagggtggctccgcttctgtgtggagaaaggattataagagaaaaagggaaacagcagcgaggcaggtggaatctgggtgagaggtgaggtaagttgactgggatgaaggcaggcagtggcggattagggacggatcaggctgtttttctaaattatatgagaaaggtggaccattttcacatacctcaagcacaaataaaaaactgggtacaacgaacagtttcaacagtagcaccagaaatgtatcattatgatatttaaagtcatttaagctaagaaggaggtaaatacattaagagataaaggaaagaagtaaggtgcaaaacattgttacggtatgtttccattttgtgggggaaaaatgtgtgcgagtatctgggcacgaatagaacatttctgaggggatacacacaaccccaccgacaatgactgactccggacacagcaactcggggagcagggtggggggattttcaatgtataatcttctggacaatttgaatgttgaccacacagtgtacactttgcttcttcgatgaaaaatagagatgacattagattttatgctccttgcagatgagatcaagtcttccatctccctttagtctctataatgcttcgtaagttgtcttaaccacagcgagggtttcatttgctgagaaggcaagggcttcagtgaggacgatgctgtataacacaattatgatgggaggcagcaaaggcaggaaaaaagaacaataaactagaaagctgcagacctagattcacacctgcttctacgtcctaggaagtaagtaggatgactccacttcgccgatctaggagctggaggttaggcagattgttgcttggtgtaggttgaaagttaccagatcaaatgcaagatgctcacttaaatttgaacttcagataaataataacatttctagcataagcatgccctccaattttacatgagacacactaaaaattgtctaaaattaaaatttacctgggtgttctgtatttttatttgtgaaatctggcaaccctatgccagccacaactctctttccaagaggtaatgtagttatgatctgagtgaatcactttctttcttatacaatgaattaaaggttaacttccaaggtattccacagcagatttaactattcttctttggaagcaccatgattccagaagccattgtgttcacagtcatctcctgattttgtttttttgttttttgtttttttttttgagatggagtctcgctttgtcgcccaggctggagggcagtgcgcgatctccgctcactgcaagctccgcctcctgggttcacgccattctcctgcctcagcctcccgaatagctgggactataggtgcccgccatgacgtccggctaattttttgtatttttagtagagatggggtttcaccgtgttagccagaatggtctcgatctcctgaccttgttatccgcccgccttggcctcccaaagtgctggaattacaggcgtgagccactgcgccgggcctgattttgtttttaacttttataccctgatcctctgaaactgtaatttatcaatttatcaaaaacttgtctagtttagacagctaaaccatatcagtgaaaaacataaccataaccagtattttcaataaagattctggaatgtacttgatgaaatttgttaatgtccatcttgttggtaagccttaagtgttggaaagtagcaagcatgtaccataataaaaaatgcaatttgagaacataggaaaacataaatttaaagtgaccttgtaaatatatgcaatattttttaagtacccaagaaaaacggtcaattatatttaataactatggacatgatgaagttaacgtgcacagtttattaaaaaaaaaaacttgctgggtaacaagcacaatccttttaaataaatggcctgtaaaaaaaacaatccctgggggactttgacatttagagagaatgccaggcctggcatttgttccctgtcatttccatgcattagacaaagcaatgaagacaaaccaaatggaaataggttttattcaaaacgatcaatacaaacaaattaaataatctcacccagtggatagcaggcttcaaatttcataaacaggaaaatttgcaaaagaaattttagggagctaaatagaattgccagtttttcgtttagctaaatgagaaaataaattttttaaagaaacaaagcaccaactattatcggtattgttgcataaaaataagttgcatggacaatctcagaagagacaactgtttctcaagaaaggaccagcctttcactgatattttgctatagactaaaactgtgacagcaactagcagcagaacatggtctagtctgataactgctagagtataaagtcttggaagagatgaaaccttttgcttttcttaaaaagtagtctccattacctggcatttgttaaacccaaagttaattaagataaacaaaagccattctagtccctggaaattattccagtctcgtatgtacctatatatgctgtctacattccttctgattcattaaaaaaaatttctcaaggcaatatatgtatatcatttatataatcaaaaattactaaaaggtatgtaatacaaataatcttttaacttcacctctgattcttgctgctcaaaagtcacctctttcaatctctttttggtttttctattttcaatatgatctattgactttcaactgcagaactctggaaagtgaacatttatttggttctcttaacacacacacccatccacacacacacacacacccacacacaccctgcccgtctctttctttccactcccatattaaaatcataccacagtcacaatttgcagtttcatgaattttcagtcctcatattattgtgactatatagacattattcatggggcagaacactaggctacgtttccattttttgtaagatttttgatttccctggagttaatcatcatcttattttgttgttgtttactcagttttctacgaatctatctctatgtcaacttcacaccctccagcaggcattccttcggtgccatggttggaagcatgtctcttggcatcgtctctgcccccactcctctaatctggctggtttctatctccggcacagctgttgtcccagggtttccctttgccattgtcctggggattccctctccccctctgctctactggacaccatgtcttctctttcacttcttcaagcaactgagaaaaagtacatgagaaagtagagagggaagagacgccctgctgtgaaacgtttatacctttcactgaatcctgctattttcaacgtggggatctccccgtgggcctcgactgagcctaatttcctaagtccaaaacctctggattaaacttatcagagagaaagaacagaaaattgtagggcgggcaggggggcatgctggctcatacctgtaatcccaacgatttgggaggccaaggcaggaggattgcttgagcccagcagttaaagaccaacctgggaaacaaaacaagaccctatctctacaaaaaaattaaaaaatgagctgcgcatggtggtgtgtgcctgtggctcctgctactctggaagctgaggacttgggaggattccttgagcccaggaagtggagggtgcagtgagcagtgatcgtgccactgcagtccagactggatgaaagagtgaaacttgtcttaaaaaaaaaaagaaaatggtgggaggaagggtatgcggctatcaaagcaggggagggcattcagaaggtcgacttactaattttagaggctttaaagggctgtcctcgttcgactcactgccctcagaggtagccagtggcccccagttcctgggccttccctgcgttctgtggggacagattgatctatttctttctttagtatttggcatccagtttttttctgtggaacttaaatagtgaacacgtctatctggtttccatgtttcaaagtttgctgatgttttgaaaaatcctctctcattctttgggtccttgaaggtctacgaatcctactgtcattttagtggagtttaggtgggtgtaaagataaaagcacactgttaccttaaattctaatttaagagttaagtttttttgctatatgtaaataccacttaatcacagtctaagagatcacagcagggggtggatggggcacagaaaatctcctcaaaacactgtccaaccatagtaagagtattccaaatggcctttttattttacctgtttttaagaagatgtattaagaaagaagtgtggccagatgtggtgtctcatgtctgtgatcccagcactttgggaggctgaggtgggagaagcatctgaggtggggtgttcaagaccagactgggcaacattgtaagtcctctgtctctacaaaaaagttaaaatattagcctggagtggtgacatgtgcctagttactcaggaagtggaggcatgaggattatatgaggccaggatttcagggctacagtgaggtatgttcttactactgcactccagcttgggtgacaaagtgagaccctgtctccaatttaaaaaaaaaagcaacaataaagaaaagtgtcatcaatctatataaatctgctggacctttatctgtccctcggagtgacagtcaagagctgcttctctcaaagtactttcttgtatctgtacgtctagttaggtaggacctcaaccctttagatttacttatgctgggagaccttagaagaaaactgtaatgaaaaagctcaataaggattcgttcccttgtcatgagccactggggcaccaggatctagagaaggtcttactgcttcctgtaaacaccttggcctgccccagtggatttctgagtagtagagctgacgctgacaccactaaactgcagctgagtgcaagaaggagattagactgtttgagatagcttcgtaatcttatttatttactggaatcaaacacacacttggctcaccagatttgaatgtggcagtaacgagtacactagtgtttccagtgccttggggggcatttcatgttgtaaaacttaactgcaggctacaaacaatggcatgtcataaggggagtcaggctaggactagagcctcagccagcccgttcagaaaaattttgatattaagcatttcaaagaatctacctagaaaaacaaattccaccgatatcaggtgatctacgtgtccaaacaggtacactaaatgtaccatcggaacatggtacagtggattttaaaaaaagaaataaaatctgcttgaatgatagttaaggcaaagcttaaaaatcttaattaaaattaatgttagaagagcaacttccatcataaattaatatcataaattaacaagcaggaagccatcttgcacagctactcttggtctctgcttcactatggatgagtaaataaaaaatattttccaaaaatctcctattagactctaagctggacgcaatccctaagctctaagccaggcatgatctaacaacaggttgcagaatagcttgtcaccatacatattcccacacagaagctccttatggtcaacttcaggttatcatgatgctacgaaactccctgatcttcggcagtgactatctttaaaatgcaaatatatatatatttttttctctttcgactcctatcattattgcatagagttttctttttcctttccctggattctgaaaaggatattacactaagcttgccaggaatgacagcatggaccagcattttctctacaatgttcaaatactgcatggaagttctcaaacacctgcttcagtacaccttccccaaaagaatgtgttcaaatacagtctactcataaatggaggggagcaagaatgcagtacgaccttgggagttagagatgacacaacaggagtgggacgcggcttctccttcatgtatttctttcttcttctcttcacaaaacccacacctctaccacctcactgatgccatacccgctaaccctgaggacttagtcacacaaagaaaagagccattctctctgctctcataatgtttaaatatgtttcacttagtccagaaactggccttaggagatttaacaggaaaccaagattgtggagtgtcctatcctgagtaggaaatgccgaacaattgatttacagccttgttgctgctggccagaccagcgaggagcccatcactcgagataactattacaaccagatatgctgacccgcataccctacccctcttttgtgctttgcccagccaagcctgtatactttagccttgataacaatatctgtgctttgcctaataaaaaaacacctaccagcttccccctgctgcttcctgcagagccagtcagaggaccctgtgcctcacctccactgtctcccttgtgcttgagcacaagccctgatttgaaagcctcatctgggaaatctgctcggctccatgttaatttccattacatgggaagccaaagagcctgcggtctgtaacagagacatccaaaccaaacacatcacctacactttactcaagtgaaaatgggtaaacagtgatcgtaaagatctgctattaattaaattcaagggtcaagaaatatcactctatcaggagcatagtgtgctcaacatttactcctaagtaatcatttgagcaatcttaaaaaagacatttatttatatgaaagtaccagcaggatttgagaaattcacagatacagaggaactagaggaaggagggaaattaagaggtgggcagcagggggtagctctaacaaaccaacccagtaacaaaaaccattgtcactttgctaggtttcctaacaaaaataaaaccaggtcagcgcagtggctcatgccttgaatgccagcacttttggaggccaaggagttcagatcacacgaggccaggaattaaagaccagcctggccaacatggcaaaaacccatctctattaaaaataaaaaaaaaatagctgggtgtggtggtgcatgagaattgcctgaacccaggaggcagaggttacagtgagcccaggtcaggccattgcactctggcctagaagacagagcaatattgtgtaaggagtgaaagtttttattttggggcaagtctgactcaagtcatcaacttaaggggaataaacagttatcgataatatgaaaatgatacagataatgataatctgtagaactacgtccctgaagaagtcaggtctctttttaagatctcctttggctaaggatcacagtaaaacattagaacatgttgactgggcacggtggcttacgcctgtaatctcagcactgtgggaggcgaggcggccagatcacgaggtcaggagatcaaaaccatcctggctaacacggtgaaaccccatctctactaaaaatacaaaaaattagccaggcgtggtggcgggtgcctgtagtcccagctactcgggaggctgaagcaggagagtggtgtgaacctgggaggcagagcttgcagtgagccgagatcaggccactgcactccagcctgggcagcagagcgagactctgtctcaaaaaaaaaaaaacaaagtaaacaaaaaaacccacaaaacattagaacatgttaatctggcagaataattaatacctggtgaaaaagtataacttaacataggagagccaagaaaagaaaaataggcttctgaagataaaattgtttttatctttgcactaccagatttactttgttcaacacaccacctccctaattccttcaaatgccaggattagaactagtgcaggaggatgttgatattttgacctaatagtttaagttgtttaaaaaaaattctccttgggagctcattagactgaggtacctctggcattttaaatttttacatgaacaaaccaaaggccaatgtaaacagtaaatggaaactagaaaatataccaatcagaaaccatcaacttcttttaaaaaatttatttttctttctctctgcctatcattctttccaccaactaacttccagccaatcaaaactgttctcttcgccttgcttctgcaaatactacataagagttttcccagctgggcgtggtggctcacgcctataatcccaacgctttgggaggcctaagtgggcggatcgcctgaggttgggagttcaagaccagcccgacaaacatggagaaactccgtcactattaaaaatacaaaattagccggacgtggtggcgcatgcctgtaatcccagctaacttgggaggccgaggcaggggaatcgctcgaatctgggaggcagaggttgcggtgagccgagattgtgccattgcactccagcctgggcaacaaaagcaaaactccgtctcaaaaaaaaaaaaaagttttccttcttgcacctctcatcagagtgccagccccttgtggtttggtacaaccctaatttatgcatccctgaatgttcaaactcttgaaaatgtatatatgcttaagtttttcttttaataaagtctattcagctaaaggatgaatttatgaggttaaaaatgtactccttcaacttaggaataacaaaaatatgtaaagacatttgcaagaaaattttcatattatgactaagaattttctccattttaaaataggcagatatcaatgtcctgtttgaccagaatctccttcccaggctctagccttagtctaaagagcaaaagtggtctaggaagaaatgacaacaatctgcaagcctgccaccaaaacttcaggtcgcaaagggccattgtaatgatttcttcaggtttctttgtgtatagctttaactcacagaggaagcaatgattagcagttatctaacaatgcaaaggaaacagcaagtgaagcctaagcagaatggggagaatagaggtgatggtgcctttcaacattattgcaacacgtttttaaaaagcaatggattaggcacttagcagagcagaggtttggagcaaaggacttccattttcctttaacacgtttatggttaacatctcctagtacaggaagaggtttattcagaatacatataaaactacctttgttaaatctagctcagtctttaaggttccttccacagaggaaataaccccaccaacctcggcaagatttctaaaattaacagtgttcagaacaaagatatcattttgtcaaaaccctgcattttagggatgagtcttggggaggtgaagtaacttgtctaggtgaacattgctacttagaaagcaaaaccagggtagcccgccaggatgcggcatcctgactgagaaaccaacaggccaatgtttcactatgcaccaaccaaagtaccagtactttactggaagttcttgaaatttcggtgtcacagaaattgatttctttgctatatcactgaataaaagctttaaacggttcacttgaatcaacattattaactagagaattcttgatctaatctctagcatcatgcttattcctcaaaaaaggcctcaaggattcagccacgcatgttatattaatccactcatgtgacattcacctacaacaacataaagaaacaacagtttgagattccgcctcatttaaacggtatcacgtagtttggcaagagatggggaagaaaagagtgtttatcaacatgaacttttacagatttatgttttaaaccataagttaaaaattagtactagaataatttatatttgacaaatatttagactcagaggaggactgtggaaatgtctgggagaactgaggcttaaatcaacattttctaatactgcacattccaaattctggagtacagttggccctccatatccatgggttttgaaaccccaagggtacccgaatacccggggctgattgtattctacttttaggaaattgtttctaaattagaaatcaattagaatctaattgattctaaaatgttacttctgtcaaaggcagagcaaccagctggatctgacagcaggaaggtctgcactgccccctcatggccagaagccttgctagtaactcttccaataacagacacccaatgaagagctgagctcagtcagacttcattaattttaataatgaatgccggtctccacgaaacacatgttcttccaaaacatattcagatttgcatcctgcccatattatgtgcttcagaggttgatacaaacattattatcgagaaaaagacaaagccacactctctctagaggaaatggtaagatttaaacacagaataaagaaaaaaagtcaacacggagaagggggttttaaagaaaataacatctataagctgaattttagtaggttaaataatattcttcagacgaggtcaatatgaaccataaagtactggaaaattcaattttcttaatttaaaatatttagaccaagaaaagcatttaagatatctcactaaaattaaaagcaaaacttctaatcctttccacagtcctttaacactttttttcaaatgaatatgaataaatcagagaacaagtgaggactacagataattaatatttgaataaaccattatgttttaatggccaagaaaacaagctggaaacatcaaagatgaaagtttcaaagaatacaaaacatgtaattccaactctgacaaggagaagcaattattacacctattctagaaagagccagagttctagaaagataacattaaatcccaggagcgaaccacgagttaatggtatcttattttttacaggttgggaagatgacatgagagggtggagagaggtggcaatggggatcttctaatcatcaaattagacatcctgcattttggatgaaagagtcagataatcaaaaatgctgtttacatgattagcaagaagaaataccagctgggtgcagtagctcgtgcctatcatcccaatactttgggaggcagaggtggaaggactgcttgagcccaggagttggagaccaacctgggcaacatactgagacattgtttctgtttcaaaaaaaaaaaaaaaaaaaaaagaagaggaggaagaagaaacactgatttaagggctaaaaaatactactagatacaagtaagatcaatgaaaattctgattaaaattggaggaaaacgtgtaactgtggataaaaatgggagaagtgatgcttaaatcaacattttacacatgtctattatagtataattaagttcagtaatttagggtacaagcctgtcatattattcagtttatttcatttagggaatataaatggctagtcaatgattagggtcactctgatagaatattctattctactgattttctcttagctctggtgttcaattttaagccactagataatcctaaaaatatctcttgtgagatattgggagcttggctatatccttgaacacatattctgtaacttagggaccacatatgcctcaaaaaaatactaatcatctcttaaaaaccgactataatctttaaggtatcatgtgatggcctactgactacagttctaccagtggccttttatactgttaactcctgcggcgtttgcaatattcaaaaaaaaaaaaaaaaagtgcttggccttctcttccacagatacatatcaagtaaaagtacctgtactgtgtgacaaacacagaggacagtagagaatcttttcatgtggtatctatgctggattccaacattacactacacaaccataattctgggtgaacccactaatattacaatgcctaaattatcatgaggataggtagtaggactacaacagagttaaggatgatgagctcttaatttcccatagcctctgactgcataccatgggtatactccacattaaaacatccaaaacaaaatccagagacgtctcttagtgctcttatagaagccaattttatagccatgttgagaattacatacatgctcacatacatttatttaagaatatgataaaccattctggtctatttcagcaggagaccgcagtcctgacaccacaggtggtctcataacactttcagtagaagccaacacatccctatacaggtcacattaaaggactttgaagacacgtttctctctaaagataaagctttttaaaaaaacagtgaggagtaaaaagccagatttgaagacttactggagccaggcaatttgctaatgacggagggggtcagactccactatgtcataatgtaagggggtgaataggaagccaacatatttcttaaagtcacactaaggtattttgccacctgtcccctgccatattttgaggggaacctgttaatgccaaagtctttcaataatgttatgtcacacagggatggggaggtagcagaggaggagggcagtggggagtggtgggagggtgaagaaagcctgatgtcactctcagtgggtctggatataaccccgagaaggctgaaatgacactgagatccacctcctgacgctctctctgcacattatcaagcccatgaatctccgttataatcatctccatctccagacctggagttctgtgatcctatgattctattattccatttttaaacctgtggagtgggagtgtttctgagtaccctgctcacacagatggtggtgggaagaatctcaagaatatgttgcatgtagtaaatgcccacttcactacgtaatcactcccttcacatttcacacgaacaaagattatattatcttcaagacagctgcaaaaacacgagtggtttcatggcagcatagcatcagcacatatatgtgtaaggaacatgaaagaagaaatttctcttcattacatatgcctggggctaaccactctaaacctgacatgaatgtagtataataggaccaggtcatacttgtacatcagctccacagactgggggctgggggaagaccaggggaggaaaggaaaaaggaactaactgaaagataaaatcatacacaatatctctgtattcctgatgttctaaaaatactccgcactgaaaaatcatttgtcaaggcaacctttctgagaccaaaaacaagatcgatgtgccaaacaacagtttcccacagtcatctcattttgagcacggctttcgcccatctcttccacaaactggctctttacaaaactgacccatgccacagcatctttgtatctggagttcaggtcccatccgtttcacctgatcgcacctgattctcttagaaccattttatactcctcgttactttctcagtctatcactgcacattagacactgccaaagactatccaattctgttgccctgccacacagctgtcaataaggttcaatgtggtatttctttaccttgttctccttagcagaaaactctgaggagttggaaattttcatggactttgacctgtgagactgccgccggatagaatcctcccgggagtatttcacggaacctgaggtcctcacccgtaccttgctggcactctggacactattcacgccaatcattttcgaaggtcaactaaggaaggggtttagagaaataaaaaggcactttccaaccgttccaaggctctcacgctggaggaactctgcggggttgtgcctgagcagctcctgagcgccgtgatccgcgttagcttaagaagcaccaggctgcctcccccagcatcttcaactaccctgtttgcagcgagtctgattgttccaggcacagctcacgtcactggctgcaaagaggaaaaaaatgcaatccacccctgctactcgtctctcttttccacacacacacacacacacacacacacacacacacacacacacacaccccatcatattcacacactggaacgaatggcaattggccaggcaagcaattcattaacattccaaaaagcaacactatttctcttgtgatatttgtgaagtaagctcattaatgtcaacaaccaaatagagataccacaaataaaagtctcaagtaatctccaaggcaccatgtggggtgggaacgtagctgaatttccacaaggaagaaaaaaaatatggatggacgtcaaaaggctcaattaattacaggctagtgaaacgatgcgagacacaaaggcatctcaatgatcaataattttcctttctttcccgtttcaggccacacactgtttgacagcaattcaaattatgttgccattctgaagaattaaatgtttcttatgaccttagactacgacagccagatatttcaagaggaattatgtcagtgtgtacggcaaatccagaataaagatgttctgttacctctctaggagactgagaaaatgactggggggttagcacaggttaactttcaatatggcacagagtgagagcaataaagctaactccgggcaacaagcagcaagcagcttttccaaaagccatcaatgttctgtcagtgtacacagcaatgtgcaagcctctgagtacgaatcacaaactggagattactagaaaacaagaccattttagctcctaacatatgaagtgagttttgagcatactactcaggattgcgatgtctcactatctggcatcccagggacagaggctcagccacataagcgtgttctccagataaaggaggctttcgtgttaatataaataacaaaacttaaacattgtttacaaagaccactctgggaaaaacgtcagcctcaatccatcccacccctcagatttaaacttttcctttacaactcaagaatgtatacacttttttttacaatgtaccaatgttcaaattttgcaacgcactggtgttcttgagcattatttgagataattaattttttaaaaaatggtttaaagtaattcttaaactttaattactaaagttatgttttaatgtcaggtaactgtttccctctactgtcaacaggcccagcagagggtgatgtttgacccttgggttttgttgcatcctcatgacaggggctttcttcctatatcctttacattttttttttttaacttttcatctcctatttttaaagcacttagtgcttctattgtgctataaagaagacgaagacattaatattggtaaaatgttaccatctaaaataataatagattatttttggaataggttttggaagatcttggggactctcctgtcctttgaggtacattttcctctcttcttaggaaactgaagctaccaaataactgtttctcagaattaagaaaaattctgtaaagttactattttacaaagcatattccaaagacataaaaagtggtgtactatagcagtaaaataaaatcgatcatttggaatagacttagttctaacttaagcagacgacgagtctacaggtaaagatctccagttaacaaaagtaagcttgaggtggaacccagtaagaaactaataccataataaagataaaaattcaaaatgtcccgtgtaaaagacatgagcgcctgcctctgtgtggggataaagacagtgcacgggcttaaaagaaacatgccctttggatatttgtcagtcatcataatgaggagttataaactatctcctgatgaactttcttttctccaccaaaatggttagattaaaaaacaaacaaacaaacaacaacaacaacaacaaaaactaaaaccatatggtaggatgtacagaaatggaatctgatacatgtcatttctgggaggtttagcagaaggacgccatctttacccaaagactgcccaattgacgttactcctgtactgtctccactaataaccactttcatcgatctgtttaacacctaataccttacagaagccacttgttctcttgttttcactctcaacatgacaattctgcgaagtgggttgaggtaatattgcaatccccactttcctgatgaggacgctatcacagagccagcatgcagattctcgcatgaagtataccaggaaccacgctgtgtccctcacactatagctgtctgcattgccctgtcctttttaaacctgccatgagcttttctgcaagtcagggagagaaagttttcttctgctcctgccttttactctctgttgcagaacacgtatttctacgtggacagagtgaagagaactcctacaatgctgctagcagtctcacagcagatgatccctgcgacatatctgagtatgtctcaagaggtacctgaaaaagctgtacagacctcagcatccaggggcccttgatgctcaggcctcatcctactgacctaaacttaatcccaaccgcttctcactcttcttatctttgtcagtcaggcctgactcttcattccaggtgagtgcgtggcactttagcttccactcagcccatgcatggaaggcaagcttgcctcctttctgaagctttcccgaatgaccctccatctgctgtcatcctgtctggaactctgttgccccatcctgattcactactaagctggcttctcctcattcagcagtcagctcagtatctttttccaaaaggaccttctgtgaccatccttccttaaacagcagcccagctccaccctagtcattcatttgccaccaaaacccctacttctgtgacttcagggcactcatagctgtttgaaattacctgcatctcagaggccaaaacagaacctggtgaagagccggagctcaatgaccagctgtcaaataaaggaactactttaaatatacaagtttcccttctctatcggctctcacgtcattcaactttcttttaaagaaaattcaggatgggtgcagtggctcactcctgtaatcccagcactttgggaggccaaggcgggcggatcacatgagtccaagagttcaagaccaacctgggcaaaacagtgaaaaacccatctctacaaataatacaaaaaattagccgggcatgatgatgagcacctgtggtcctgactacttgagaggctggggtgggaggatcacctgagcccaggaggttgaggttgcagtgagctgtgatcatacaactgcactccagcttgggagacacagtgagatcctgtctcaaaaaaagaaaatttagcagttttttttttttctgaaaaaatgaatacaataaatacgaaatgatttcccccctaactatacaaaaaagtatgaagtgaaatttgtttccttcccgtaccattttcctgttcagtccctctgcccgaaacaagaactgttcccagtttcctatgcatccttccagagataataagccatccacgtgtgtgtgtccacgtgcgtgtgtgtgtttgggtttgtgtgtgtgcgcttgcccatcccttttcttctcatggactataaatggaagcatgatatatatttttgctatttttttttaagatggagtcttgctccatcgcccaggctggagtacagtggcatgatcttggctgactgtaacctccgcctcccgggttcaagtaattctccctgcgtcagcctctggagtagctgggattacaggcacctgccaccatgcctgggtaatttttgtattttttagtaaagatggggtttcgccatgttggccaggctggtcttgaactcctaacctcaggtaatccaccctcctctgcctcccaaagtgctgggattacagatgtgagccactacgcttggtctatttttgctatttttatttatattttagagatagggtcctgttctgtcgctcaggctggagtgcagtgatgccataatagctcactgcagctatgagcaaagatcctggactcaagtgatcctcatgcctgagcctcctgagtagctaggactacaggcatgcacctggcacgatcacgtcaggctgtttgtttgtttgtttgttttggtagaaatagggtcttgctatgctgtccaggctagtctcaaactcctggtctcaagcgatactcctgcctcggcctctcaaagtgctgggattatgggcgtgagccactgtgcctggccttcttaatatttcttgctcttttaacccttatcaaaatcctgttacattatcacatacaaagccgccttactcttgttaatagcagcatagtattcgagcatgtgaatgtatcatattgtaacagggtcttattattgaacatttagtctgcaatcttttgctacaataatgatgcagtgaataatacccctgcaatgtatcacatcctaacattgaaacaacatagttttccaattgttttctgaacaagtcttattttcttcatcctacattatttcttatcacccacaatcatggtgttaggtacatatggggttcacaactagattcaatatgaaataatcacttcaaagacgtgttggatgaccctgtcctgccccatctggctctgaggccttgaccatttatagacatgagccagcctgtacagagacagccgagccggcttgctataaaataaaagcaggcttcctggagagaagcagctgtttaaaggtacaaaataactttccacaaaagctttagcagaaagtgaaggtgacttccataacaaatcaaaatagcaggagacatttaatgaagcaaactaattaagcggaaggctggaaactggtgcttcaccttctgatgctttctctaaggacaccgtttggtagataaaccctaaaaggcttctaacaagggacctagttaatggtcatcagaaaaactcaacctctcaaaagagtaccagagaaatgaactcaatacacttctttgctgtgtctactaggtaccagatgctggggacacacaacgctgataccatcaggcccctaactttgagcagctcacattcagtcgggggtaggaggtagagagaacaagaaattctgttgccataattataatgatgaatatcttcagagtatcaatgaactgaaaggctttcagatcccaagtgaaatcaacaggagagtatcaaacggcacccaggcagacacttccctctttgctaagaaaatctcacagaaccattagtagaaggaggtgaagactgaggtatgaactctggagaaaagctaaagtggaaatgaattataaataccaattgtctagaggtacaattagcaggataccaagaaggactggggagggaagagaggcatgaggtgtcaagaggaactcagcctcagcctattttcagaacagaatggcggttgtaacactcagttaattcaaaaggctctcatgactttccctaggttcctcacattacatttgcttgtactgaaacagagtaaagtgacagaggctgatttgggagtgacagggcaggggcttgccaagattttctgtccatgtttgtcacgtagcccaacatattcaagaggctagtgctgctgttataaagatgctaatgattaattgtttcctagactattcatttggacttattattagagctgggagaggcctcagcaagaatcatcttcaatctcttcattctatagatgactcctgagacacagaaacaaagtgacttgtccaggagctcataactatgaagtgaccaaactgagacttgggcccaggtttcttaattaccaatattgaggtttctttttttcctcctatgctatttgtttcttgaaagctaaatattccacgaacacatatctcttcagactacattaaggcctgaaaggttatcttgaaatggaaagttcaaggctgggagactgactctagaagtgaaatagaggccagctactcataagaactacgaaaaggagacatgaaaggacaaaatcaactgtaccaatagcgtaggaactggtcttggagtcctgaaacgtatgtgacagctccctgtccttgacctggcaggagtgaggtacgcaacctttcgttctctgagtgctattcctttccatgcggtaacatgactacaaagcaagttaattttgcagagaacgatagctactactgttaaggatacataaacacacaaggtatcatgaggaaaacagatacattggatcaaaacgtactgctttatttttcctgtcttcttccaggcctttccagctaatacttttctagtctagggatctattttgaaccccagcagatggtggcagcctagcttcttctaacactctacaccccaggacaggattcttatcccctagatggtccagccacatgaggcctgatacaggctccactgcctgacatctgagcctgcaccagaaccctgctgccatgtgtcactaacctaccaccttgatggacacaccaccgctttcctaaacgggactcagaccctttctcccagaataaacacttggcccacagtgccgggctacctcttcctcgctgtctggtccgtcacccttcgaccccagcctgctgaaccagcttcagagccccttcccttgatttcccctgccccttctcagaaaggtccaataaggcttgccttcacccatctcaattggacataaaactgcaaagttttttctagcagtggggctacggatttccttagtccataagacatcactagaatctaagctaaatcaaccttaatgaacaatcactataagaattggcggttaggagtaaaaaaaaaaaaatcctatgatttgtacaacctatgaggacgcatcacctcactccagcagccttcaatcttcctggagcatcacacgcttttgattccatctgttcctcaaacatacaaagcaacaggatggggggaaaaatctttaaatagaacgttcttacattgcaaatgaaataacattcttaaggcagggggaacacccgtataagttaaacagttttgaacctggaaaaaaacctcattttttccccctcatgaacaagaccagtcatgtaagatgttttagaccagagtgatgcattagatttgctgtttagaagtacggacaatgcagaacaaagacggcctctgtgtgttcacacacttaactctgtatagctgacaatgccacagtcagctcagacctttccaaccatcatatggaaaacaaacacaaaactgtgaagctacagggccttccggagatcagaaaaacttaccctatatacctgaggcattataaactcttctttctgtgctacaagaaggtattcttaattctagcccaaagtaaacacaaaatgcaaatacagaaatgctatttcacagcctccaaagctgttcatccagatgagtaaaccaataattgtatataaaagggtgagtgctgagaaaatactgtttcaaaagctaatccaataagcccgtccataattatctctaacatctagtgtcaactcaacaaatattccccaagtgcctaatacatgccaatcattgaatctaggaggcaataaaatgatcagagatccctgcccttgtgcttcacatcaaagacaaattattctctaagtaaaaaacaatgccagtcgaagtacatgaccctaggtgcattttttctaaaaaaagattatttgaacagagacagagagggagccactttttgctgtctcattttcatttatcaaaagtcctctaaaattaccaacatttcatttttcatttctttgattagtttgcttggtagtctgggtcacttatgaatttctatcagtccttaataatgtcaagccatatttagtttcatcaaaaaagggtgaccatttggtacaatgtaagagtaactgtaagctctatagtgcaaaagacaaaacatctgtttaaattctgttcaacattttaacttccctcattcactgtgccaggcatgaggaataaaatattatgcaaatccagagagattcctcttcccactgagctgacactgagatagacattaatcaatcaataagtaataatcaaataatacccaaaataaatgtaaaacagtaactgtgccaatacaatggaagagaatcacaaggtactgcagctctggaagtctctgacagcaattggaatgggcctggccttaaggaagtctgggaatgcttccctgaggactttagaaaatgaggcaggatctgaagaatgaacaggagaaaagagggaacagcagtctgtgccaaggccctctgacggaggggtaaaaggtaaaagcaggagcaaccagaagaaaatcaggccataatggagcgggagctgagaaatatatttaagaaggatgatgagaggcttttttaaagatgatgaaaagctatcaaagggactttaaaaagtagtaacagaacctgattggaattttgaggggattattcatttttttcttcccagtaactgatgtttggctagctgcaagaattgtcactttgggcacattttctgtaaccaaatgtatcttcggcctttatattcaaaagggcagtaaaccaaactgcctatattatatagatgttattttaactcctcactggataaggtctctctgaaattaaaggatggagtacagatagttggggaacaattaaaattcaaactttaataccaaagctaagctctggggctgcagaaattcactaccgggggtagaatgtccaggtgggagtttggactggtactagctcaacctcaagtaaattcctgaagggtttagaaaaatctgaaacagacgctgacatatgtgaaggccgggctacataaaacatggagatgatgaacttctcaaatggagcagaacaccacaaaatttggagaagacagggctatttcaaacacatttcccccaactgctggttgtactgctgctacccctcaatgagtagggattctatgaatcagaccagcttgacacatacgaccttaaatacaacaaacaaacccaacagatttgctatttcatactctgcctcatccaaatttcaatgtggccaagccccaaatcatggtttctaccaggtcaacagcacataaggcggcagcaaagcgcaatggctatgagccaaacggacctgtgttcatatcttggctttgtcattgactggtcagtgacattgaataagttcctgaaattctctatatttcacttaaaaacagggggaaacatgctgtattaaaatttgttgattttaggctactcaccaaaacaacatcctgctttagcggaaatcttcaggtattccctgtccctgtaagctggaaacaaaggtataagccatgtgacctaagcccggccatatgatgctctcaaaaaagtggcgtaaagactcagagtcggtgacagagcccccctgttgcagttgtggtggcaactgcaggctactagccccacacttttcctacggaagcaacgtggcactttcctctgcactcagcctccttggttcaagtctatttttctaatatgatcctcaaaatagcctcctcctccattctgtgaactacctgatgacctttcaatagattcctttttactcttaagttattaaaggtcagtttccatgtttttggagccaggaatcctggctattacaactgacttatattagatggtgcagggcaaacagagatgaagcattagcatggcatctgataggtaagtagtgatgatgggtagtaacactggaccctgaatgctaggaaagatctgaaaaaagaatttgggatctgaaaatagtcctgtccaagtgtcatgaaacagtaaggtaactagagcacctcaagccagtgttttgtttcagtgacaaagattaagaagacactggtacctactcaagcctgaggcaccacacagtaaatcatcatcaataaaatgttcctggtcccttcaacacctgcccaccacacccacctgagccctaacctgccagccaactctcctcatctgctaccaccacactgttccctaagcctgtggagaaaacattctacaaaactcaaattaactaaattaaaaatgaagttccagccaggcgcggtggcgcacgtctgtaatcccagcactttagaaggctgaggcaggtggatcacaaggtcagcagatcgagaccatcctggctaagatggtgaaaccctgtctctattaaaaatacaaaaaattagccgggcgtggtgctgggcacctgtagtcccagctacttgggaggctgaggcaggagaatggcgtgaacccgggaggcagagcttgcagtgagccgagatcgtgccactgcactccagcctgggcaacagagtgagactgcatctccgaaaaaaaaaaaaaaagtgaagttccttctctagatggaagcttctttcacttcttaaataataaattaaaattattctgataggctgggtgcagtggttcacatgtgtaatcctagcactttgggaggccaagacaggcggatcacttgagcacttgagctcaggagctcaagaccagcctgggcaacatagtgaaaccctatctccactgaaaaaaaaaattattctgataaatgaaactgttttcatgtggtagtactgattcaagggatccttggagctggccaaaggtatggaggaaaattatagcataaaaatactaactcttagatatttaaaaaaatctaatacatttttatataagaaggaaacaataaatggataggaaaaaagaccctctaagacaggaagggaccagagttaggctgtgcaattcccaaattctctaggggtaaaactactccttccccttctactagggatccttagccttctagacttttagactaaagatccctagcagagggagaaagcttccttgcaaagaacagcaacgacaaaggcctgatgagagctaatgttacagtaatattgagatcacaacttgggctggctatgtgaaggctgacaatctaaatgaaatcttaatctctctcagaggaaactgcagacacaacagtcattgatacctgtcagccccaaatcagccttgcagacataaaagtgcatgcatgaagtaaaaagataacagcatctttgatgcctcctgtcatgtcataaaccaaactaggtagtatatcaaatactgtagaaacaaactattagacttcttccatgtatgccagaagacccctgaaggattccatagaactgtggataactttgatctattcccccttaaggggcatttttattatgtaataactgacacatacgaaacaatacatataatatttacacaagatattagaaataataaaaaacacccttaaacattcctccaagtacatgaaacagaacataaccatcaccattaaacttcttgaggacaccaatctcaacggttttgctcttcctgggtatatacacataccagaaaataattttgcattatcttgtaaagttgaatttatctaccttgtaacctcacagttcttttccaaggactacactctagaaagaccattacagaaacttggaacagatgagttaaaaaatgttgtctgtaacaagaaggagtatgaaacaagtcaaatggataaattaacaatgataacttcatgtgaccagaacagtaccctctctcatgtgtaatgcaagctggtaacaggaacggggggaatgcacattcctgggtagactctgtgctgagctgcccagacaccccttcaggaatcaagggcacatccagcgtcacctggcagctgtcgctgagaattgccctgagatgaaaaaaggtgcctggcccagggtcatgggagacaggacctgcatctgaggatgtgtcaatgcctctctagctttctccaccgacctccggtcccagagctctgcaaggattcacagaggcctttgttgagatggcattgccgtccgttcctctctgcccaatcctgcttcctttccacctcctcctcacctccatacgactcagtctgttccccagggaatttcatacaggccggaaacttcacattatctcatttaatacgtatgacaaacactattagatagatattatcagtcccattttatacatggttttagaggaagtagttaacttgtctaaagcttttcagctaagacaggagcttggattcaatgttgaatctacttggatcctcaagactatgctctttcaattactctgtgtggcctgttttactaagcagcacgttgctcagcttgtgttaagatacattccgaggagcaaataaaagtgcatttcttttaaattattctttaattcagatattactaattgcattttccccagaattacaaaggtcttagtacattataataagtatcacagtcactcatcaagatatgatgagcttcctagcttgtgaatacaaataagaaatactccatttttactgcactagttctaagatatctgattctcataggataagggagcagtagtgtgcctcaaatcggaacatcattagagctggggaaaagtatagaatggtactgtccaatagaagtctataaaagccacataataacttaaaatttctagtaacctcattaaaatgtgtaaaaagaaaacaagtaaaattaactttaacgatgcatcttgtttgccccatatatccaaaatgttaccatttcaggccaggcacgttggctcatgtctataatcccagcactttgccactttgcggggacaacgtgggaggatcacttgagcccaggggtttgagaccagcctgggcaacatagtaagactctctttctattttatcaaatttaaaagaagttatttcaacatgtaatcaataaaaacaatgagatattttacattattttttctgcacgagtctttgaaatctggtgtgtattttacactcccagaatatctcaatttggactagccaggtattaactgctcgacagcgacatggggtgagtggcgacaatactgggtatcacaggcaagggggagagggtaggaaacaacgggctaagaatgagataagagaattgtcagtacttttaccatccactcctgactggccaacaaaagtacctgacaagtgataagactcaaaacattttctcttaaatatggagcccatctccttgacagtctatgtaaacaagagtgctctgcagaacattatagaaaagtgtttcttttatatacagtattaaggtctgaggtccatgattcactaaaacatttcgttgctatcagaagtcaacttgggaacattttatattctagaacattattgttacttaaagaaacaaaatgctttaaatggagttctaagaaaagaacatggcaccttctctcctcctttatcttaaaatccccagaaggtcccaaagctctgcctgtgattgcgtgaattacctctgggcaagtatctatcaatttttaggggtcctagattcctcatccaggaaatgtgagtgttggatgaaataacctctccagttccttctggcatcaacatttcgtcactacacagcacagtctgatcagcaaattgttttctgaaaagcaaacaaaaatccatttcatcgttgcatcacttttctctgagaaaaagtctgtacataatttatctattgtggaaagatgaataatggtccccccaaagatgtccatgtcctaactctcagatcacaagatttttatgatactctgtgaatattatatgtcaaaagagaatttgcagatgtgaataagttaacgaacttaaggagaagagattaccctgggttgtctcagtgggcacacaggatgtatttttgttttgttttttcagagacagggtctcactctgtagcccaggctcaagtgcagtggtgcgatcatagctcattgtaacctcgaactcctaggctcaactgagcctcctgcttcaatctttcaagtagctaggtctacaggcacatgccactatgcccacctagttttaacattttttaattttttaaaaaaatttttgtagagatgaggtctcattacgttgcccaggttggtctctaactcctgggctcaagtgatcctcctgccttggcctcccgaagtgctaagattataggtgcaagccatgatgctcagcctcacagcgttcttacaaaagaggttggaggttcagagtcagagaagacgggatgacagaagcagaagggaagaagaggtttgaaggtggagaaagggggtcatgaatcaaggaatagacagctcttagaagctggaaaagacaagcaaaaagattctcccctcgagcctccagaaggaatacagccctgccaacccattttggacttctgaccttcagacctatgagctaatatattgtgttaagacaacaagtttatggtaatttgatacagtagcaatagcaaacagatatacctataatcatacaagtaacatccaagatggtatatctatgtggcttctttgtcagaagtaggtgtattgatttccaactaatctatttaattaggattaaggagttctgtgttagcttttatatgcaggaacaataatatgtgagataagtttcaataaaaaagtactagctttttctagaaaatatgtagaaacactatcatttaaaattaacattaatgagagatagtaaatctgtattaatattaatcatctgaagacccaaagatgaaaccccactcaaccaggctcataaggaaatgaatgaaaaggttacctggtgtggcagagatgcctgtttgtccacctaaatcccttcttcctcccatggtacagggttgtttctgggaacatccagagactgcttctcagcatcccttgcaactagattcctgctaaggaatgtgagtgaaagctatgtgtgccacttccaggccaagctttttaagagccactactcattttacttttacaggccaaatacagaaaaattcataagtccccgaagatgatgatgccacaaaatggaaagaggctgctgtatttttgcaaaaagaagcaatctgttcaccaggaatatctagctttgacaaccatgtaaacaagaaacaaacttatactgtgttggagccagtcaacaatttgagatcatttactacagtaatgtagcctactcagatgaagacacctagtcacagtcaggcaagacgacccaacatttctttcttgagcttattttcaggttgataacaattcatagagtgtagtgaaaactggggacttatattgaatgagtttgactaaccttctactcacttgaccgaatactctatatgaaggatagtgcccttagaaaatatgtgctggaatgtctgtcatttctggtaaaaatttcaggtagcgtaaagactgctgggcaatacaggaaaaagaattcaaatgatataaaaataaattaattataaacttttggataggcatggtaggctatagaatggtgggtggtcacactgggagaatgagcagttttagttattaccagtatttaagccaaagttcattagggtttttcgcagtaacacacattgtacaaacaataatgagatccccacccaaaaaaaaaaaccacaaaaatcaagctgcagattccgctcctatattttcctttctttactaagcccattggcaactgattaactttttgaaattattctcaactataaattctaccccatcagcagttaatcaacaataaaattcctgggaaaaaattggtaatgtgaggcttcctcatttgcaaggacatttgaacagaatcttatttcagtcaaaccttattttcattttcctaggccaagaattagagaaacagaacctgaaattagcaaccatcttttgggactgttgtattaacattaaagataatatacaatataaaaaccaaacccagacaataatgcagcaactttccctgtttccctttaaaaacagacctcctaatcacttaattagatgtactttaaaaggtacataaagtccaagaatttatcatatcggtggccaaaaataagaatattttacagattcctattaatgagttatctatacattattagtaataggaaaaatgatgtactttctagagtacggttgtttcttaaggatcaagctcttaaagatataacatactgctgaaatagtgtgaacactcgtgagaggctatctcccatgcttaaacctttctgctccacttctaataacctgaaaacaatatttgagaaaatcaacaatgtgcttccggagctaagaataagcataagcacaacatggtctcttagcagacatactgggggaaaaccaggaacagaagccaagcctcgagacctctcaactcaaacaccaatgggtttcacaccatcacactgaagaccaatacgtagaatactgcaacttccttttttttcagtctttttctttcctttggttttttctttctttccttccgtctaggggtaagcaaacagtagagtagaaaggatgcaggactaagattcacaacatttgagtgaacctgacgcaatgccaccatcctgtgatacagccttggaagagtcactttacatctccagacctcagtttatatatctgtactgatgttataatctccaaggtctttggaaatttaaaactctataatttcataaaacaatattttgtgtatttatttattttgagacagggtgttactctgtcacccaggctggagtgcagtgttgtgatcatggctcactgtagcctcaacctcctggcttaagcaatcctctcaccccagcctcccaagtagctgagaccacaggtgtgtgccaagaagcctggctgattttttttttttttttctgtagagacaggatcactctatgttgtccaggttggtctcgaactcctgggcccaagtgatcttcctgccttaacttccccaaattctgagattacaggtgcaagtcactgtgactggccacatgaaacatttttatcttgtatactgtaagtaaaatagttttttttggtcacaagaaatgctgtgtctcttgagttggtataaataatttcaaacacaatacaagtctcattcagcttgctataaattttaaactcatatacagtaacctatttcaacaagcccctttatgaagcttacacaattgaaaacatactatgtatcaagaaaccttttatacagaatggaacaatcacatcgtttatcaatagggtaagctgaacatttatattgcagtccagttaaaccaaatgtgtatgtactagtctcatcatttaagtgaagtcttccattgttgaaggaaacaaaaaagtggcttcctagtagtgcagagtaagttccaagatgtttaaaggatatatacacgtgcctgtcaatgtgaactttctttaaatgcactgatttatgcagtaatatttggagtatgactttaagtgaatatttgctttaatatttaccaaatataagagctttacaactgcatagccatgagctttcctgagggagtaaaaatctacgtacaaagtagagatttatgaacactatttcatctcaggttttttcaaccgacaaaaaaacatgaaaatatcactggtgtgaaatactatgttcacaggaccatttacggctcttgggatttttgcctacaaattatgtgaaattacatgaaagagctgaaaacaaaaaagaagcaaaaacaaaacccctttaagagtgcattcgtttcagcattttacttcccaaggcagaatgttttcccaggaatcctgggagtgacttcagatactccgactgatatttacagctgccatgtatttacaccaataacttgtccatctgtagaggaaggctgaaataatcaatttgtaaccgacaggtctttctacatgtttaagatcatcttgaaatatattggaaatgtatctctcagatccacattctcccggatgacttcaaaacatcacctgattttggtgatggaggaaattttttggtgtgtgtttatgtacataggtaacctactttatgggttgttctaagagttatgagatggaaatcatgtaaaatgttagcacatctttggtagcacatctttaccttaattggtactgttttcccctttttgtattgtgaatcatagttgtacgtactttaggggtatgtgtgttcttttgacacatatacacaacaatgtgcaatgatcaagtcagggtaactgggatattcatcgccttaaacatttatctttggtttgtggtgggagcattacaatttttctcttctagctataggtactctttctttctttctttctttttttgagatggaatctcgctctgttgcccaggctggagtgcagtggtgtgatctcggttccctgcaagctccggctcccgggttcacaccattttcctgcctcagcctcccgagtagctgggactaccggtgcccgccatcacgcctggctaaatttttgcatttttagtagagacagggtttcaccatgttagccgggatggtctcgatctcctgacctcatgatccgcccgcctcagcctcccaaagtgctgggattacaggtgtgagccaccgcgcttggacagctataggtactctttataagaggcattttactgctttgtgtagtgcctgctatagccattttcatgttctcctaaaatgtctttctccatgtcttttctggtattatcttgatttttgtgtttttctgaggcaagaactgtgaaaaatcctaatgggaggaactctccttatttgagagtgtcgagagctgaaggaaatgtcttaactttttggttaaaaaaggaatacaagaaaaagaaggcaacaccaccagcagatgccactgcctcgtcacgagggcttttctccccaatgaattaatagtctacaaaggggcagaagtttccagtgcattctgcagctgtaaaacacactgaagccgctcagggaccaagatgcaaatgagcctgccactgatgaaccaatgtctcagcaagggccttcagagacttacacagagaggtccccttaaaggtatgaaaaggtgctcattaagcacttttaagacgtcgaaattgaaataactatccttcagttcttcattatcactaggtggttggactctgaggggatcaagcatttacttttcaaggaaaagtttaaaccaaactcataagcacacaaacctctagaaacgtaccattttgccagtgaaaataaatcacccagagaaaagagatcccatatagagaattcccttggacatgaaattctttgttaaagtaaataacatgcaactgacttccacagaagactggatgactgcagtacaatggatgctgttaatatttccgagaagatggtggctaacctttagttgtttattttttaaaataagtaaaataacatgaatatgttgctaatgagaatatataacactaagcctgaaaatattcattaagccatgaatagaaatggatacagctgaatctcaatgctatcattttcataatttgtcctgaagtatatttgacaatgaatttcacattaaccaaagtgcttttaaccctgaaactactgcagcatcactgatttggtcctaaaattgtggcattgattccaaaaagcagctgatccacgaaaaagggaaaaaaaagaaaaaaggaacttcctggcagataagatctttaaaaaagatgccaaaaagatgaaaaagcaagaaacaaagcaaagcatgatgtaccaaaatgctactttccaactgaaaacagatacatttctttcctctctttaaaacgctagtagttctttagaccatttggcaactaaagggtaagaaaaatgccatagcttcacacaaccctttactgaaataagaatgtgctttactctggacatttatttttcttactagactctaaatgaagaatctccctttactagaggaccagttctagcaagatgaacttacacaatggggaccttaaactccgtgtataaaggaaaataagagaacctttttttgtgagacagagtctctgtcgcacaggctggagtgcagttgtgtggtctcggctcactgaaacttctgtctcctgggttcaagtgattctcctgtctcaccctccccagtagctaggattacagggacgtgccaccacactcggctaatttttgtatttttagtagagacagggtttccccacgctggccaggctggctggtcttgaactcctgacctcgtgatctgcctgcctcagcctcacaaagtgttgggattacaggcgtgagccaccatgtctggccccaataagagaaccttattgtgagtttccatctcagttctgctaagttgctgagacacttcctatctagttctattgctttgttcttttcattctgccttcctacaacattcatgtctttgtccagcttatgattaaaaactgaaagtagaaaaataatatgttaaaagacaaaccagcaaaaatataagcagcatatacgacaaaggtaataataatgtttaaaaaaaataaaaaggttttggagatcaactaagaaaaagatgaatatctcaatttaaaaattggaaaaaataaatgggcaaccccaaaatgaagaaagcaagttttccataaacataagaaaaataaaaattaactagtaccaaaaatgcaaatcgagacaatgagtactaatttcatcagtcaaactggcccagaaatagtatggaacacccttcctagatgacaatttattgtattaataatacaaataaaaagcacaaaaacatctgcattcattctttgactcagtaattcttaaggaaatgaaaaaatgtttagttgaagcagttgttgaaaataacaaaaaatgaaaacaataacaatgtctaaaaatgagggactaggccaggcgtgatggctcatgcctgtaatcccagccctttgggaggccaagccgggtggactgctcaagctcagtagttcgagatcagccagggcaacatggcttaagacggtgcctatacaaaaaaatagaaaaattagctgggtgtggtgtcgtgtgcctgtagtcttagctacttgggaggctgaggtgggaggatgacttgagcttgggaggcagaggttacagtgagctgagaccgtgccactatacttcagcctaggtgacagagccagaccctgtctcaagcaaaaaaaaaaaaaaaaaaaaaaaaattcgttaaataacataaggcatataaaatgaaatctagtgtaaatattaaaattctgttgaaatacatattgatatgtaaagatctttttagtatattaataggtaaaaaagaagaccacacttaaatatgtgttcatctatatctatattaaaaaagtcttaaagaaagtgacataggctatgtctgggtaactattctttggggaggagttgagtatattctgcctttggaggggaatgagtattcgtgatcaagaaagtggaatgtggttgttgtattgctatatacaaacgtattttgtatgtggaaaaagaatatttgtgatcaagagtatcaaaaatactacttttcacaaatatctactgcatatcctactcccaaggtttcccaaggaaagcttcctactccattgatgttgaccacacccatgtaacttgctttggccagtggactatgaacaaatagggcccatgtcccattccagcagctttaaatgcactgtataggttggctcagcgtccagttcttcccttccaccacaggaagggcttgtcactgagcaactgttatttcaaaatggatctcccaacgagaagacgcttagagcagagctctgccacagccgttctgtagccaccaaaaagtaattgaaaagggaaatgaatacctgtttcaacccattaagattttagggttctttgttactcagaaaagctgtttagtaaatacacaatgcaatattgtgctgtaaattgtcattatggaagaattttttctcgttttgcttatttatatttcctaattgttctattataactatgtattacacaaacacacattggttaaaaaaaagaaaaccttaaaacaacaggataggtcaacaaactaaaaggaattgattctaacttgactgagtcatttcaatatccaaagaaataatcattgttcactatttgtcagccaaagaagattagcaaaaaagccatatagaagagcactggtggtgcccatccatgcacaatccaggggagaaaaagccttagctaatgggcttggatatatttttcatccagctggcaatcacctagcaaggagatggatatagaagctgcatctaatgaactgtgaggtttgtggacctttggcaaacacatcctcactggaaatggctacatcaagctgcctaagcttcatgacattaaacagtcaccacctctagcttcctttgtcctgatgccacaccagctaagcaaccttctgagtataccatattatatggtttcttagttacctattaggaaagaatgtcctggttaaaccagcttagacagcatttatttaaattaataaactggcatttaaatttaatttttataagggaatgagggaagaaataggcaaagattcttgactactaagtcaaattctcatttaggaaatcaggattttccatactgcattctatccaatgcaatcttgactacttctcatttgcaattccatgttcctattacgcttattcccattcagctgccactccacacatgtatacacatcatatactcactctctcgttgtgctgattttgcatattcttctctgcctgtccaaatcctacccatccttcaaaaacgcctcaaagctcaccctcttcccctttccagaaaacctacccgacaattcacaacagcagcactacccctttatactgctctgctcctgtgtcaagtctatgagacttttctagatgaatatcagctccttgaagttttctatacacagcccacagcaacaggtaagtagcagattctcaagaagtgttcatgaaattgatttctgactaaattaatccaacagcttcagggcagggcttatcctacttatcttggcagattggaggattgggatttacagttgacagccccacaacacacacacttgctactactgccaggcagttctgaatactttttaatcaatgatcttataaaaacaaaaagtgcaagactatgagatagatattatcatcactcccatgttccagatgagacagcaaagctcatatgactgataacactcttgaggtcagaagtggtacggctgggattcagggcccatgtttgttacctcctgccaattttagctcattataataaaataaggctcattagaaacatagtaagctaggaagaaattcttatacttcttccccgaagagtacagtctgagatggaaaagtttgggatgggaagtaagagacgcaaaaaggaaagcctgaatcaaacagacagatactgatgtcttccacagaagacaggtcacaatgactgcagtatgtggccaagtaggacatcaaagtttggggctagagctgaattgctcagggcaacagaggaaagattaggcaatgccacctacatttccttctctgctcttgtaccaggtaataaaccaccttgcttttaaagaaatgttggccaattatgtaaagaatatttattcacaatctcggcagaggtacccagtctgatcctggagacaggggagaaagggaaaacagacagaggaatcctgactaatttacagttttaatggggctcactttaaacctcagacttactctttcttccttctttacacatatggcaaagaggatataaggataaagacaacagaaaaaccttccttttctttcttaggatttagggatgagagtaacagtaattcctctacattgtatggaagggccaaataagagactgtggtaaagcacctagctcaatacaagggtgattaactgctctctctccactttccacctatgtgaatactgaatatagcacctcatggcagctctaggcctgggattgaaaaaaaaattagaaaattttttttttccacagaaaaatttctaactttcagtcttagcagtacctctgagtagagccatcacttataagttacagaccacacagctgtctctccgtgtttttccaaaagtttttactctaaccttctgtaacagacaacattttcgtcatgacccagtacataaaagatgcaaatatgcataataccctctattttctactgcattttaataaaagaaatgctagtcaagaaagaggtcaagatggcctactagaagcagctctcctctgtggctcccacccagaggaacaaaaacagtgagtgaatcctgcaccttcagctgagggatccggattatctcactgggactaatgaggtggttggcgtgacccatggagagcaagaaaaagcagggtagaacaatggccaacctgagagccacacggggtaagaggaactcccacctccagtcaagggaggtggagagtgatcatactaccccaccagggaaaccacgctttttccaagtatctatgcaacctgcggatcaggagatccccttgtgaacccacgctaccagggccttgggtcccatgcacagagctgtgcagactctcagcagctgctcgggttgtggacagcggtagcaggctggagactaagatgaccaagttcttggggaaaggggtggctgccatcactgtggctccaattggccgttttctcctgctgatgccagggagactgggcagtttagaccaggaggaattccccacagtgaagcacagcgactgtggcagatcatgggctgacttctttaggtgggacctgatccatccctcctcactgggcagggtctccccacatgaattccagcaactccagccagggatttaggataaaactcttgatccctgggatggagcccctgacgggaggggcggccactgtctctggttcagcagatttaatctctcccgcctgctggctctgaggagtctggtcagctcagaaaagtgggaatcccctcagcccactgcacctgttctgccaaggggcagccaggctgcttcttcaagagggtccctgatcctgtgccccctgactaggtgaaacctcccaacagaagtcatcagacacctcatacagcagagttctggctagcatcaggtcagtgtccctctaggacagagttcccagagaaacaaacaggcaaccatctttgctgttctgcagactcccctggtgatacctccaggtatgggaggtacccaggtgaatagggtgtggagtggaaccccagaaaccacagcagccctatggaagagggacctaactattaaaagaaaaacagaaagcaacaacaacaataacaaaaaagacaccacaaaaaccccagccaaaggccagcagcctcaaagatccaaggtaaataagctcacaaagattagaaagaatcaaagaaaaaacactgaaaattaaaaagaaatagggtgcctcttctcctccaaatgattgcaccacctctccagcaagggcacagaactggactgagcctgagacagatgaagtgatagaagtaagcttcacaaggtggtaataacaagctttgctgagctaaaggagtgggttctaacccaattcaaagcggctaaaaaccatgatgaaacactacaggacctgttaaccagaataacccgtttagagaggaacataaatgacctcatggagctgaaacacacaacacgagaacttcacaacgcaaccatgagtatcaatagccaaacagaccatgtggaggagagaatctcagaggtgaagactatgttgctgaagtaagacaggcagaaaagattagagggaaaaaaaatgagaaggaatgaacaaaaccttcgaaaactatgagattatgtaaaaagacaaaacctacgactgattggggtacctgaaagagacagggggaacagaaccaggttggaaaacatactccaagatgtcatccaggagaacttccccaacctagcaagacaggcaaatattcacattgaggaaacccagagaaccacagtaagatactccatgagaagaacaactctaagatacctaatcttcagcaaaggttgaaataaaagaaaaaatcttaaagggagccagggaaaaaggccaggtcacttacaaagggaagcccatgagactaacagtggacctctcagcagaaaccttacgagccagaagagattgggggccaatattcaatttttttttttgagatggagtctctctctgtcgccaaggctggagtgcagtggcgtgatttaggctcactgcaacgtccaactcccaggttcaagtgattcttctgcctcagcttcctgagtagctgggattacaggtgcctgccaccacacctagctaatttttgtatttttagtagagattgggtttcaccatattggaccaggctggtcttgaactcctggcctcaggtgatctgcccaactcggcctcccaaagttctgggattacaggcatgagccactgcgcctggtctcaacattcttaaaaaaaagaatttccgacctagaatttaatatctggccaaactaagctttgtgagtgaaggggaaataaaatctttttcagacaagcaaatgatgacagaattcatcaccaccagacctgccttgcaagaactcctgtaagaagcactgaatatggaaagggaaaatggttaccagccactacaaaaacatactgaagtacacagaccaataacactatgaagcaactacattaacaagtctgtaaaataaccagccagcatcatgatgacaggatcaaattcacacataacaatatgaaccttaaatgtaaatgggctaaatgcctcaattaaaagacacagaatggaaagctggagaaagagtcaaaacccattgctgtgctgtcttcaagagacccatctcacacgcaaagacacaataggctcaaaataaatggagggaggaaaagcacatggaaaacagaaaacagcaggggtcacaatcatagttttgacaaaacagactttaaatgaacaaagataaaaaaatacaaagaagtgcctcacataacggtaaaggatgcaattcaacacgaagagctaactatcccaaatacatatgcacctaatacaggagcatccagattcataaagcaagttcttaacagacctacaaagagacttagactcccacacaatgataatgggagatgttaacaccccattgacaatatcagacagatcgtcaagagagaaaattaacaaagatactcagaacctgaaatcagctctggatcaagcagacctgacaggtatctacagaaccttccaccccgaaacaacagaatacacattctttttatcaccacatggtacttactctaaaattgatcacataattggaagtaaaacactcctcagcaaatgcaaaataactgaaatcataatagtctctcggaccacagagtgatccaatcagaaatcaagattaagaaacccatataaaaccacacaactacatggaaattgaacaacctgcttctgaatgactcctgagtaaataatgaaattaaggcagaaattacgaagttctctgaaactaatgagaacaaagacaatgtaccagaatctctgggacacagctaaagcaatgttaagagggacatttacagtactaaatgcccacagcaaaaagctacaaagacctcacatcaacaacctaacatcacaactaaaagaactagagaaccaagagcaaacaaacctcaaagcccgcagaagacaagatatgactaaaatcagcgcagaactgaaggagatagggacatgaaaaatccttccaaaaaaaaaaaatcaatgaatcccagagctggttttttgaaaaaattaatagatgaaccactagctagaacaataaagaagaaaaaataattgaatacacacaataaaaatgataaaggggtatcatccctgaccccacagaaatataaacaaccatcagagaataccataaacacctgtatgcaaataaactagaaaatctagaagaaatggatatattcctagacacatacacacatacaccttcccaagactgaatcaggaagtggttgaatccctgaacagaccaatattgagttctgatattgaggcagtaataaatagcctcccaaccaaacaaacaaaaaagcccaggaccagatgcattacagctgaattctaccacaggtacaaacaggagctagtaccatttcatgcgaaactattccaaaaaattgaaaaggaagaactcctcccttactcgcgttatgaggccagcatcatcctgatatcaaaacctggcagagatataacaaaaaaaagaaaacttcaaaccaacatacgtggtgaacaccagtgcaaaaatcctcaataaatgctggcaaactgcatcccgaagcacattgaaaaacttatccaccatgatgaagttggcttcatccctggaatgcaaggcgggttcaacatatgcaaatcagttaatgtaattcatcacatacacagaactccagacaaaaaccacgggattatctcgatagataccaaaaagacctttgataaaattcaatatcccttcatgttaaaaattctgaataaactaggtattgaaggaacgtacctcaaaacaataaaagccattcatgacaaacccacagccagtatcatactgaatgggcaaaagcaggaagcacaccccttgaaaaccggcacaagacaaggatgccctctttcaccactcgtattcaacacagtattagacattctggccaaggaaatcaggcaagagaaagaaataaagggtattcaaataggaagagaagtcaaattgtctttgtttgcagatgatataaacctatatctagaaaacaccattatctcagctgaaaagcttctttacctgataagtcacttcagcaatgtctcaggatacaaaatcaatgtgcaaaaatgataagcattcctatacaccaacaacagacaagcagagagccaaatcatgaatgaactcccattcacaattgctacaaagagaataaaatacctaggaatatggcaaacaagggaagtgaacgacctcttcaaggagaacgacaaacctctgcccaaggaaatcagatgatgcaaacaaatgaaaaaacgttctatgctcatggatagtaaggatcagtatcatgaaaacggccatactgcccaaaataatttatacattcaatgttattccaatcaaactaccattggcattcttcacagaattagaaaacatcattttaaaattcatatggaaccgaaaaagagtctgtacagccaagacaatcctaagcaaaaagaacaaacctggagaaatcccactacctgaattcaaactatactacaagtctacagtaaccaaaacagtatggtactggtacaaaaaacagacacatagaccaatggaacagaaagagaactcagaaataagactacacatttacaaccatctgatcgtcaacaaacctgacaaaagcaggcaatggggaaatgattccctatttaataaatagtgttgtgaaaactggctagccatatgcataaaattgaaactgtaccccttccttataccttatacaaaaattaactcaagatggattaaagacttaaatgtaaaacccaaaactggaaaaactagaagaaaatctaggcaataccattcaggacatacgcatgggcaaagattttatgatgaaaatgtcaaaagcaactgcaacaaaagtaaaaattgacaaatgaaatctaattaaactaaagagcttcttcacagcaaaagaaactatcatcacagcaaacattcaacccacagaatgggaaaaaatgtttgaaacatccgtttgacaaaggtctgatatccagagactacaaggaacttaaatttacaagaaaaaaaaaaaaaaccaaacaaccccatcaaaaagcaggcaaaggacatgaacagatacttctcaaaagtcatacgtgcagccaagaaacttatgaaaaaaaccctcaatatcgctagtcattagagaaatgcaaatcaaaaccacaatgagataccatttcacaccagtcagaatggtgattattgcaaagtcaagaaacaacagatgctggtgaggctttggaaaaacagcaacgcttttacgctgctggtaggaatgtaagttggttcaaccattgtagaagacagtgtggcaattcctcaaagacctagaaccagaaatacaatttaatctagcaatcccattactgggtatatacccaaaggaatataaattattctgttataaagacacatgcacgtgtatgttcactggagtgctattcacaatatcaaagacatggaatcaacccaaatgtccatcagtgatagactgcatacagaaaacgtggcacatatacaccatagaatactatgcagccataaaaaggaatgagatcatttcttttgcagggacatggatagatctggaagccatcatcctcagcaaactaatgcaggaaaagaaaaccaaacactgcatgttctcactcataagtgggagatgaacaaggagaacccgtggacacagggagggaaacaacacacactgggccttgtagggggtgggaagacggagaacatcaggaaaaatagctaatgcaggctgggcttaatacttaggtgatgggttgataggtgcagctaaccaccatggcacacgtttacccatgtaacaaacctgcacatcctgcacatgtaaaattaaaagaaaaaaacatgctagtcacaaaccactaaattaacataatgacccattaataggttacaatctacactttgaaaagcattgacctagattaagcagatctaagaaacatattattaatgtatccatgtatgtaattcaacactttcaggaaagccaatattttgctattccttgaattatcctcattcaaattattaaagagtaagtgctctacaaactctaacttaatgacttataaactgacagaaattttaaaatggaatgtttttcctacagactagaaggctttagattttgtctctggagctaaataaaacataatttttaaaaaagcaaaatcgcttggaagtgtttcccaaacacaggcatcaatgctctacctcagttgttataatctatggcaggcatagcaacagggctctgctgctctagaacccatggcaaacaccacttactaataatactgctcatttcttgaaccccattgcaatctgcaatttcttcttactccaaccctccaggcagctaccaaaaaactgtagcaaataagtacatccaacgcatatttactgagtccctactatgtgacaggcattgttctaggtagagacagacacagcagtaaaaatgcaaagcatctaacttcatagaacatagatttgagtgagggagctggctaacaaaggaataagcaaatacattggttgcttcaggttgctctgggtgctttaacgaacaaaagtagggtaagaggacagagcataacggcaggagtgggtgagtgctatttcaaagaggatggccatggcccaattgttggtcaggccatgagtgcagagaacaaaatctagttagctagcttaaaacatgatttatcaggtattaaacagttgattgctggaaaggtcaaagaaaaacttcaaggctgaatgtctacgaaacacgcccacatccatacttaccactcatggtccacactcaccttacacacctcatatggtgtgtctgacggtggcatcaaaccacaaccagaacctgagcagcaagaggagagggaaatatagtttttacctttccgggctctgcagtggaataaatggaaaaatgcctctatgaaaacacaacattcttgcaggcccctgattaatgaggagccaatgaaaggaagtgttccaggtgggtgaaacaaaaggctgagagtgggaatgagcttggtgtattcacacagcagcaagatggccagggtggctgaagcttgggcagtgggagaggaaataatgagagatgaggcagggagggtattcaagacccagttcaagtaagtcttgcaagctttgataaggagtctaaatgtattttcctaagtgtagaaggatgttataggatgaggattttaagcagaggaataacatgttctgaataacctttcttaatagaccattgtagttctataaactgttctccatgcttgatttacatcaatagcttaaaaatgtacaattttaaagtgacttcatttgatcttctatggagtaactttttcaattaaaaaaggcctaaaaggtaatatttctcaatctataactccctcacggatacagcacatgtgtgagcatgatcatctctaccttctctaagaccaagaggagtagccaaaggtagcaggcccaagcctggacacccacctcttgccaggctccaggaagatgtggttaatcaagggtaagtttttttctaaaaaacaaaactcagacctctggacttaaaatcctgagattcttcctagttagaaacaaaaacgaaattagcttccagcactaaaatcaacctattttaaacagtcttaaaggtttttttgttcccgtctccaatatgcaacctaaagccaaaacatttcaaactcaaacaagagaatgaaataaaaataaaattaaccaaattacgtttattttaatttttttttcaaaaagtaaccattttatactaacatccatttgcaacgggccactttcttaaggagcagaaccacttaaaagaaaaggtcaatttaaaaattgttccagaatgggagtgaggagttcttgctataagtacatgcctagtttagcaactattatgcttctgccaggagcatttattactgttatgaggtcacccattataaatgtggtctgaatgttctaatttgcttttctttatacaatgttaatgttgcaagcttttgagccaaaacatattttgctccagttaaaaaaaaaccaaccatgaagcaaaattgcagaaagggaatcaattttaaacaaatttgttatattatatattttatatgtttgtatgttaaatttaatttcttttactttctccaaagcagccacaatactggctttgatgaagggtcacactataaccacttgagtcaactcctgactttttgactcagttagaaagataaaaaagcaaaacaaaatattccctttgccttctctccatacagcctgccttgtaattcttttcacacataaatctgaactattcattttctttgtatttcataaacttttgcctgctctagctcccttacgaacattaaattctctgcggtgagacttggtaaatagaacacaaaaaatgctccataggattagactaaatgctgaagctggctcagtgggactggtgatggccagcttccaagacggcacccagcggcctgcctctgggactcatgtgcttgtgtattgcctcccacttctgtccaagggtttaacagtctttcttcaagcacattcggcagaaatggaattagtttcaccctgccctagtgagcccttgaagctctgactgtatcttacctcctggagcagctgccacacccctaccctgtcgccatttcctaaaacaacaccctcaacaaggttaccttgtatgtaatagtcttctaccctcacaatcttttattttattaattcctctattcatctacattcatctagaatcacagcaatatttacctattttcccatgttatccattacatgctcaaattaactttacttttccccatagggaattataaaagaagatttgtagctttagcatattattatgtgtgtgctttggtttgtttgttcttgcagtgaagtaggcagagacagggattacaaagaggttagatcatttagcttcatagacagatatacaggactagaagggaatattcaaacacagttatctcagctttgggaatactgatgcatttttaaaactttacagatttgctaaaacaaatgtttaatacattttataatcagaagaatattaacaaaaagtatcacatgtattcatgtattagctgtgcttttgaacatagcactctcctaagacccgaaatgtcatataatctgaagaaaaccgctaaaaacctttaggagatgacatatggtacaagaaaaacaggaaatgatgacagaagagagtaggaggtcaaggaaattttataatttagagacattaataatgagtttgaaagtcgtttggtgcaaaaaaaccccacctaaactaaaatgggaaaatcaggttttacaaaaaggaggcaatggggagagcagagttcagcacaaaagccaagacaacattcaaaaaaagacatcacagaccttcagtctccacttgactgctacaattatctgtggagctgtcaaccagctgatgtagagatcttgtgggaataaagcattaaagaatgtaagtgataacagagttatcctagatcaggagaatgaggctaaaaggaaaaagctaagacagagatcgaaaattaggtggctgtgacttcggatagtcccgcagcctgcttcagaagcgctctgctctgtttggccaataaacgagtgtctagaaggcaccctggaagatgggtatgagtggacgccactgagattgtcaaagtgaaaagtttcctgggtacaatacacagagttcctctaaacaagactgcattctgaccttgactttttaactgaaattttaaaaatctgaaactgagtttatggcttgtacaaactactaaatccagacttttgctttattccatgttttagagaactccagagaaaaagaattttctcaagccacatacacaaccctggcagaagcaaaagacaggtcaaggacattatctttattatgtgctactagtcatactgctttaaaacaatattcatatttgtataaaactgtatcaaaacagatactatagaatctcacttgaacaagactttaaaaatcatttactccaaatactcatttactcgtttagctgagccccttgttcaacatcctaattgcacaactattcttgaacatttgcaggtcaaggaacccactatttcccgagatagtatgatctattcatggacacctccaactttgagaaagcctgacttgtttattctagtttattttatttttaatcttcaagttacctaaatctattctttagagctggtttcattttaaccagaaagctctgtaggaatatagcatatatctagatagcaaaactctgtatattttgctttgtcaaagattttttagacaatagttcttttgtatatcaggctctataaacacgaaggattaaagaataccaaccaggcctcttctgttcatagcgatatatgcatcatatttctcatatcgaaacccaaaaaggtaaagatacgtaagttttcttgcccttaatgccctaaaatgtaaaatagaattccatgggcagttatgactgccccattctgacccaactcattagggactactgccatttccaatgtatgggaaactcatatatgtagagaaaatctgcagatattcccttgcaagcagagaagttggaaaacaaaaacaaaaaaacaaaaaaccctcaaagctcctgctttgaatccaaaaacataaccatattttattaaaatggtcattaaagtaccaggcacattccaatcattcctggcaacatgaaccaccagatgtttactggattacacattttaccacaattggattctctgagcctcttaaggtgactctttggattgacaacacattttaataaaatatctaggaaaagggtataattttattaagtcaaggatgagcaatctaagaaaccagagttaaaaacaacaacaaaagcaaacctctatccatatcctcagactacctggaattatatgtgtttacagcaattaacaattggcaagaattagaagatcttgagtgggacataaatacaaaatacatgcaaaatgaccaaaaagtgaaatgaaaattgattcttacagaagtacatactgaatgtgccagtaaaattaaaagaaaaatccagtgtttagtacaaacccatcctccctgcctggccacccccacagtgctctgcagatggcatacaataccagtcacaggagcgccgatgcatttgctcagtgcgttttaaacacacacataattacaacaatccaagtcttcaggaaaataaaatgaggttaaagggtcacattccaaagcagtgatttattatttgtagtgatgccttaaaggttttattttttcctatttgatatcactctctcccaaaccccaggatctgagggcaaaaacaagcctctatttaaaaaagacaagatgaagaaaaaaattcatactgaggagaaaggttcatctgtcaatgtgaacaaggagtttacatcactagcattctactggttttcttggggaaagaagtctctgcagaaaagcccacaatccacatcccactcggagcaaaggcccttctcacccgaagagccctagtgattcatgtcatcgccatctgtcccaccggacacccctgaaaactcacttctggctagcaaaacaaggtgtgtgcaatttctgatactgttttatcaatcactgatttctctttaaggattatttcattaaaaaaaaaaaacctgccaatgttccaatacaggctccaaaggggtggggaaggcacccaggggtgctatgtaagactcattttgagacatgcctacaaatgtctatcagaatgaactaactgtatcccaagtaactaggaccaagtgcttgagccacccaagaccaggaactgctgtatttatccttttgtttttccttgaagttctatagcatagctgggaccattaaagccttagaagttaaaaagattgacgtttattgagacaataatgcaatgtctcattttatacatgaggaaggtgatattgtataaggttaggtgacatgctcaaggccatgaagctgtgtaacaacaagaccagagatgggcctgggtctttggactcctgttccaggaaccatactgcataaaccgatgatcattctggaatatgtgtcctattaacacagggcaagagggaggcatttgctagtgtaactgtttactaaatcgttccctaaagactgatcacacttctttacccaataaaatccagccagtaaagaatcatagtaagtatttatttaatgtgttgatgttcaaaatgtgttgcattaaaagtgagctttttaaaaggcctacgagacacccaatggctgcacacatattgttcccactgaagggacaaccatttttaagtaggtcacacatagtaatgccacgtaatttaaagtgtgatgactaacaacacatttgaaagcggaagccaatttattgttacaatttctaaactggtgcagacatacagactatgattgttgagccttgtttttaacagtaaaaattgaatttcaactcccctttctcccagctgcggtattgaacttaaaagtctactagatcggtgggtggacgatcaaagaacatttaaaacattttaactttactacccacaaggaggtgggagtaatatgtcagtgggactaaaatgtatgtgacagagtcttaagagattccctaactagacaagaagctggttgttcccttttttaaagcagcagcactcacccttacctttgctcagtctactttttagagctggcaaatagaataaaagagttaaatcagaatctaaaaatatccatgttcttatatgttctgtttccagtgcagttgaaaacactaatcacagttgataatctgagatttctcttatctagatggccttgtaaaaggtttcccttcaagtgagtaatacgtaatccacactaagaataaacttaatctttaaaaaatggaaaacattaattctttctctccatttcctcccccttcatttccacctgaaggaagtacagatgtgaataaatgtatctaaatataatcattagagaaagatgtcaatctcatttccaaaagactgaaaccaagtaggaggagaaagaagaagcaataatggatgagggagaaaagcatactgacctcttcggcctgggatgccctgaggctgcctctgaccagcgcccccttccatctgcctaaatctcatctatctatagagcccattcaaattctatcactcccaaggagcattactggagtacaatatgccctccaaactctaattttctgaactatttcagcacccgttatgcgaaccccacaatgagcaacaattatagaatgccgtatgtcccttgctagctgttttacatgttatcagttttgtttccctatttaaaccattaagatgaagaacatgcaacataactcatacttttaaaatgttttccataatactggcatgcaaatggacaaacaggtgcttgagaaaaacaaagaaacaaacgaacaaacaaaccatgctccgttgaattgacacagcaaaactcatgcctcttaagagtgacccacagtatttcctccgtgggcagtgcatgaacccaggagcacatgaaggacatgtggctgcagatgacacgtgtgttctagcttgtttgaaaagcccaggtgtaacgatcaatattactgttattgttactctctgcatagaaagctaagtgccataagtaatacttaggaatgagctgtcatgcaaactctgcaaatgcctttgtgcatatatggatttaatttttctttcatttttgcattcatcatccagtgcactttctcattttatagaaagtcattaaaaagatcttcagtagctattttaatataatctaagttagttccttaggcgtttctctactgaagatcaattaaatgcttagcacagagcgacatcctgaaagaaatacaaaaagacatatgacagagttccctttctattttgaggtgggggaaaaaaaccctgttccttctgtatctccagtaccatctctcccgaggccttccatacactaatggttcaaagaatatgtcagtggcactgcactgtttacagattaatgacactggtaagtataaacatagcaaagtacggtagcctttttaaaataaactatcatatgaaagccaagtacataaaaataaatacattttaagaacacatttttaattctgacttaaatttctagaagatttgattttccctgacagtgtcactgaaaaatcatttattgattttaaatctctcatgtttcctgaggcagaaattaatttaatgtgattggcaacttccgtttccatacacaatggaatacctaaggaagcttccagtagtcacagcagtgaaacactatcacagccatatgaactcaagtaaagatctgtaaacttacatgtctacagttatacagaaaattattcttttgagggttaatgataatagacataagaagaatgaaaatactaaaaagaagatgaaaatatgagcctagggtttggattctttataagcaggtaggggtggaagaatcatgtggattagagatctcagcatcaggacgagtagaggggtaatgcctgtcaccaaggctattacagcggtctataaatggaagaagaaaaatgaggcaaaatcatattgggcaaaacaaatagcagtaatattaaagccagaaatctccttagagttcttactgttgggccaggtgtggtggctcatgcttgtaatcccagcattttggtaggtcagggcaggagcatctcttgtggccaggagttcaaagccagcctgggcaacatagcgagacccccatctcaacagaaaataaaacatgagctgtgtggtggtgtgaacctgtaatcccagctacttgagaagaagctgaggcaggaggatcacttgagcccagagtctgaggctgcagtgagctatgatcactccattgtactccagcctgggtgacagagtgagaccctgtctctaaaaaaaataaataaaaataaaaataaaaataaaataattctttctgctggtggggacctggcgggggaagtgtagagagttaatgtgggcacgtaattcctcatttgagaaagatacatgggcttaacaaatgattcaagaacaaataagcttattaataaatggaaaaataaatgaaggcatgaataaaagcagcaaggaaataacatataactaactaacagtctgcgtccctggatataaggagaaatatgtggtcaaagaacaatcgtaacaactagatgggaacaatgggagatgtggaatgggcaggtgggcttaggcaaaattagtggctcagaaaagaaagaaaaagaaaagtcatgtaaaaggattttaaaagacaaagtgaacagaattctaccatgttgggaatcattgagcaaatctaatttccttgttcttttctaccaaataaacttccattaaagttttcagtgcagcaaacaggttctacgtattggctccccatcatatttcctatgtaacccatgcctggagtaagcctctactccaatccacccaaattctatccatcctttaggtctaacgcgacgcaagccccccaagaactcttttattttttaggaaacttagaaaatagtaatctttctcttttcctgcagtcagcttttggaagaggggctacaaacagacaagggacagaaatatcaaaaggagaaaatataagtaggatcagatcttcaaagaactgaatattatagatttccttggttggggtcagaagaaagatgaaaaacaaagtattccaatcccactttgtcctaaaggggagaaatccattatacttccttcaagcgggctagcttttgatttctggaaccactggggacaatgggcttggcattcttttctatcaccctcccacctcatgttccactttcccctcttttgagagacggggacatctaaaatggagtcagtacatgtcccaaagtaaaggacagccagggacaggaagaagaagacccactgaaaggaacttttatttttcctttttgttttattattatttttaatgaattcctccagcactaaacctgtaagatgaacagatatcatctcctaggttattggccaagaacacactgcctcaataccaaataagatataatgcagagactctaggcaactcccgaagaaacaagttataaaagagaggggaagcaaaattagtggcaccaatggcaatgacgcaaagaaaaagaaaaaggaaagaaatgccaagctgtagccaggcaatgcaatgtaaaaccattgcttcatgtcccgcccacttccacacccactgagagtgctgttcttggggactagaaaacagcttgaggtaacaacagaagaatcaatgccaagccatacttatctctcagccaagacactaacctcacagttcatggacgttattgaaagacagaagacaaacacaagaggagaagatgaatgtggttctctcctgccttgtccaccacttccctaaacccagaaaggcactcctgtgccaaatctgtttaaaaatcatatgaatcactggcctctgtttcttttatgcatttattgtagaccagcctacactgacatcgatgagctagtgagatattgccaagtaataagcagccagagacattaagttactgaactttaatgaaataacagcttagaatttaaagacaaagaaatgtcttttatcgtcttccacatacagaaaaggaacatagctgcttaaaagatccactgtaattccccaatattctcttgtatccttattttaatatcaactgctgtatagctgattataatcattacgttattatatcaaaccctaaatatagaggtttaaataaactacaggattatctgctacctagaactaggcccaaatctccatccattcccatgactttaattcatgctcatggcgaaagatttccaaacaattctatcttctcatctcagagtctattagaacatgaactcgatgtctgttctgttgcatctttataacccctagaacatgcttaataggtatcaactgaatgaacctaggtctaatgaaatctcagattcagcttatgcaaaataccttcattccaactaaaccaaaactactatcttaatgttccaaccacgcttcggggctctaactttagatagtcttaactcatccctgtcctttatttccactatccagacagtccaccatctaggaaattttctttagaaaataaattgctaggctgggtgcggtggctcatgcctgtaatcccagcacttgcactttgggaggcagaggcaggaggatcacctgaagtcaggagttctagaccagcctggtcaacatgacaaaaccccatctctactaaaaatataaaaatcgtccaggcaggccaggcgcagtggctcacgcctgtaatcccagaactttgggaggccgaagtgggtgaaccatgaggacaggtattcaagaccagcttggccaacatggtgaagccccatctctactaaaaatacaaaaaactacctgggcatggtggtgggcacctgtaatcccagctactctagaagctgaggcaggagaatcgattgaacctgggaggcggaggttgcagtgagccgagatcgcactactgcactccagcccaggaaaccgcaagactgtgtctcaaaaaaaaaaaaaaaaaaaaaaaaatgagccaggcatggtggtggacacctgtaatcgcagctacttgggaagctgaggcagggagaactccttgagcctgggaggtggaggctgcagtaagccacgattgtgccactgcactgcagcctgggtaacagagcaagattccatctcaatcgatcaatcaatcaatagctaaattaaaaaaaaatccaaacacacacacacacacacacacacacacacacgcacgcacacacacacccctcttattcatctttacctctctgccacaaccctcccctactacactattccaggctggctatcattacccatattttggcagtcctgtctaagctggactttttactttcagtgtctgcataccagttacagacgaaaagtctcttttgctcagaagttatttatacttccctattacccacctactctcccaagtaaaattatgctcttaaggaaaaccattcaaagtccaagtttgtaacatatcccacccatcgagttggcctcctcattgccctactagtctactaagctactttctagacttatatttaacccatttttatccatttagtctattagaacacatattccatgagggcagggatttttcactgttatatcttcaccacctagatcaatgcctgaagactggacccttaaatatttgctgaatgaatgaatgattttatgaaaaacagaaaaaaaaaagcggagaaagggaagtagaagagagagtgttaaacttcacaaaggagtttatcattataggttcaggtcaagtcccactttcactcatcacttcagccttcactgatttctctcttctctgattttccatggaatttctgcaccgtacaattgagcactgaaatactcattgcaagaattcaatgaaaagttgagaacctcctatccaccaaactctgcacagcacagacatggtttatgccttctccaaacttatagtctcatagaaacattcaacaaagtcaattaaaaaccagctaccacaggtgcacatagaaagaacacttagactttgatgacagggaaggcttctcagaggaagggacagctaacggaagacttgaagggtgagtatgagttacccagacaaaaaggagggaggagtgtttcaggcagaggaaacagcatggatggagacttagaggcaagacagagtgtttaggaaaagtgtttgggaattgaaggaagttcagtggttctggagtacatgggcagcaaagagccaaagctgctggggtgggcaaggaccagactttcaagggccaagcagtcaccttgagttacgctgcgtgagctaaaaatgtgagttatgtgaagtcatgcataagttaattagctcgatttagccattccaaaatgtatacagatttcaaaacatgttgtacatgacaaatataacctttatatgtcaattttgaaaaatataaaacttttgaaaaaaaagctatgaaaatgaatatgaaagggaagctgggaaggggaaggggacagagagggtggacgcctcacatgtcagttctgcttctcagttattctggaagatttcttttaagaaaagcagagatctggtttcaggctttctctgtatctcaaaatgtctgttcaaaaaatgtggaattcacaagaaaacctgttgatttgaaaactttgattcttcctgcacctttcccacccaaagaaaaagaacagctgtaaaatttaacaactaacagagactaataagcaatttttaacgctagagacttcatcaactataagaaccttatgtccctttcaattttcttcccctttgagactctgaactagtcagtagagatttctgaaccacacgtcccccacaatccacaaacctataaattttcataattatgcattctgtaaaagcttaagcaatgagctaaggaaacagctctaagtggttctgatttcaatttctctgttgcatcagattaactgactcctttaacccacagcagtgtctaacattagtccatactcaataccaagttcaagtcaaatgtgggaccttgtgtaaggttcttacccaaaattatttcaagatgaagagggctgtatctagacttatgcagttctcctaagaacatgccaccacattaaataaaagtagcatgcaacaaccataaaacgaataaacaaaagtcaaagctcctaagacaaaaaagggtacagtgcaggttcctatgtaaggtatagattttaactggataatttttagtaattgtatatcaagaaaagatacccaacatctgtctcatgtattaccttcaaaaactcttctttctctaaatagcttgcactctctctgggccatgaatgaaatgaggccactgtgagaaattacaaatgccattctggaggaaaatccttcacatccctatcttgagcctactacacaggagaaggaaataaatcctcatgctaaaccttccactgaggaaattactaattcaatttctcttaccaacgttgctacaatgcactaaacatttctacccagtaaaaactcttatttatcacattcatttatttccattttaattagaatagcaaagcctacattccataaagactggaaaaggaagaaagcatcataaagcaaaaaaagcttcctcatttttgaaacaggaatatcatacgggatactagctactgactttcaaaaataagaaatatgctcaagtattgcctctttctaatgacaagtaatatgctgtgtttttcccaaggcaccacttcttttgagatattttgactatgaaatgtttccgtgggacagctctaaaaaatctgcatttattccacaatcacacaacaataaaatgaggacctgaccttctaggtatgaaggtaccacagcacaatcatcaacactgctaccaaatctcatctgctaatatgtaaaatgtctccttctccagctgacaagcggtaagtattctccaatataaacaaacatatacaccccacgttataactaaaacattatctagctttgacttgtcattgtggaggaaatacaaaaaccctttatatataaatattaatgagatgaccatgccttatagttgaactagcaatctgatctttaacgaagttgacccttagtacctctgaggaaagataaagaaaagatacactatatccattgttacattcactggcctttcatccatccactcaaaaagtatttattgatcactttctatgtgccagatactgtacgctatacactgtttacacatatttttggcttctatcccttaaaataccagtagcagctaattgcctcagctgtaacaaccaaatagatctccaaacattgccagatgtcctttgggaagccttgtcttagagtttaagattctgtgggcactgtttttcagaaatttaagatataactgaaagacaagatgtgtgtacttaaaatatatgaaaacactgaacaaataaatagccgataataacattttagagttggcaagatggctaccaaaaaaaaaatcacatgtacctagctaaggtcgaaagtaatgtttatttttaaataaaactttaaaaagataatttctttctaaaagtcattccaatctgtcctctctagaaaattcacccctttacctcccccacaaaataaacactcttcaccagcctggccaacatggtaaaaccctgtctctaataaaaatacaaaaattagctggacgtgggggcgggcagctgaaatcccagctactcgggagcctgaggcaggagaatcgcttgaacccgggaagcggaggttgcagtgagcagagattgcaccactgcactcttgcctgggtgacaagagtgaaactctgtctcaaaaacaaaaaacaaaaaaccttcttcatcacatagcaaaacatttattctgactatggactaatgcactcatggagtcagtgttaaaaaataaagaccagaaggatggaaacagcaaacaaatcatgaaagtgacattggaagattctgccaattaagaaaggcaacttagattctctatacccttcctcttttatctatttgatacttaaaatttactgccctgtatcaaacatgatctcagtaattcttttttaatcaactgtttaggacagcttgaggaaaggaattgctaggcagaaagacaacaggagaaacaataaatcttttaagtacaaaaaactgacaacgaaatgagaaaaatactaccttgtgtgctcaaaggaaattgcttatagaaactgaaaccaggactcagaacagtcatgtgttctactcaggaaattaaaagttgtacttttaaaaagggtttcagatccttccagaaaatctaaaataaaactaggtaactaccttccaggttttcctgggaacacttgccatttgaacagaaaatacacattgcaaactctccttggagtgtctgggtctttgcttttaaataaaaatgtttaccctagatccttctgctttgttttctgcccatcagtgagtaggatgcacagctatttgaggagtctgagaggtcactatggtttaatgggtagcaggaaatattctttagggaaaataagtcatcttttttccactgtttttcttttgagagagacaagtaattttctgtctctcatatacaactagaagaaaatggtatcactgtgcccctcagagaaatgtccccctaggagcatttcaggagagtcacctgcttcaagtgaggacaaatataaagctggtaaaaaaacaaccctcctcccccccgaaaaaaaaacccactaactacaaagcaagaaatagcgactgaagaatgcctaacgaactcgtactaaaacaaaatactgattgtagatggacatacggagtcatagaactatctggacacaccgtaaacagatatgagaaaagaaggaagattaggaagctacaaatcctgtctcagtaatctattgctctgtaacaagctaccccaaaagcgaggggctttaaatcatcatcagttcatttgctagagattctgcacaagtgcagtctggggcagaactcagtgagaacaggatgtctcaaccccatgtgctaatggccgagctgacctggggctggaggatccaagatgccccagtccaatgtatgagcatggtgccagctgcaagctggagcaccttgatgctcctacacatggcttctccctccagcaggatatcttgagcttccttccttacatggtggctccgaaactgccaggcctcttaaggcctgccgttacaacagcaccacttctgccacattctgtcacacaaaccagcccaggcttcggcgggaggggaaatagactctacactcctgatgaatggaacaacatgttcgtgcagggatgggagaactccaagtgatcatttcttccttttttttttatttttttttcacagatattctaccacaagccccactattgtgaaccacgataatataaaatgaaattaggaaaaagataagatgaccgggacgaagtaccttgcctacacacgccccctccctatcaccaccatcttctgcccttgactcttcaaccaacgaaggagagaaaagaaagaagagaatgaaacgtgcaatgcagactatagcatcacggacagcagcgttggttacaacatcttattagggtcctttaaaaatacagaaagagaacaaatgaaggagaacctagaaccaccacttactgctttttcttatgacttttggctcaatgtatgttttacacaaaaagaaatgctacaaggatttggtaccaggtaaacaatatataaattgttagggaaaaaaggaaaatctctttttttaaaaaatgagaggttctactttttagggtcataattgtataagttcaatgtttctagcatatctttctagaagaaagactagaacagccacaggtgaaaaaggaaactgataaatggagggggtaatatagtagatcctgtgacgacatcctttatcctgcactaaaactgcaatgctgcagaatgccatccccctcttgaaatcctgactctttgagaatagcaaatggtggtattactcatgcatgacctttgccaaaaagtggctggcagatgggtttgcccagcaaagtggagatgtgatgagattattctgagtccctatgcaagtagcccagttgagcctggacaagaatttcactggatcagaggctttttactttcacagaacgtagacaaatgtgccatgtcacaatggcttccactcacgtcctggtttatcatcattcctccctccactcctcaacagaaaccaaaaaaaaggcaattatctttcttccagctacagatgttaatcctcaactaacatcccataccggcagtgtctgcaatgtagtagaaaggctttgaagcctgcaaatcatttaggaccaaaaggaggaaatccaagtccaattatgggaaaatgaaaaaaagaaaaagagcagaaaagcccttcaaatcagaccacacagaaggccaaaaccacagatgaaaggaactgagaagctatgggttttttttgctgccttttaaatacagacccctaggcaaaggcagcacttatttaacatatccacaggtattaaagtctataacatataaggtgctagaaaaataatttcagtgattgttacttatgggtctagataattcttaatattgacaaacattggtatccatgtaaaagacaaaagtagaaaatatcactaaacttggaggtagaaaccagacttgaattctgcctctatgtatagcctttggaaaattactttttgtttcaaagcccaagtttcttcatctataaaaatatggattaaaaataccttcattcaaagagttgtactataacttttcaatgaaattcatgtatatgtctgaaaaacagtatctaataaatataaactgtgtatgattctgatctttaatacagattaagactcccaagtaaaagtcctttttctttttttaaatcatggaaaagacacaaattttgttgtcacaagatgatggttcaatggttctaggtcagattttgttcctcctggcaagatgatcttgggtaagtcttttctctttccaagtcctaggttctccatttcatttatttgcttgtaaacctgaattcatttggaggcactaacagtaaacacggcaaataaagtccccgcccttatggaacttagcaagtcatgaggagacctaaaagcaatgaatgtacagtgttggctactgttttctaaacgatgaggtgactgggttagaatatcttcaagaccctctccagctttaagcctgtgaacccgtaactgtaaatataaaagtcaacaaaaagaaggaagaccacagtttctcattctgatgttttgtaaggtgttaaatcattttttctcaagccaaaatcaaaagcttccagagaacagcaataccattacaaaggctttctgaattaaaaacgaacagtcctcatctcagttgaaaacttaaaattctactgttaaagggaaaatcaagtcctcacatcaaagactgtgccctttatccccttgaaagcaataattcagagtaatattggcacatacgccgaggaccactcatgccttagcatacagaatcagaaactgtttactaaaactagggtctgttgattaatcctacattcagtaagagtttgagaagggaataatcaccaaaaatccctaagttctctcctctgatcatcagtggggctgtagttcaactccaggaaaacactttatagagataagaggagactacttaccgccagggcagaagagcatgttgagatacggaaataatggtgcccaaaaacaagagatgaaaaaaattgggaaagcttcacctaagaagagataactatgttgaatcatagaagtaatcttcaattatcagaatggtcattgagatactcacaatcagagtaatacactgaatggcgaatggacgataaacgtacccaagtggacacactactccctaggataagattcccaggggataggaatgctttctttgctgcctttacactttatattctttattcgccctacaaacatatttaaggctgtagtagttaaatggagggtaggttctacaagcacagtttttctctgacagatttctatctcctggtagcatggtttttactggcaacctcaagtgggtaagccttacataaaaagcttcagttttcagaatgaatcagacaaggactaagaaataatgatcataagcagttagaatcagtacaaatttatgaggctgatgaaactatgggaaaacaaaggattattggataccaacaacagttcttcaaataatttttcagtgacacagcaccagaaattttctgtttaagtcaactaagaaacacgcacctgaatagtaaaattaagttttaggaaacttatttggcaaattgaacaaagattgtcaagcagaattcattaaaaatacaaagaataaataaaaacaattgatttttatggatctaactataaatctaactagatatatctaactacaaaaaacaatctaactataaattgtttttatggaaagtagcttctgacaaatttcaactttcttaaaacaacgtagaattccaacaaacttgagcacatctcctatgctacagtttacctatttaagtataagcataaaccttatatatctcacgtaatttctataacctccaacttccatacttacaaactctggaataagatgccctatattatccaatcaacactctagctctgccacttactgtgaaattgaaggcaagacacttaactactctgctccttagtctgtttcttctttatatctaaaaagtaaaataatggtacctaccctcaagggttactgaaagaatcaaatgtgttaatatatttaaacactagaataatgcctggcacaccatgaaaatttttaaatgctgggaattttatcatcaactgtgtttattagtatacatatttatagacgagtatgtgttagtaaacaccatttactaaactgtttactaaaactagagtctatttattaatcctacattcagtaagagtttgagaagggaataatcacccaaaatccccaagttccctcctttgatcatcaatggggctgtagttcaactccagggaaatattttatagagataagggcagattaccccagagcagaatagcatgttgagatacggaaataatggtgcacaaaaacaagagatgaaaaaaattggaaaggtttcacctaagaagaggtaactttgctgaatcatagaagtaatcttcaaatatcagaatcgtcatcaattaaatcagtaattagacttattatttgtttttccaaaggtaaatttggctgatgatcagaaaaatcttttaaatcaaagctttctgatggcaatgagcattctttccaaatgaatgctaacattaaaaacaaaatgctgcttttcaaatatagagagatgattatgctgagtgtgagcctggactagatgacataaaaaaatctcagaattgtagaatattaaaatgtgaaaaggacttcaaagtcatctgcttttgtggtttagttgtccattggaatcacctggggagcatctgaaaaaatactgttctctttccagatcaattaaaatcagaactttctggggatagaggctgtgcactattttgctggtttgttttctttagtctttgtaattgtcccaggtagttctaacatatagccacagctgagaaacactgcattagttcacaaatgagaaaaatagggcccacagttagaaaataatggaactttaatttgaacccaggtactatgctgtgctatttgtttatttgtgtgtgtgtgtgcgtgtgacggggtcttactctgtagcccaggatggaatgcagtgcatgctcatggctcatgcagccttggcttcctgggctcaagcgatcctcccacctcagcctcccgagaggtgggacttacttttttaaatatatttttgtagagatggagtgttgccatgttgtccaggctggtttcaaactcttgacctcaagcaatctgctcgcttggcctcccagagtgctgggattacaggtgtgagtcactacgcttggcctctatgctattttcaataaattactcaaaaggtctatggctttataatatgcataaggctataaataagtcttgcaaatatcagtttcggaggggaaagtatataccttattttttttccccagggtacagactgttctctggtctattatcactttctaactttaaagacattatttcactgaacttcagtagaaaatatacacaaaactagtcttgcatcatggggtttacttctaactttgattttgacctacttgagcctgatttcctattgtttttgcaagtatgcccttgcacagatccttatcacacaggcaggaggcagaggctccctctactcaatttgtgatcaagagaaactgcttataaattattttctgcttgcagatgacaccaactagaagctatctttgctagattttaaaagtcttaatcagtgtgaaattgggagaagggcaaaggaatggaaatcaggaaatccgaatggctaacatggggtcacagggaaagaagagcaagcccagaactgaatgttaattccacagctcagcctctacatcacaaactgttaccaggactttctggtgaccaattttgcatatcatttcaaattagaggcctcctggcaggtgggaaaaccatggcagtgagaaggacaagtagctgtccttctctctgttctgtctttacccacactaattagggccttaaacaactcactatctctctgaaactccttttctcatttataaaatgggaaggttcatcaagatcatctcaagggtgacttcgaattacaatgttctatgatgagataacatctgcattgtcaaggaggacagggctggcctatgatgtttatactgtgaatagttgcttttcctgtggacagaatctaccacatgctaaatagaatccacacagcagccatattataaaagggatctaccatacacatcacatgttaaatttttaatacagtaatcattatcagaaatgtgaattccatcacaggttaaaccttaacacaagtaggctgaaaatcaaactggcatcttactctcagcaataaagactcgtactagccacctgataactccatgacagagatataaacagcatacacattcaagggcagactatagcttgaactgactgatcactttccagaaatgctattcttggattgctaagaagtaagctataccacacccgctccgaaaaaaaaaaacaaaaacaaaaaaaacaccaagaaatcccttcacctcaaagaatattctagaaaaaaattctagtcattttttttgttctgaaatgtaccttttaatatattttaaagacaaaaaaataccacaaggatttcttttccttttaagaagaaccttcggctcttaggtatcacagattgttcagaacaacttggactaaaggcggatttcgcctagtgatttaattaataaacatgtttgtggttcaaaaatcattttggaaggcacatatggaaaactaggaaaacttcagatggatgaatatttagtaataaatatatttaaggaagaatattaaccaaccaaaaattaatttaaattgaaaatgcttcccagttataatcagtaacaaggaagcagatgattcccccacaaaaatatagaactgtaggcaataaacagatctttgtggaagaaaaagagtaagctatttaagggaaaaaataggtgttcccatacttaattattagttataaactcgctgttgaaataccaagagtatttaaagaaacaagaggccgggcaaacctggaaaacaacacatgtaaatacagtgcctttgtctggactctatagagaaccagaaagtgttctaaaacatctgttttattatagggttgaaaataaagaagaaggtaatatgtactttgaaatctattttctaatttccatttttcatgtgtctaatagctaaagataacacattcattttataaatacagtaccactattagctagcatggtcacagggctctaatttatcctatttatagtagcaaaaaaataaaccacattttttaattataaatcaacaacttatcattgtatatatttgaggatacaaagtaatattatgatttgaaaattcagtgtgaaataatcaaatcaaacaaattaacatgcccattacctcaaatacttttttgcagtgagaacatttgaaattgacctggctttctggctaagatcaactatagtatctgtcttcatcagtctaattctaatatttgtaaagaatattagaaatcagatgaaagtaacattatcagctatctttagaacataagttatttctaaaagaaatgtcaagaactcacaaataatataatatcaaatctgggataacagactgcgtagtaactttcttgtgcatggacaagctcacagggacaaaactgcaagatgttcctatcaaccagagtggaggccagccagcctccacgagcaggagctgctgtccatggagctgctctggacccactccacattcccctagcacggcgttgctttcctgtcttctgttcccaggtctgatctccgactggcccgcaaaactggacgctgacacgggttccacagtgacagctcctgctgtgttaactcagcctggatcgcccccacactgctttatgagcactaaattttggcaacctactctctctctcctcggaatctgacctcaactgcaccctttctgttccacttcacttctcctcaattctgacagcttgcagtgaccttccctagctacaaagagaaaactgtgttgggtttcatttgcaaaattctcaagtagaatccatcacaccttcagtcctgttctctaagggcccttttagcagtcacattattgccctcttattattggcagagagagtctgagtgaccttggatgaatctcaactgctttttgagcttaaccttgacagcccctcggtttcattacctaatgatttaggaatatcagactatctagaaaatcttttaagattacttccatttctaataacctgctcatattccttatctcagtgaaatgaccctaccaggtacttaaatcccaaaagtcacatggaaatcctctctctcactcatcctcatattcaaatgaacaaatgattccctctgtcccacgactttgtctcctagtcctcctaatgtcccttaaacctcagctctgtgaggctgacttcacttcccctaccttccagctgcttccgggttcagcacttccactagactttcccagtgacttccggcttttctctgagtgtggattaacctgggtgcctccctgaggtcagagggcttatctgaccctcaagaaataagtcctggtgcaaagccaaaaatgaatgaaggaatgaaagggagaaaggaaatatctaaagattttcagatcctaacataaaaagggattaaaatattgttttctgttgtctgttttttaaatcttagaaaacacaacactgagtaagagggagatgagagtaagtggtggggagaaaggaaggaaggacacttacaggtacgagttacggtccagagaacgagcgaagcatgtgacacatgtaatctcatttcctcctgtaacaactgttcacaagatgcgatgtcatctccattttatggttagagaaagtggactctgaaagcctccttaatttgcccaatgtcacaatgccagtaagtgtcagggtcagaactttaaccaagatgatgtgactccaagagtccattgatctttccctagagtttgttaccatgatgatctcaactttacaacagtggtccatgggagtagcttatatcatattaaaatcttagaatttcagtgtgcaggaagaagagtttaaaaacaatcctagaatttaagaaaccaaagtatttgggaaataggagggaaaactccaccaacactgcagctgtgctattcatctatagactctactcttgtactggcactagctacatatgtcggcacctttgaaatgcagtattttaaaatccaatcctgtgctaagattatccgtcctatcagcggcatgctgcattttgggatgccctctcccacctactttaagctctccagagactgtgatacaacaatatgggcttcaacacactgcatctaattttattgtaaaaaaaaaaaaaaaaaaaaaaaaggctatgccatatggttaccaacaaatgaaatagtgactgttgcaaacagaataaaaaagcaggtggagccctgacaaaaaaaagtacaactgaaatgagatctaaaagatttaaaaatagctggtcaaccagtaatgtatacttaaacgaaagtgtttaagaaaccaggatgaaaaatgtataaaaacattaccaggagtaatatgaggaaaataatgctttcgacattttcattttatccttggaaagctttggtgattcaaatttaaaaggactataatagggaagatataaaaaggaatcacaagtccaagagaacagaagaaagtttcaccttttgttctaatttcttagaatcatcttcctatttccttgcaatatacctctttaagaaacctggtatactttgctttatatatgatttaccaaaaaagaaaaaagagaaagaaacaaaccaaccaaccaagcaaccaacctagtatcaccaaaaccacaaagacagacgggccttaaatttgctacgtaacctgtatacacttaaattagaatggtcaggctgagttctctagtaaacactataaagaacttcagaatgacacaggcatcaaaccaagcaaggaagaaaaaatctttataatcgtgaaacaaactgatgttatatccaaaatataaatataagcatattctttgaaaacatgtagttatttccatatatattttacctacagtgtatataatcatagatagcttttgtgaaggtattagtgaattccggatccccctgtaactcagttggcccatcaccacctaaagattaaaaagcaattgatatctatcctatttttaacttcagtcctggagattacatcaccattttggtgcccaactccaggttttaatcactctaataaaaatgtcaggaattatttattactggcaaaatgctacagtttagaagccatttggtttatttttcataaagacaaagagctagtcatacccatccttacctaggttatccataacctttcacaacctaggattatacactagagtaattagttaatcttccaagttaagacccacatttcagagaactgtagacatcaactagttttaagtggctgagagcacagtcaggtctcttacaatttccaatgtgagggacaagtcatatgaccttggacactatgcgatgcctttagctttagaaatagttttcatggctggttttacttaataaatattgatagcaggcttctcttaaaagttgctatgcatacttcttcaactgtattgcaggaacaaagggcaaacctcccctttgccctttgaaggttcactgaaaatcaactggccaaaggtagaataacagcgaaaaaagcatacaatttattaatatgtacaagggacaatcacagagtgattccccaaatattccaatggggccaacatactcctacagcttcttttcatagaggagcggggagatagcgaatgcagggaactctgtcaaagggcaataaatgattaccaaggagaatgaacggatgggaaaacagagatgaacttgtaaatggtcctctttagaaaatgttcgagcatgcttacattctttagtattctttgttacaatagataatgagataacaaggaggtgaaggacaaacagtcgttctccttggtgggtccagtctttacttggatgggggaaaagtctcttcccacatttactgatctctaagaacctttcattcaaaatacctattataccagggagccatattttggagtgaagttccctggataccttcagtatactttatgcaaaataaattttaaaatatttaacttagaaagtggaagttcctatttgggaggccgagggggaagattacttgaggccaggaatttgagaccaatctgggcaacacagaaagaccctgtctctattaaaaaaaaaaaaaaaagaaagaaaattagctaggcttggtggcacatgcctgcagtcccagctactttgaggggggaggttaaggtgggaggatcccttgagcccaggaatttgtggttgcagtgagatatggttgcatcgctatattgcactccagcctgggtgaaagtgcaaactctgtctctcaccaccaccaccaccaccaccaccaccaccaccaccacccagaagttccctaatatgctgctcccctgacatcaccactattaacacattcatcttctagattctcacatatgaattttaacataaatggtatcattccatacttaattttgtattgatgttccccaccatcaattccttgaaaataataattaggtaatcatattttatgaagtattttttatgtgccaagtatcatcctgtaggctttacatggattttcacatttaaacctcattcctggttcataagtaggtatatttacttttcccaagttccagatgaggaagctgatagaggaataatttccccaaggtcacagaattggtgctaagtatcagagaatccaggcagcatgaataaagaagctatactcttaaccccttctcttcactttgccatccataccactactcataactctacgtggtctttttaacaactgtattaattacatgaataaagtataactgatgtaatccttcactgatcgagatttgtattattctcaattttttgctattgtatacaatgctgcttttaatgtccttgtacacatacctttgtacgtttaactacccagcatctttcttttttcttctgaaataattttagacttacaaaaaggttgtacaaatggtacagagttcctgtaaatcctccacccagtcttcccttaatgttaacatcttacgtaaccatcagtgcaattatcaaaaccagaacgttaatgttggtatagtattaactgaactatacaccttattcaaatttcaccagtttccccattactgcccttgtcctattccatgatcctctctagaacccacaaggccttcagttactatggcttcttagtctcctccatttggtgacagttcttcagtattcccttgtcttttatgacctcgacacttcaaaagaagatgggccagttattatatagaatatcttgcaatttgggtttggctgctgttttctcatgtttacaatgaagttaggcattttgggaaagagaagtgatgttaagtgatgttatcttctcctttagagcatcagaggcttcatgatgttgagatgccttgccactggtgatgttaatcttgatcacttggttaaggtggtatctttcactgtctacattgtaaagttagtattttcccctcataatgaataaatatcctgggagagatactttgagactacacaaatatcctgtttcttccctaactttcatctactaaatttagtatccttcaatggctctatcaacaacaataattactgcgatatttgccatttcctcctttcctttcacaattgttaaaatttttctgtaataaaaacctgtcccttctccacaatttttaaaatgtattcaacggatattcattttcttctctgagtataatctaatactatcactttgttgctcaaattgttccagctttggccattaggagctcctccaggttggctaggttggccttctggcacaccaccctcttcttttgagcacttactttctggcaccacaagatgttctaggctcattttatattttccctgccccaggactacaaccaaccaattctccacagagcattaattcattttactggtgaacagtatttagaaaccaaggtctggaagctacgctgctcattgatattgagatatcagtgcttctagatccgctcggcaggcagagctaagaaatatatgcaggcgtatatttacatgcatatatacatacccatcatgcaaactcacctacgtttctgcatcaatccatacattaaaaattacaagttcatatgaataacgtcaactggaatccaataccacagggttccttattcataatttctttctcccatagagagaaaactgcctcttatcatctatagtatgtttgtttatttgcatatcctagtatacagataaagtaatgatagaggcagacaaatgcctagacagacagacagaggcaggtcccctgcaaaatcctaccttcaggccaaagatagtttaaagcctgaaagctgagctacaagttaaatctttggaccaaactgagagtgtcttcctgtctggcatactttcctctgatgggtccccacccttcacgtattttacatataccctttcctaattggtttcctaccctttcctaattggtttttctacactgtcctgcccacctttgagtggtgtttttgctttaatcttttttgcatacttacaaaccaatcagcatgcactccccattctgagtccataaagggccccagacccagccacacagaggaaccccctccctcccctgctgacccttgctgaaagccgttttcataactcgaaaacattcttctccatcctcctcacccttccatgccccacgtgtcctcattcttcttcagtgcagtctaagagttcggaaacaccaaacaaaggtacaagctctaacacaggtaagctggggcacaccagcgtggccaagggaggtccagggggggtgttgctggtcaggggtccccaccttgcgaagtgaccaagaagaaaaattctgcatcagtaatagtttcagaattaatagctcatacccctgtaaaagacaaatttactaactggagtacagtgtttgtgtactgttctttttgtcttcaaccacacggcatacagttaaaaaactgtttttcaaaattatttatgttcgttctttccttttccattccctttagtgtaaattacaaaatacttaatttgtaatacaattaggttcatttgttactgtttatactttccactttgagttttcatggactggttggtcttaattattaatttgtatcctaagagggtaaatgccagggttgtgatttaatgtagcaaatgaatagaagggcacattcagtgaggactgaaagaaatgcccttaggcatggatattttctcagcatgtttgtgcttgcatccatgtgcctgcttgctctctctctctacctgtgtatgcatagcctcagtttttaaatggcggtgtcacctttgttcatatgagataatgtgaagcttagaaccctatagattttaagattgaaaagggcttctcaaacgtaaataatgcccccacatcttcaattcttaatactaacgatttaaaaatgtaccacaaattggagcttggccttttcataaaaatgtatgtgggtacctgcaggtgtacagacacagtttacttgaagttaacgacactggaaggatccttataataagcttttaattagatattacaaacaaggaaaatataggaacatgagagctggaagaaattacctaagagagtttctaaaggtttggtttcatttttaaaaaatcaattttccctacaggaaagaaaccagaagtggacatgactgacataatagatgggcaaagtaatgtattctcaaagtcagatgcattgtggaaacaggaagagaaaactacaggtgaaagcaacagcaatctttctgaattatcagaaaacataccttagcatattaaagtgggaaaatgaatggaaaaagaggaaaccagaaacagttcccagtgtctctgaatctgaaagcacaaagctttaatcagaacaccagcagagattatggctggatagtgacaagaatgagactgccacatggtaaggaaggtagtgcttcctttccagctgctaaatagtgccaattaactactatatgaattacatgtgtaccaatgtctgctcagtatgcagagagcaactccaagaaaaggctatttttcttatcaaagtgagtaaaaaaaaaagaaaaaaaaagacacagaagaagacgagtttccttttgcaggcctctaatcatcaggaccagcacttcaggtttcggtggaaggtgggaagagaaggaaggaaaacaaactctggcaagagagagggagaaaggtttggaaagactacggaagtcttcgtatgtactagaagctttaagggcaaaatatgagtcaccaaaggcaagtgaaattgctgatctctcataaaacaccccttggctttctgccaccataacttccccttttaatcctatttctcatatgcagcatgtgaaaaaaggaccagctggctgcactggttttgttattttagcccttatgtatacacactttaaaaggctgaagaaaagcaactgtgggcagttacatcctttgtatttttcaaaggttggcagaaagtattctgtgactcctttgtatagatgcatgctttcaaaataaaaaggtatatacaactctttttaaagcttataaataaattaggtgaaaaggaagggaagtggtagagagtaacgctaataaagatttttccaggctgggcgcgatggctcacacctgtaatcccagcactttgagaggccaaggcgggcggatcacgaggccaggagatcgagactatcctggctaacacggtgaaaccccatctctactaaaaatacaaaaaattagccgggcttggtggcaggcgcctgtagtcccagctactcaggaggctgaggcaggagaatggcgtgaacctgggatgcagagcttgcagtgagctgagatcgcgccactgcactccagcctgggcgacagagcgagactccgtctccaaaaaaaaaaaaaaaaaaaagatttttcctttatgtggaattgttatagaaaatcagttataatacggcagtaatgtttagagacaccaaggacctgccaacatgacctcatcatctctccacacaagctgggactgtgctgaagttatcatccacctaaagtagggtacaaagcccactcagaatggtcacagaggtaagccctgtggggcaatacaaaaggagagtgggagacttttcccaaaggccacattctctggtttgtatcagtagatatggagcttttaaaagtttagaaataagaaaatcagatttcacattttcatgtgtaacgctactcagttctttctaacagccaaagagaaggtggtacaacaatcacaccacacaactgtcttagtccttttaaaataatgattctgcatgctacgtgttgattatcttcttgacgttcctcttatttctactttgatctagaaaaatctgatgttaggagcctgaataactctgtaaatagtaactaacacatggagtacattcaagggatatggctgctcttagtggaccacacgttatcatccttcctgtctccacactggcatctaagctgttaccccacaaccagagtcccttctactccagctctatagcacccatcggaactacgtttcaatagacgacaaggtgctaccatctcaaaggggcttttccagatgctgcccagttgaaagtcatttctctttattctgaaatcccacagtattttatacgtaattccgcatttatgcaggattttaaagatgctggccccctaagagtctcatcccttgatgatttaatcaaatgttcatctagccactgctaagaaggcacacggcagatggaactaaggttactcatcaactaaccttaatagagggagattattctggattatctgggtgggcccagtgtaatcacacaagaccttcaaagaggaagggagaacaggcactcagaagatgcaccagaaaaggaaaccagacaaagacgaggcaaaaagaagaggatgaggaggtcagacagtaccagagagtgagaagaacttgggccatctctgctagctttcaaaatggaggtagcggaccacacgcaaaggactaaaggtgaccgctagaagctgaggaggacccctgggcaacaaccaacaagaaaagggggaccgcagtcctatgaccacacagaacttaatccttccaacaagcttaatgaacttgaagcagattcaccttcagagcctccagaaatagacacagtcctgcctaaatcttgatttggaaatggaaaaaccagaagtagaaaaaccagccaagcaaacccaaacctctaacccacagaacgatgagataatgatcaatctgtgttgtttcaagccactaagtttgtggtgatttgttaacgacagcaatataaaactaacacattctccttcatattatatcctatttaatagttcaagtctcagtgggcattagaactgtgtccggaattggtgggttcttggtctcactgacttcaagaatgaagccgcggaccctcgcggtgagtgctacagctcttaaggtggcgcgtctggagtttgttccttctgatgttcagatgtgttcggcgtttcttccttctggtgggttcgtggtctcgctggctcaggagtgaagctgcagacctttgcgatgagtgttacagctcttaaggtagcgcgtctggagttgttcgttcctcccggtgggctcgtggtcttgctgggctcaggagtgaagctgcagatcttcgcggtgagtgttacaactcataaaagcagcgtggacccaaagagtgagcagtagcaagatttattgcaaagagcgaaagaacaaaccttccacagtgtggaaggggacccgagtgggttgccactgctggctccggcagcctgcttttattctcttatctggccccacccacatcctgctgattggtagagccgagtggcctgttttgacagggcgctgagtggtgcgtttacaatcccggagctagatacaaaggttctccacgtccccatcagattagttagatacagagtatggacacacaggttctccaaggccccaccagagcagctagacacagagtgtcgattggtgcactcacaaaccctgagctagacacagggtgctgattggtgtatttacaaaccttgagctagatacagagtgccgactggtgtatttacaatccctgagttagacataaagactctccacctccccaccagactcaggagaccagctggcttcacccagtggatcccgcaccggggctgcaggtggagctgcctgccagtcctgcgcgatgcgctcacactcctcagcccttgggcagttgatggacctgggcgccgtgcagcagggggcggtgctcttcggggaggctccggccgcacaggaacccacggaggcggggaaggctcaggcatggcgggctgcaggtcccgagccctgccctgtgggaaggcagctaaggcccggcgagaaatcgagcacagcgctggtgggccggcactgctgggggacccagtacaccctccgcagccgctggcccgggtgctaagcccctcactgaaacgatccttacaagatcaccctgtgaagttgttccagtttcttttttgccacataatattttgctcaaaagacatcaccagaggaagttagaacatgacagaaaaagagaacaacttctggagcagaaggggagcggtgacagggaggggtgaacactggacacaggctccagaagcctaaaccgaaaacctgaaaaccataggcacaggccaaatatcttattttacaaatgaggaaactcaggcacaaagtgaaatgatcacccggaggcgccaccactagtcactagcaacactaaggcaggcttagagcccagcgacttccataacccagtcagaacaactagtgcattccacacgggcacactgctagccacttaacacacctcatcatatttaattctcctaaccgctcttagaggaaggtgtttttatcccatgccgtacctgagaaaactgaaaaggattaagttgcttggccaaggtaagatattgggattactttccagatctgtaactactcattttactctgccacacagccttccatgacattcagcctaacaggccaaataaacattaactgggatctggacgcggtggctcacgcctggaatcccagcactttgggaggccgaggtgggtggatcatttgaggtcaggagttcaagaccagccttgccaacatggtaaaaccctgtctctactaaaaatacataaaaaaaaaaaaaaaattagctgggcgtggtggtggatgcctgtaatcccagctactcgggaggctgtgtcaggagaatcacttgaacccaggaggcggaggttgcagtgagcaaccatctgaatatctgatcataggtatagctcctctctctcaaaaaataaaaaattatgcatatacttacacacattaacaattctacatacaatatcaagttgtacatgcagaatcactgacactgtgttttacggaaaactgaaattatttctttaatgagtatttgttgagtatctgatctgttctaagaattacactaggtatgaggcatactgtggccaacaggagggtctcttgtccttaagaatactggaaggaaggagatcaaatgcaagtgataagcaataccaccatctaatcagtaagttctcaaaatccctaacttttcaaatatatatattattatatatataatatatataatatatataatatatgtaatatatataattatatattatatatattatatataattatatatattatatatataattatatatattatatattatatattatatataatacatataatatatattatatataatatatataatatatataatatattatatttgatatatatcaaatatataatcatatatgatataatatataatatatatatatttttgtctaagtctatactgtatgacaaacaacctgaaatgcaaataacctttcgagatacgattttgagtatacatatttgcctttcattgctgtttttgggagtgaaagaaagagcatggaaatgaggcaaaaagagtaacaatgtacctgtcttgcattctcaaggaataattgcttttgattgcttttagaataggtaacctcatcgtgacatgatttgctccaggagcaggaattcacttccctctgtgatcttttacaaatggcagtggtttccaaatgaacagggtaagttcatttttttctgggaaaaagtgtgaaggtatcaggatttttctcaacagtctggggtgatgatgagcatggtggttcacgcctgtaatcccagcactctgggaagccgaggcaggtggatcacgaggtcaggagcttgagaccagcctggccaatatggtgaaatcccatctctactaaacatacaaaaattagtcaggtgtggtagcgtgcgccttagtcccagctactcaggaggttaaggcaggagaatcactcgaacccaggaggtggaagttgcagtgagccgagatcatgccactgtactccagcctaggggacagagcgagactccaactccaaaaaaaaaaaaatccacacaaaagaaaagaatgtgtgaactccctctgacaagatggtatgttgtgaagaggaaagttcatgtacctgcattatccagaaaatacttccttgcaagatctggataatgtggcttctggcgtttctgcaaaaacaacaatttagcacaaaaactatgctgctatctatggaaagtttaagggaagagtaaatgttaaaacaattaaaacaagcaaataaaatgttttaaataacagtaaaaatccaacattgacagggaacagagttcaagaatggttttagatagagaaatgaattatcctacattagcgcattttctgattgaaggtaatttctttaaatgccaaaaaatctttataagatagttttactggcaatctttccaatctatttcacactccctgtctccttaatcaaaccaagtaaacaaaatgtaacatttttgatgactcactaagtacatccattactttgcagtgctgtaatgcagccattctgagaggctactgacgacacagatttgactgcctctcttcaaaacaactccagatgtaccatttggagacctagtgccctttaaggttgcaacattttctctttacctcattagcaaatcacttcttgctactgcccctctatctgaggaacatcacttccttgaactccattcttctaattcatggccaaactgagaaaacaattgtttctttaaaataatttcaatttaggccaggtgcggtggctcacgcctgtaatcccaccactttgggaagccgaggtgggtggattacctgaggtcaggagttccggatcagcctgaccaatatggtgaaaccctgtctctactaaaaatacaaaaattaggagggcgtggtggcggatgcctgtaatcccaactactcgggaggctaagacaggggaatcacttgaacctgggaggcacaggttgcggtgagctgagatcacgccactgcattccagcctgggcgacagggtgagactccatctcaaaattaataaatgaataatttccacttaaaaatttatgtaataacctaaatgtctgtgttctattaaattcatcttattaaaatcagttggatttggctattaacttgcccacgaacagctggctcggtgatagtcagcagtaacttgtatgctggtatttgcctgtgtctacaggcccaagattatgatatgccagggggaggatcaggtcaaaaatttcaaagtgaaaactaattgtgggtattattaaaaacaggatctaaatacaggttgtgtgaaatttgtgaggtcagttattaatacatggactctgtaattattctggctgttgagagttatttttatttttttgcttgttttcactttttttagtcattttaaaaaaagattgacctttagctaagtgaagcattactataacaacacactgttttcctttatgggatattttgactatataattataaatgcctttaaaataaaatttgtttttctgtatccttattggctaagtaaataccatgttcaggatagaatatttgccatggtagttccacttatccttgcattgctggtctgctgaaaggagggcatcaatcatcccaaggagctcctcagtctcctgacatatcataagcaaaaagaggatagcttttattcatgatgtgaccagttacattcatatcaataatacatgctcatgttagtgagaggggcagcaatcttggactgttatgacactttaaacatgctccaaacaaggccgggtgcagcagctcaagcctgtaatcccagtactttgggaggccatggtgggcggatcacttgaggctaggagttcgagaccagcctggtcaacatggtgaaacccctgtccctactaaaaatacaaaaattagccaggcgtggtggcacgcgcctgtaatctcagctacttgggaggctgaagcaggagaatcgcctgaacctaggaggtagaggttgcagtgagccgagattgtaccactgcactcctgcctgggcaacagagtgagaccctgtctcaacataacataacataacataacataacataacataacataacataacataacataaaaatgctccaaacatacaaacattcaaacgtctatggatgcatctgaataggaaattctgtagcacttcttcatgatcaaattgaaaataaatttcaatataaattcccactgggaatcattaatattccattacagtacccttaatgattacaaccaccaccactcaaacttttttccttttttctttttttgggggttaaaaatctgtttgtactcttaagcagcatctgttctgttaaaacattgtaacagacttctttttggtaatttttttttttttttaagaaaacacatgaacatgatttgtggatcttcagttacttcaaatattaccctcattatcgtcaccatttttcattcatggtctgaaccacaccaaaagcagcatcattattctgcccatgatgagcacgtgatcgaaagcgaaagcaggctgccagacctccacggggagggcagaagcggaaacacgccacgcacctttcatcacctaactcagcttgatttactttactgaaaaaagcagcaatattccatattttaagccagaacctttaaagcttttctcttaaaaagcttgcaaacctagcttttctcttaaaaggctctccgacttacacaggacaggcatccaagccctcttcctccatggatactgttgctaccaggtttccatgaccttctcttggaaagaactcacctactctaggcaacagttgatgctctttttttagctacacttaaataccacccataagttcctattttcaactacatactccgaatataactcagatcaagtatttttgagaattcagttcaggcttttcctttataaaaagttcagacctttttctgactgaggtctgcttcttcctcttgtgtagtcctttgggaataatcttttgaaaatgctgcaatgacaaaagcaattttcttggatttaaatctgaacattctctggtttcattattaagtatacacttctttgtctaaaccagtaaatacaaggtgagagctaagagagttaacactttagaaatgcgatttggattcaaaatgacgttaagaaaatgcccagcacttagactgaaacgatccttacaagatcaccctgtgaagttgttccaatttcttttttgccacataatattttgctcaaaagacatcaccagaggaagttagaacatgacagaaaaagagaacaacttctggagcagaaggggagcggtgacagggaggagtgaacactggacacaggctccagaagcctaaaccgaaaacctgaaaaccataggcacaggccaaatatcttattttacaaatgaggaaactcaggcacaaagtgaaatgatcacccggaggcgccaccactagtcactagcaacactaagacaggcttagagcccagcgacttccataacccagtcagaacaactagtgcattccacacgggcacactgctagccacttaacacacctcatcatatttaattctcctaaccgctcttagaggaaggtgtttttatcccatgccgtacctgagaaaactgaaaaggattaagttgcttggccaaggtaagatattgggattactttccagatctgtaactactcattttactctgccacacagccttccatgacattcagcctaacaggccaaataaacattaactgggatctggacgcggtggctcacgcctggaatcccagcactttgggaggccgaggtgggtggatcatttgaggtcaggagttcaagaccagccttgccaacatggtaaaaccctgtctctaccaaaaatacaaaaaaaaaaaaaaaattagctgggcgtggtggtggatgcctgtaatcccagctactcgggaggctgtgtcaggagaatcacttgaacccaggaggcggaggttgcagtgagcagagatcatgccactgcattccagcctgggcaacaaggcaagactccgttgcaaacaaacaaacaaacaaacattaactgcgtagagaaaattcagattctactctttgtttcttttctacttcgttcaggtaagggacaaaggggcaatgaggaaaccagtctaccagcagaatctctaataggaagctctaaataattcaatacttaatatatttccttcaatactgtcaccaccagcatccgagccaccatccttctcacatagacaattgcgattttaccatctttccacttccactttcctaaacaattcttcaaatatccagagtaaaacatgacaataaacataggatcatgttactttccagttttcaattcttcaaaacaattcccattgtctttttcttaaaacgtcagtgtttttaatactgttatatagttatttctgaactgttggtcattacactgtactcagtactttaaaagaatgaccaagagtagtaaaatttcattaagcctatttttatatgatgcctaaaacctctggctgaatagacaaactgccccatttttttttttagagtggacttgtccattatttttgtcattgttttactgacagaattacaaattcacaggcagttgtaagaaaagaacagagtccttgtgccatttacccagtatcctccaatggtaacatctgcaaaactatagtatgatagcacaaaccagaatgttgacattaataaaacctagtcttattctgatgtctccagctatacttgtactcagcgataatcaggaagtaaagatgagagaggagagagcaacaatgagagtgggaagatcaaatagggaaaaaagacttcatgttgcttaggttaagccttctggtagaaaatattgaaaagtagggcaattgtcagtgttaaatttccaatcttctccctggctgaaaggggtagatggaactcagaaagagagatgggtcagttttactctttttttttttttttttaagaagaatcattacagcttttgctgtcactccgtgtgaacagatcctttttggggtttgaacttacaaaaatggcttatctctagatttttaatggctgattcatctgttgttctttacccttatatacagctgtaactgattaaaaagcctaatggttacaaatctgagagcctcactttatattttctaattatgtttcttccttatccaaaaagatgcattaatctttatttaaaatgtgttttatctttgctgatcttttgagtctgtttaaattctaccttcttggctaattactccatcattttcacaaattatttttccttaagaaaaccaaatgagaaaattatgtttaaaacaacatatataatcctttcagctgacaagataggttaaaaacgggatggaggtatcctacatattcttggaactgtctcctaagagaatcttgcctaaactctgtcctttgagaaagcaagggaaaacaaatgtatttgaatgacaactttcattaaaattctaaccaacagactatgtaacaatttaattcactgtttttttatcactccattcatggagtgaagcttataaatcctgctaggccaagcatactgatttacatcctttcaatttaacccattcttcacacacacacacactctctctctctctctctctctctttcttccacattaaaacttttgctcttcccttaagggaagacgtgctaatttcaaagttcataaattcccaagtaaagcaatttctataaaaaaacttaaaaatttaaagaatattctaatgtcaaacatctaatagcaagcaataacctaaaagactgtcatattgattggtatctgtaagatttatttccctacgtttttaaatgatttccagtgacactgtcttctaactagaattattcttagacctacttgtgtatttaaatacattcaaggtatgtttttaaacattctgcaaattgtgttcagttttatcacaaatatttggaacattttgttttgttgtttctgttctttccatcaataagttggtataaaaatttttaaaggagagactgtttcagctaatttctttctactctcccttggtacttactgaatttaactgctgctcaaaaaagaaataaagatctaacaatgactggaataaaaatactaaggagagcagtatcagagtattaaatggtagatggcaatgggaaagtgggatagaaaacaattgggttcatgtcatatcaaaatctacagtctagatgtctcttcagaatgaaattatgggacggccaataactgaccttccaccctttatgttcctagaccatttgccaggatcttcttgtcatttatttctcagtttcttcccttctttcatgtaaatacattttcaaatggacaattcatctctaaatatataaatacctggtgaccatcactgaaaggccctgtgtcttttctgtatataatgagaaatggacaattatcaaccaccagagttagaaatgcagagcagattcgatagaagatagaaacgcagcttttctgttacaaacaagaacaagggtttcctaagaaactcagtagaaataaaattcagggaacagaaatgcagaggatcaagacactgcattttgaacattaagatagaggaactttcaagaaaattcttatttttaaatgttttaattgacaaatgaaaagtatatatttgtggtgcacaatgcagtattttgagtacacatacatactgtacaatgattaaataaagctaattaacctatttctcacctcacatactgttttgtgatgagaacattcaaaatctattctcctagtatttttcaaacaaacaatatgatgttattaactatagtcaccatgctatacaacaaagctctatgatttatttatatagtcgaaaggaaattgtaccctttgtttaaatccccaccatccccagacccctggtaaccaccatttaactccatgaatctgtgagatcaacttttttagattccactgtaagtgagatcatgcggtatttgtctttctgtgcctggcttatttcatttagtgaaacgtcctccagatttatcgatgtcacaaatgacagaattcctcctttttaaggccaaataatattccactgtgcatatctaccacattttatccattcgtctgctgatgaacatttaggatgattccgtatctgggctgttatgaattttcaaaggttattctacagagtgaagagtttcagaaatatgcacataatcaaaagctaacacttcactagttggtatcagccgctgataagactgggtgaaagaagtccccaggctgacacagtcaagagtccataaaaattgccccgagacaaagcagaatcccaacaattcctggacctgatccttcagaccaacgcctctccattaggaaggcacatctctagcaacccttgtctcccccagggatgttttaatcacttcaagtaattcacatctccatcaatattccaggataatcttgggatcttagcagaatatgaactagtttgcttcctcaaaggttcttcaagattccaggaccagttcaagagccaatgcaccctagtacttcccctcttgtagcatcaaagagggaagtcactaaaaacgcaaatcaaacgtcaggtttaaaaatgtgggaagaaggataggcccaggagaaagaggctgttaacaaggtaaaaaggtaagggttaagcaagattcattttcagtcaacgtcacaggtgcttcctttcaaagagcagaggctatgtatctttggaaagcagcaagctaaaaagggatggtgggtagaggttttgactactgccgctaatctcactcgcctctaaaaagtcttaaaaccagatacctgcaggaagggatagggtccttccagcccactttaggctaagtaaaataatatcaaaaataaaaagttttaatagctaacagacaatacttactatatgtgaggactctaaaatctcccattttatagatgaggatattgaaatacactatttacttgacgtagtcccctgactattaagagacagaacctggtattagaacccagtcagtacagttctcaaatcataatctcaatcctcataccgtactgtctctcaaaacacagcctacaatacagagctagcctgcattctacattcttatccctctttattcacgtcgttagtacctgtaatacttattagagccttacgaatgttttacaaaatctatcagacccaaagcagaacctcccctttctcttccattgtccccaaggatgcttgaatacaaaccacatccaaccgctgggatgggtggagccagtagaaacatgatcacagggttaatcagaaacttgtaagacagtagcaaatttttctgtgtttatctgtactatgtgaatcataccagatgatctggcctattttgttatatgaatgactgtcttgatttggtcatgtagttgagaggggtaaatatgagaatgtctttgggtgaaagaaggggcaggaaatgcaatggaataataaccaagataacaagtcttttacctatacttcaaaaggccatctgacatggtttgtgtccccaccaaaactcatgttgaataataatccgtagtactggatgtggggtctgttgggaggtgattggatcaggagggcggagctctcatgaatgggttagcactgtccccttggtgctgttctcatgatgacgagtgagctctcctgagctatggttatttaacagtgtgcagcatctccttccttcctctcttcctcctgctccggccacttaagatgtgcctgcctccccttctgccacgattttaggtttcctgaggcctccctagaagccaagcagatgccagcatcaggctttctgtacagcccgcagaaccatgatcaaaataaacctctgttctttatgaattactcagtatcaggtatttgtttgcagcagtgggagaatggactaatacaccatctcaaacatcacctcctcccagccttctgctttgaagaacctaagtaatatgctatcactggttgtcttctgatatccaacttatttcacttttattacacatatccatatcttacactgtaaacaccctgtaggggaaaaaatgtcaaatatcggtttaggttatttgagtaaacaacgaaagctgcaatggaattttaaactaaaaaaagggctcaatgtatcatctatcccttcaatacagtataaggcaaattcagaagcaaaatattaattaaatcaactgaattgaaggactgtacacaagcttctcatttctcacacatttaaatatgtcaaggtctattttttcttaaccctttctcttcagaaaacaactacaacaacaaaaaaacagaatttggcttatacttttatttcaacatggaataactgtttattttatggagaaagacacctccaatatttctcagtagtctgtgatctctgaggacaggtgcccatttggtttcagcatcttctccaatcccacaacacctagtaaacacacagcagacctttaataaatgtttccagctacaaaatgacatggaacaacagacattcaagtacaaatgttacttctgggccaaagaaatctgaacagacataaatccaaatgttacttttgaaccaaattaatctaaaagtatcaaggtcaatacgtaacaataaaagcctcagtttatgtaactttaagcttttttaatattgaatctagcagtttctatatatgattatgaggaaacctaataaaggtcataatttttccttttatttcacacaaaaaaaacttaatgtcacacatgcctgtaacatggagattggaaaggtggcaaagaaagagagaatgaccatgatattaaaaacctgtaagatgacaccaaattttgaaaagtttctatgtatgtatgtatctgtgtagcacatatgtaacaatattttcccccagaattcaagtatatactccacccaataatttatctcagcagggaatccagcgacagctattctaagagaaagagaatgagaaaaaaagacaccaaaagaaaaatagaaagccaaagagaaagtaaaagacagaaataaaaagaaaccaggagaaaaggaaggcaggaagaaagggaggaaagggaaggaaaaccgaacagcacacagaatagaggaatgaaaccaacgtggtttaaagaaaaccttttcttactgaaattttcagtaaaacccattcctactgaaatggaaaactatcttgggtgggtgagcggctggggtttgttatggaagagaatcaatacttcacttgacaattaccatgctaaccaccaccattttcggtatcatttcactatcatcttctcacaacaaaaaaacaaataatacatactttcccatgaggtttataaacataatctcattgcacaacagcaacaaatcatctggcaaattcttggtagaggaagtcaaagaacacgtttactcaaggtgaacagtagcctctggactgtatattaaccatacacggtttcatacagctccgccaaacatgctctaaattagccaataatttgccaaccgtcatgcaggttaccataagcctaccactaaattctaaaagcttcactatgaaaattttcctgtcaactttcatttctgacataagttgataaaagcctcacaaatcctctcttagagagactccataattttccatgcaaatatcactagactgaaaaaagtcttgttaacaccatacggattcaatggaagatgtaaaacatctttatcacgtcacaatcctgcaccatttatctcccgctcccatttggatttatacctttagaaatggcagcacttgctgtacaaaggacctaaagaaaatgccttctttactccataaattaaagctacttttcttcctgatttttttttcataatttcttgtaatgtgctgcaaataaagttagtaagactaagaatgtcgtaataccacatcgtaatgccttctttcatttaccatagtagataagtctttccaaatctggcagaactctattctatgtagcttaaaggttacataaaacacaacaaaggacttctctttcaacatttccatatcatatcatacatttccataccatagctgattcaaatgtcacctttcttgaaaattcatttaaagaaattgattccaaaagaaacctatacgtgtactgttttttaaaaggctagaatcaaaaagacaactgtaaaaaccacattctcaatgtatacaatcttaccctacaaccccccaaatactcatattatcattattttgtactcaatcaaatgcccatctcatttacaatgctggagaatgcatgaattccaaagttgattttgttgtctccttgaaaacaatctgatgagggggaaaaacatcatgctgatgttaccaataataaagccaaatgcaaataattcaggcattctacaattactgagaatttaatttaatctatttccagagacaacatgagtggctctgagactagggattgaacacagttggaactgtttccattatagcctgcaaatgctactctgtttccgtagtgcatatacctttgggatctttcttaaattctgatagtctatttacaaataaatcgaacaaaaactgccactcactatttgtatcaccaaccattccaaatttacttacctcagtattattgattataatgcagacttctagaaattatcaacttaaggtactttgcagcacgaaaaatcaaggacaaggcttaaaagaaacatcaccaataaaaccaaaagcaaaaagcaaaatacttaagtgatccttagcctacttaggattaagctgtaagcagcaaacagaaatacaagcatacactaaaaaccaatagttccatgcttactttcagcagatccttggagaaatcaacaccctcatttaccccttgcagatttgcaatgaactcctgacaggtcatcttctttccaatattctgaaacagaggcaaacagtacatcactatgacattcatggaattaagactgattcataaatatatgatgaggcagaccaataatttgtttctaaaaacataactaggccaggtgcggtggctcacgcctgtaacttccacactttgggaggccgaggtgggtggatcacgaggtcaggagatagagaccatcctggctaaccgggctatgtttagcagaaagcccgtccactactaacatgtttagtaaaaaccccgtctctactaaaaatacaaagaattagtttggcatggtggcatgcacctgtagtctcagctactcgggaggctgaggcaggagaatcgcttgaacccgggaggcagaggttgcagcgagcggagatggtgccactgcactccagcgtgggtgacagagcgagactccatctcaaaaaaaaaaaccaaaaacaaaaaacagacaaacaaacaaacaaataacataactagacatctatttacaaatacagggctgggcacagtggctcctgactcatgtctgtaatcccagcactttgggaggctgaggtgcgtggattacttgaggtcaagagtttgagaccagcctggccaacatggcaaaatgctgtctctactaaaaatacaaaatttagccaggcgtggtggcaggcgcctgtagtcctagctactcgggaggttgaggcatgagaatcacttgaacccaggaggcagaggttgcagtgagtcgagactgcactactacactccagcctgggtgacagagtgcaactgtatctcaaaaaacaaaaacaaagcaaccacaggtttatatacacatacatacaattttactgcactaaaaacatggtttattatgcttttaaaattctcattaaatataaatagcaaacttataccaaaaacttattataatgtagaaaaaaacttgaaaaaccgacgctacatttatacaatatataatacagtttttaatgaaaaacatgggtaaaaacggacatttctgagctgaactcagctgtttatgcatttatttgtgttacctacatactatcaagacctgtgaaggatctgagatttacactactttcaaactaacaagttagcctgtcacaagctaataaaatgctggcagaggaaagaagtctcctgggtgagagacaaggtatttattacttacactaacaggggcagccagaatatcaacattatcttgtgaccactgggctctagttccccaagtcccaaatgtcacagagcaacctgaatagggccacaggccacctgcacatgcagtgtgttgcattataggagagaaaccctaaccttcaggagctggaatctttaatcatgggaaatacgcctatccctttgcactagcgggagataccagctctaccttccagggagatatgcaaacctgaccgctgctgtgaagtcactacagcatcttccaaagctactcactgtatatagaaataatcttgaaaagacagaaaagaacaaaggcagtcacagcctctgttcgcaaaacgtacaggaaagtgtgagacccatggaaaattatctcccagcacgtctccaagctggtttaaggacaataaagtttaacaaaaggaaattgcattaataaagtaattagaaaatccaaactacaaaaagagcaaagatataaacaaactaagaaaactaacaaaattgttatcacagagaatcacctcttattctagttccaaacaactagtagaagctgctagctgtggaggatttttaggttccgtatagacagcaagatacatctgttacgagtgcaggagaggaacgcagagcacagagaagtgtcacaggtatcatctctagcaaaatgtagtccaagtgaatacaaagtgtaccaacatcgtaatatacctgtgaccgggcacggtggctcaagcctgtaatcccagcactttcggaggccgaggcaggtagataacgaggtcaggagttctagaccagcctgctcaacatggtgaaaccccgtctctactgaaaaatacataaattagccgggtgcagtggcggccgcctgtaactccagctacttgggaggctgaggcagaataactgcttgaacccgggaggtggaggatgcagtgagcagagatcgtgccactgcactccagcctgggaaacaagagcaagactccgtctcaaaacagataaataaataaaaaataaaaaaaccaaccaaccaaataaataaatatacctgcatacactactactatgcataaatgtatgcttttcaaggtcacgctattctttcgtaaaaggctaacagaagggtagaacagcacctagtgaattcatttgaaagtgaattcatttgaatacctacggtattcaaaatgagaaagcagacttctggagatagacttttaaaaagtagcagaggccgggcgcggtggctcacacctataatcccagcactttgggaggccgagacaggcggatcacttgaggtcaggagattgagaccagcctggccaacataatagaatcctgtctctactgaaaatacaaaaaaaaaaaaaaaaaaaaatagccggatgtcatggcgggcgcctgtaatcccagctactcagggggctgaggcagaagaatcacttgaacccgggaggtggaggttacagtaagccaagattgtgccactgcactccagcctgagcgacagagagagagtccagttcaaaaaataaataaataattaaaaataaatataaaggaggccaggcatggtggctcatgcctataatcccacactgcctgggaggcccaggaaggaggatcacttgagcctgggagatcaagactagcctgggtaacatccctctctagaaacaatatgaaaattagctgggtatgaaggcacgtgctttgcagtcccagctactctggaggctgaggggcaagatcgcttgagcccaggatgttgaggttacagtgagccataattgtgccactgcattccagctcgggtaacagaggaagactttcaagaagacgcacaggcatcattttaagggaatatgtatacacaacctcaaattcaaagacagatttgcctgagaacatacacctgtgtgccataggagtcatcacttcccacctcccctttcccagccacccttctcctgtttcacaaaataaaacaattcgtcccattcaagctgtctaaatagttacaatgacagtgctgacatttttgttgttgttgttaaaaaccttgcctctttcatcagcaaagaatgcatagtttgtatgaaacactgaaaaaaatggtttgacagaagtggctttgtcagctaacttatttagtagatatttctcataagttaaataaattaaatctgcagtttaaaaattttgttgataattagtttaaagcacagaaaggaactttaatgaaaaatattgttttgcaacagtatactgaagacgacaataactcagttttcccaatcctttccaactgtatcaggtcaaacaaggtgtctcaaggtaaaaaaataacacatacaatgaacagtcattatgatataccttggcaatacctttttagatatgttctggggagatgaataaataatgactaggtaacaaatctttttccaagtcaggtggtgtttaattctttgctttaaatgaaaataaaggaaggtctaatttagtcatcagttaatcaccaaaactattttttgatatgtgatctgcaaaattcaactgcttgtaacattatctgctttaaataaattgttattaataaacttctttgtaaaagtacactaaaatatgagtataaaaacgaaaatttttctcttaaaaaagtgtgttaattttgttacatgatgatagcatcaactactataactttaaaaaagtatcatctttattaaaatacaattcacagtatattctttcgaaccatataattcagtgatttttaataaaggtgtgcaatcaccaccactatctacattcagaacatttactccctaaagaaactccatacccaccagcagttattctccaaatctcttccaccaccctcactagggaccacctggcaagcacaaatctgcattttctttatacagatttgcctattcaggacatgtgaaataaatggaatcatataaaatgtagccttttatgactagcttcttttacttaacatgttttccaagttcatccatgttgttgcataaatcagtatttaatgtccttttatttctaaacaacattccattgtatggatataccaattgtgtttcttcatttataaattgatgaatgtttagactattttctttttttggctattataaataatgctgctataaatattcatgtataagtttctgtgtaaacatgttttcattcctcctgggcatatatttaggagtgggattattgagtcctatggtaatcttgtttattcatttaaggaactgccagactcattttcaaagtggctgcaccatttcacattcccacaagcagcgaatgagggttccagtttccctccaacctcacagacactaacatctgtcccttttactttaggtattgttatgggtatgaacgggtatgctatggttttgatttgcatttccctaatgactaatgaccctcagctttttttcatgtgctaattatccatttgcatgtcttctttagagaaaggcctgttaaaatcctattttcccttcttattggaatatttatatttttattattcagttgtaagacttctttacacattctagatataattttcttatcacatatgtactttaaaaatatcttttcccattctgtgggtcttttcatttttttcctttcactttcttgatgatgtccttttgaagcaggatatttccctgaccccttcatgggcagatatgggagtatatgagcactggagtcagccaactccactcactcaaatctgctgtgttccaccccttgctggagggagcaaacaggtgagtgggtacggcagctcgggcaaatgccttcgggcaccagcaggagtgaactctgtactggtcccgcagcaacatctggggaggggtgccagtgacccctgaagtcccagaggaagtgtttgggtgctcttttagcttggctgtctgcatatggcttaagtgttaacagctcagtggatcctctgcctttttgggtgagatggctgccttctgccagcaagggcaaagggtcagtgtgacagccttttgcaaccacacttggggcacctgagctctttaccagcatccaggagaaaagaggttgcacaaacaaattggaggatggtaaatgcaggaaattttattgccgatggaagtggctctcagcaggaaggggagctgaaaaggggacagagtgggaaggtaaatgccactgaagtttggctgtctctggccagattcttctcagaagttatgctgtcagactgtccctctgaagtcaagccacttctctctgacatccagctgtagtctccaatgtccagctgcttctcctctctctgctggctgaggctggggcttttatgggcacaggaatggggggcagagcaggccatgggtggttttggaaaaggcaacatttgaacaggaaatcagggatgtaagttctcactttgggccaccgcatcaggcttttcagcttgagggtgcagccctcactggggacccatcctcttctgcccagaatttccctgcctcttgtccctatcactttgaagcacaaaaggttttaattaggtgaaatccagtttacctgtgttttattttcttacttgtgtattttatatctaagaaatcattgcctaatccaacatcacaaagatttactccaaaaaattttgtagcattagctcttatatttagatatttgacccattttgagttcatttttgtacgatagaaagcagagattcaacttcattcttttacatgtggatattcagttgttacgacatcatttactggaaagactacttttcccccaccaaattgttttgaaactctttttgaaatcaacagaccataaatgtatgggattatttttagacacttgattatactgcaatgatctagctgttgagctttatatcagcataactcttgattactgaagctttgcactgagtttaccatgttaacagttttaagcattcagttcagtactgtttcacattagtatattcacactgttgtggaacagaattccaaaactttttcacctcactaatctcaaactctatacccattaaagagctcctcttttccccttcatgccagccacttgtaaccaacgttctactttctgtttatatgaatttaacaactttacttacctcaaacaaatggaatcatattttttctttttgtgactggcttatttcacttagcataatgtcctcaaggttcatccatgttgtagcatgtgacaggatttctttcctttttaaggctgaacgattttccattttatgtagagacaacattttatttatacataaatctgtggatgaacatttggtctgcttctacttcttggttaatgtgaaaagtgtggctacgaacatgggtgggcaagtatctcttcaaaatccagctttaaactttttatatatatacgtgcagaaatgagattggtgtatcacatgatagttatatttctcatttttttgtggaccctccaagctattttccacagtgattgcaccattttacaattcctacaacagtacgtttccaatttgtctacatccttgccaaaaatagtttctattttttttgatagcaatgatcgtagtgggtatcaggtgatacccaactgtagtttttatttgcatttctagattagagaatgttgagtatgttttcatatgcttgtgaacacttcttttattctttttttgaaatggagttttgctctcgtggcccaggctggagtgcagtggcacaatctctggtcactgtgacctccgcctcccaagttcaagtgtttctcctgactcggcctcccaagtagctgggattacaggtgcccaccatcatgcccggctaattttttgtatttttagtagagatggggttttaccatgttgcacaggctggtctcgaacccttgacctcaggtgatctgcccaccttggccttccaaagtgctgggattacaggcatgagccactgcgcccggcccttgtgaacatttctagaccatctttggataaatatctattaaagtatttttccccttttaaaatcaggatatttgatttttagatgtggaaatataggagttctttacacagtccgatattaactccttataggtatatgatttgtaaatattttattctattctgtaggttgcctttacacacccctttgtttttaaggcacaaacgtttcagtttgatgtagtcccatttttgtttttgttgcctgtgcttttggtgtcacagtgaagaaattgccggcacatacaataacgtgatgtttttcccctatgttttttctcaggattttatagtttcaggattacatttaggtctttaaaacattgagataatttttatacactgtgtgatataagggtcctacttctcttttttttgcatgaagatactgtattcacactaccattttttaaaaagtctgacatttccccaatgagtggtcttagcactcttgttgaagatttgaggatttgtgcactctattctattccattagcctgtccttatgccagttccacactattttgactactgtagctttgtaatatgtttaaaataacatacgagtactctaactctgttctttttcaaaactgttatgattatttggggtaccttgaactctcatatgatttttagaacattttccatctctgggataaatgttattgagattttgatagtaatcgtgttgaatctgtagattactttgtatagtataatatataaaaaaattaagtcttccagtccatgaacatgaaatattttcccttttatttgcatcttattattctgcagcatggtttgataagttttgaaatggagaaatcaggagtcctccaattttttgcctctttttctatattttgactattctgggccctttccatttccacataaatttcaggatttgtctgtccatttctttacatacatatacaaagtgaacttggattttcacagtgattctgtggaatctgaagatcagtttggagagtacttcagtcttaacaataaagttccaatacatgactataaaagatctttccacttttacagttcctttcttcagtattttgtagtttcacttgaacttattttgttaaatttattctctaatatcttgattttttgatgctactgtaaaattatttcacttttaatgttcattgctagtatatagcaatgcaattgttttgcaaatgctcaacttgtattttgcagccttgctgaacgtctttagtcctaataggttttttcttttgtatagtcctgaagatcctctacacacaagatcagttctcccatacagattcctttagttattcctttaattttgttttaaagacacaaaatattttattatgctacatataaacagagtttttaaaaactgaaacataatagctacatatatttttagagtacatgtgatatcttgatatatgtatatatcgtataatgatcagaacagggcaaaagagacatccatctccccaaaaattcaccccttctttgtgttgggaacatttcaattgctctccaccagttattttaagatatacaaattattgttaactatagtcactctactgcagtactgaacaatacatcgtgttccttctaactgtatttttgtgcccattaacctaacacctttttttttcctccagtttgaattttgactcagcaatgttcatgcctagacctcttacttctgtcgttggtacagcctgttcctgctgctgctgcttcttggtcttcaggttctccctatgcttgttcagccagtggcacatgatacaagtattcttgggccacagatctgggggctagtatttcttgcccttgtagaacttcctgaggtttgttttctgagtttggctaatgacggtgagaacacaggcaacagatttggaaatgactacaatctaagagaactggaatgtcgggcacctgtcacttcggcgacatacatctgggacaggtctaccttcaggttgtccagctgtcttagcagctcctcttccttcttgcctcaaagatcctgagccttaatcttggctacggctgcaaaagccaccaccgctgccaaatgccccgagggaaagagaaaagtgcccattaatcaacctttcaaaaccctttctaaatcccctgtgcccctcctcctcctaccttctggtaaccaccaatctactctctaccttcatgaaatctactttttaagcccccccaagtttgagaaagaacatgtggtatttgtcgctctgtgccagtttacttcacttaacataatgacctctgtgttccatccacattgctaccaataacataatttcatcattttctatggccgagtaatattccacttatatttatgtaccacattttctatatccattcatctataaattaacatttaggtgaattccatatcttggctaacgtgaatagtactacaataaacatgggagtgcagacatttcttgaatatactgacttcgtttcttttaaatatataccaagcagtgggaatggagagtcatatggtagttctatagtttttcaatgagcattcacactctttttcatactgtctttttcagagagtgtatgagtttccctttcttttcattctggccagcactcattgtttattgtctttttgataaaaaccattttaactcgggtaaaatgatatctcctgtggttttgatttgcatttccctgtaacactgaacatctattcatgtatctgttggccatttctatgtcttcttttgagaaatacctattcaatcaaaaattttgcccattttaaaatcgagttatttgaccatttgctgttgagttacttatatattctggttattaatcccttttcaaatggatagctcaaaaatatcttctaccattctgtagcttgtatcttcactttgttgattatttcctttactgggcagaagggttttagcttgatgggacaccacatctaaatattttagcatttgttgctcataatttagaggtcttcccctcccccgccgaccccctgcaaaatctttactcatcccaccattgtagtgtttccccaatcttttcttctagtagtttcatatttttagttcttacatttaactctttaatccaagttgaggtgatttttgtaaattgtgaaagttaagagtctagtttgattcttcttcataagcatatccagttttctgagcaccatttattgaagaaactccccattcctcaaagtatgttcttggagcctttgtcaaaactaagttggctataaatgcatggatttctaggtttctctattctgttccactgaccaatgtgtctatttccatgccagtaccatactatattggttaccatggctctctctctctctctatatatatataatgtataaatatatatataatgtataaatatatatagtataaaatatatataaactatataaatatatatagtataaaaatatatatatctaaatatatgtatatatataattttttttttttgtttttgagacggagtctcgatctcttgcccaggctggagtgcagtggcacaacctcggctgactgcaacctatacctcctaggttcaagtgattcgtctgcctcagcttcccgagttgctgggactacaggccaccacacctggctactttttctatttttagtagagacagggtttcaccatattggccaggctggtctcgaacttctgacctcgtgatctgctagctttggcctcctcaagtgctaggattgcaggtgtgagtcaccgcatctggcctggttcttctttaaatgtctgacagaactgagcagtgaaactgtcagatcatgagcttccctttgatgggagaccattttattagtgctttgatctcgttactcattactggtctgttcaagttttttctttcttcaaagttcccgatgaacttcgtggttcttgaatcttcttggtagtttgtatgtttctaaaaatacctccacttctcgtttttccaagtagttggggaatacttcttcataagagtctctaatgattttgtgtttctttgtatttctgcggtatcagtagttatgtctctttttttgtttctgattttattgattttggtcttttttcttagactagcaaaaagtttgtcaattttgccttttgtttttttgagacggagtctacctctattgcccagactggagtgcagtggaacgatcttggctcactgaaacctctgcctcctgggttcaagcaattcttgtgcctcagcctcccgtgtagctgggactacaggcatgcaccaccacgcccagctaatttttctatttttagtagagacagggtttcaccatgttggccaggatggtctcgatctcctgacctcctgatccacccacctcggcctcccaaagtgctgggattacaagtgtgagccactgtgccttgccaattttgccaatgttttaaaaaacccaacttttcatttctgttgaccttttaaattgtttcttaaaatctgaacttcactttttatgctctgacctttattgtttccttccactaatgttgagtttttttcccatgcttttctagttctttacagtgtttcattagattgtttatctgaaatctaagtttaagaaaacattaacacataataactatacatatttatggggtacatgtgatattttgaaatatgcatgtaatgtgtaataatcaaatcaggatattttggatacccatcacttcaaacatttactacatctctgtgttgggatcatttcaaatcttccagctattttgaaatattcaacaattataaactatattcatcctccggtgctatgaaagaataggacttattccttctaactatatgtttccattcgcctccctttaatcccaccaccaccactatccacagcctctggtaaatatcattttactctctatgtccatgatatcaactttttaaactccctcatgagggagagcatacaatatgtgtctttcaatgcctgacttacttcactcaatataatgaaatgtaattttatccacgttaccgtaaatgccaagatttcattttaatggaagagtaatattctattatgtatatatgttacattttctttgtgtattcataagttgatggacacagattaattccatatcttggctatcaagaatagtactgtagtaagtacagggatgccctataactctgacattaatttccttccatttggataaaaacatagtagtggggttgctggatcgaatgaaattactcctgggttaaatttattcccaggttttttcttttgtagctgttataaatgggattactttcctgatttctttttcaactagttcattattagagaatagacacactgctgagttgtgtacactgattttttaccttgaaactttactgagttcatctatcagatctaagagtttcaggtagagtctttaggttcttctatatataagatcatgttatctgaagaaaggacaatttgaattccccttttcaaacgtggatgcatttcttttgcctggttactctggctaggacttccagtactatattgaatatgagtggtgaaggtgagcatccttatcttgttttagttcttagaagaaaggatttcagttctgcctcagtatgtagttagctgcagctttgtcatacatggcgtttactatgatgtgttctttctatgtctaatttattgagtttttttattatgaagggatgttgaattttatgaaaccctttttttgcatttgagatgcaaaaatatataattatattaaaaatataatttttgacctttttgtgacgtatcatgtttattgatttacatataataaaccatcctaccatccctggaataaaacccacttgatcatcgtgaatgatctttttattgatttgttagatttggtgtgctggtattttgctgaggaattttgcatctaagttcgtcaggaatactggcctatagtgttttcttattgtatccttatctggttctggcatcaaggtaattctggcctcatggaacaagctaggaaaaaatccctcctctccaatttttcggaatagtttgaggagaactgatgttagatcttctttgtaagtttgtagcattcagcagtaaaaatctcctgggctcaagcttttctctgttagaagacattttattactgaatcagtttcattactcattattgatctgttcaggtgttctatttcttcatggccaaatattggtagtttcctcatgtccaggaatgaatctgtttcccgtaggttccaatttgttcagacagttgttcacgatagtctctaacaatcttctatttttgtgggatataagttttactgtctccttttttggttgggattttatttgtgtcttcttttttaatcttggttagtctatccagcaatttatgaatgttgtttattctctcaaaaaaaaaacccaactcttcatttcactgatcctctgtatagcctttttttcacctctaatttagttctgctctgactttattatttcctgctgttaattttgtatctggtttgttcttgcttttctagttccttgaggtgcatcaataggttctttaaaatctttctactttcttcatgtaagtatttgttgctattaaacatccttttatcatggcttttgctgtatcccacatattttgatatgttgtgttcccattttgatttgtttcaagaaactttttgtttcttatttctccttaaatccagtgatggctcataattgtggcttaatttccttgtatttgtacaatttccaaagttctcattgttgatttctagttttattccatcgtggtctgagaagatacgtgatattatttctatttttttaatcgttgagactacttttgttgtataacaaatagtctagcctcaagaatgtcccatgtgataagaatacttgttctgtagctgttggacaatatgttctgtaaatgtctatcaagcgcatttgatctaaaacgaagtttaaatccaatacctctttgttgatgacttggctagatgatcagtccaaggctgagagtcagttgttgaagacacctaatctgattttattggactcagtctctccctttagattcaataatgtttgctttctatatctgcatgctccagtgttgggcgcacaaatatttagaattgtttaatcttcttgctgaaatggtccctctaccattatagaattaccttctttgccgctttttggcttaaagtctattttatctgatactagtgtagctactcatgcttgcttttggtttctgtttgcatggattatctttttccatcccttcactttgagtctacgtgtctttaccagtaaagtcagttttttataggcagtatatagttaagtcattttttttttgtttttctattcagccaatctatattttttaaggggggaatttaaactgtttacattcaaggttattattcagtacttaattcctgtcattttgtgaattattttttggttttgtgtatcctctcatcctgttctcctcttatcattgtggtttgctggttttctgtagtagtaacacttgcctcctctatttatttatttatttttttgtgagaccgacactcactctgttgcccaggctggagtgtgcagtggtgcgaccttggctcactgtaagctctgcgtcttgggttcacgccattctcctacctcagcctcctgagtagctgggactacaggtgcctgccaccaagcctggctaatttttttgtatttttagtagagacggggtttcactgtgttagccaggatggtctcaatctcctgacctcatgatccgcctgccttggcctcccaaagtgctggtattacaggcgtgagccaccgcgcctggcccagagttttatacttttatgtgttttgattatgacagatattgtcctttatcttctaaatgcagggctcccttgacctcttcttgtagggccagtagagtggtgattaacttcaatttttccttgctttggaaagcatttattctccttcattttttatatcttccccaggtataatatttttggctgacagttgtgtttttttgtttgttctgcttttcaccactttggagttatcatttcatttactcctggactgcagtggccaaagtaattccatccaccacgttgatttcttattaaccccagttccaagaaggcctctaagatttccagtttatttttacttaagagcatgtacttaccataaatcccattcctaggtcaaaacaatgtaaatgttattgtacttgctataatcaatgcccttaagcagttatcctacacagcccttctgatgcatgcatatcctttttctatggcatataagccctaggtcttgggagtaaaggcacagggatccaccatctttgtctcttgaagtacctcccaagacacaatccctattaaatgttcctaagtccctattaaatgtttctaagaaactgaatttgtcagcctctttctttggcctctcatattccttgaactttgggggtagggttgtatagacttttccaccgtggaacatggcctggaaggtttctgctaagaaatttgctattagtgtgatagggatactcttctctgtgacttgacccctttgctgtatttagaattctctttttcttggacttttaacagttcgactatgaagtggcatggagaaggcctttcagggtagaatatatttgaagatcttcgagcttcctatatctagatgtctgtatctcttccaagacttgagaagtttttacctattatttcgttaaatgggttttctatgccattacccatctgttctcttccaggaaaactgaaaattccactatttcgtcattgtatgtgttacataagctttcttcgtttttattttttttaaaaatgttatctgctcaggttatttcaaaagacctgtcttcaagtttacaaattcttctgcttgatctagagtctgttattgaaactgatgattatattttttattttactctttgaattcttcagtttcaggatttctatttaacttctttctgacatctttgttgaatttctcatacagatggtgaaatgtttctttgcattgttcatctgttttctgtagtacctgggttttcagaaatattttgaattcattttcaggtatttcatagattttttttaatattggcatctgttgctggagaattattgtgttcctttgatggtttcatgcttccttgatttctcatgtttcttgtgtccttacatttatatctatgcatctggtgtaacatttgcttcatccaactctatggattgggtttcgaagggaaagacatttttttctatagagctatctatagagttgtttgggtaaggcgttttggctttgattctgggtgggagaagcagtgcagtctccatatgacttctttgactatctttagcatcagtggtgtctatgagttcctcagtggataaagctgtggcttttagtaacggctgtagtgaggctttgctagtgaaagggacatcaggcaggccagttcttaggcaacagtgatggcaactctgggatggatatgcaggatctcggtcaacacacgtggatattggtaaaagcaggtcaggaggacgaatccttggtcttcaagtggattgtctgtgtgctagcagtggcaacaatgggctgagtgaatgggtcctcaggcccttagatggtatgcataatgtctgcggctgcaacagcagcagagggctaacttggggccccaagctacagctttgggtgccagcagttaggggtacaaagggcctagtggccatcaccgagcatccaagtggcacgcagctgggtggcacatggccgtaggcagggcagtggcagtctcacttggtcatgctatataatcctttttatattttgttgaattaggtttgttttagaatgcaagaaatattcataagggatatctttatcatgacttgtctcattttggtatcagggtaatagtgctctcatagaattacttaaaaagtgttactctttttttctgaagggtgtaaaaaaactgatgttaaaacttctttaaatgtcgatgcaattcacaagtaaagccatttgatcttaggcttttctttgtaggaagttttctgattactaaactcttcacttgctaaggatctattcaggttttgtttccttttgagtttcagtagtttttatctttctaagaatttgttcatttcatctaggttatctagctgttgacaatattcacttacagtagttacttccataaggccaatagtaatgccctcttcattactgattttagtaatttgagagttcttttactcatggtcagtctaattcaacttttgtcagttgttgatcttttcaaaaaacaagcttctgatttcattgctttttctctattactcttctattctctgtttaattcatctttgctctgattattctttcccttctttggactgagtttgcttttgtttctttcattaggttagactgtaaatttgacatttttctaaaatacagcaatttagagcaataatttgcaatttggcaattcatcagctgtataccataagttttttatgttgtattttcattttgctttttttgttgttgttgagacgtagtcttgctctgttgcccaggctggagtgcagtggcacaatctcagctcactgcaacctccgtctcctgggtcaagtgattctctcacatcagccactcgagtaactgggatgataggtgcatgccaccatgcctggcaaattttttgtattctgaagtagagatggcatttcaccatgttggccaggctggtctcgaactcctgacctcaaagtgatttgcctgcctcggcctcccagactgctggcatgagccactgcaaccggccaacatatttttattttcatcactatcttttagttcctcttgtaaattttttttggacctattggttatttaggagtatattgtatgactacataaatgtcctttaattgatttctaatatcattctattatgtccagaaacatgttttgtatgttttcaatccctttttgcgaattttgtcctatccttgagcatttttcatgtacactttaaagattactctcctgtcatcaggtatctgttagatctagttggtttttatgttgttcaagtctatttccttgttgatatcgtgcgtggtgattctaagcattatttaatatacggtgctaatttctcaataaaacaatttctccctccaattctgtccattgttctttcacggcttattatgtgttcagaaggaataagactttttccctacactcatacaccactcaacacaatagtcactgaagtatgtgggggtttctccacattcacaaccaattctccaggagacaccagttgggtgttttataattcaattataatactatgtatctgctgatttcatgagctcatacaggttaagggctcagccctacaagatcaccccaagtttcgggtgtcaattggtagcagtgggttgtcagttatacttctgaccaatcagctataaatgggggtttgcaggatcatctatctgggtttaatttactaggagggctcacagaactcagggaaacatttatccctttaatatcaaagatattgcaaaggatatagataaacagtgagataaagagatacacagagtgaggtctgaaaaggtcctaagtgttggggcttctgtccctgtgatgttgggatgcccaccttccaagcacatagatgtacttgccaacctcaaagctctccaaaccccatactttgggtttttacagaggctttataacacagacatggctgattaaatcaatggtcagtggtattaactaaaccttcaccctattcttgctccctggaggtggggtgtgtgcggaaggaggggaggctgaaaattccaaccctctaatcacatggttatttcccctaacaacctgtccccttgctgagcttatctaggagctcaccaaggcttgcctcattagaataaacaatgctcctatcattcatccaaggcatctaggaaccctgtgtcagaactgctgtcactcaggaggtccatttcaagaaccaggagcagagaccaaatctgtatttcttatttgtcatagtatcactggggcttatattgattggaagtgttttatcaccttgatgaaatgacccttattataaaatgttcttccttgtttctaggaaaaaatatcttacctagaccttctggatagcttgcctcagattctacattagcacttgctgctccaccaagcattttaggttatgaagacactttctttcctaaaacttcatgaaccaagttctcctagcttccaacttttcttctgcagcttcctcacctctctcgaccttcatagaattgaagagactcagggccttgctctggattaggttttggtgtaagggaatactgtggctggttggataccctatctacaccaccaaaacttgctctgtatcagtaataaggctgttttgctttcttattcttgtgatcaccggaatggcacttttaatttccttcaagaacttttcctttacattacaactttattaactgtctggtgcaagaggcctagcttctggcctatctcagcctcactaaacttaatcatttctaggttttgattcaaagcgagacgtatgaaactcttcctttcacttgaacacttagaggccattctaaggctattaattggcctaatttcaatactgttgtgtctcagggaatagggaggcctgaggagacagagatgggggaatggccagcctttggcgcagtcaaaacatatatatttatcaattaagtctgctgtcttatatgggaatggttcattgaaaaatggcactgataagactcgcttgacgcagggttccatcaaccttcactttgttaggaaaaatgttcagtgactgcaaagtgtaataaagcaaaggacaataaaatgagatacgcctatacttaaacttacaataaaaagtttccctgtggtcccagctgctcgggaggctgaggcaggagaatgacgtgaacccgggaggtggagcttgcagtgagtcgagattgcgccactgcactccagcctgggtgacacagcgagactccgtttcaaacaaaaagttttccaatttaaacttgaagaagagatactatttaaaaaaaattcttttgggagattcatgaacaagatatttaaaggctacagagtcaaaagtgttttttcaggacaccattaatttctactttaaggaattattaaaaacatcatttaagtaataattgtcataattcataacattttaaaacagtaaagtctatgaagctattttggtctatgaaatcatacctcatcctaaattcagatttactttaactgcttatttggcagtgccttctgtccaatttcaacagtgaccataccattatctatgtcagcacaaagataccaatttgactcacgtggactttgaaacagccattaggaaaaatagcagttaggtgggcaagatggatatatagattcagaccaacaaaagccaattcaaatacttggagtcctacgcagtaagcaagtattagtacaatcatccaatagactgtaccttaattttctttactggttcagagaataaagataatgtggttttctatgtgttaaaaatgtccaacaacttctcgaatgcttgactagctgaagttgcttttatctgttgattgtactcctctgactcactgatcattcttctaggcaagaattattaggaacaaaaggtgaggagtcagatcagtccattttgctgcttactggcacatatttaaacacattccttccactcaggcgtttataccatttccaaagggaataaaagtaaaatgaagtctttgtcatcaagaaatactcctcacgatgtctggatttttttctccttgtcatgtaccaggctgtctcaattattttaaaatactattattcaggcaaacactactcaacgaataaagcaaattctaatcagtgattttgtggctcaaggcttcataagtatccaagagaagctcatacactatcacagttccattcattttcttcccaaattagttttggataactttgcataaaagtagttctgctctgaaacaaatgttgaccagttgcatgccaataaagtactttaataatactttttcatattttaaatttcttcccattaaatcaataaagcatggagatttgaaaatgcctcctgatgcattgagaggtacagaaatggtaccttgaaatcaatatattttctatcaaaacagatgcaactaaagatgaagctctggatcattacctttaaaatcagtaggcattttaatcaaacttaaaaaatatcaaataacaaaatagatgacaaagtggaaagtttaaaaaaaaattctatttggaaccccaaaattccaggcaggcccaattcttaaatatttggctaatcaaggtatcatcctttatgggagcaaatattaatcaaaagtcaaaatactctctatatcggaggcctacgtcatcccgcaacaatttaaggctactctctgcagcgacaatattaccattttcaaatgctttcttatgataaaaagatgttttctctgtttgtgttcgtttaaagatacattaaatgccctttagagcaaagttccttgataaatttatcatttctggaagaacttatcctcaatatgtttaatacattcccataaacaatttttagtaaagaatttggggaaacaagtgtccaagctctagcaggtttcgtgaactaagggcaagactccaaaacagacaaattctgtaaatttctgtaaaggaccagagagtaaatattttaggctttgcaagtcatatattctgttacagttattcaacactataattggtgtgaagatgtaaacaactgggtttggctatttacgataacactgatttacagaaacaagccccagatggattttgcctatgagtcataacttgtctaccccttgtcttaaagaaaaccagaaggaagtggtattggtactgaggacaacatcgtgagcgagcaagcaaacaggttaggcatcctgatgtattctattctccaaatgcaggttttcgctttgttaaaataaagggcactttcccctgaccataacagagaagcagctcccaacttctgttgcaataacgagagcaaaggggaaaatgaagatggagaatttcattcatatcaggagcagccagaaaccgtatacaagcttcggcaccaaactcagcaagcgggtgaccaaatctttgagcgtgccatccctggcaatctggggaatgtaacctacaaagctctgaccatcgcctaacttaaaatcagccctaggagagctgcgaatagggcagctgtgtcaatcaggtattcactaggaaagctgacaacagcatatactctgattcagaggttgaagaattaagcataatgattctaaaattcttcatttttgatagtgtcaggtctggaagctttgcggaaaacgtgcttttggagaaactaaaagccctcatcatccattggtaaaatctggcttcataaatctcaggatattaaaaacacagcaggcatactctcccatatgacaattccacctcctccaacatgttacaataaatggtggaaaggcatactactgatttggtaattacttcagttatgtggctctgctgaaagctcctgttttgcttttattttgcatgctttgctatcaaataagtttgattatgtcatgctgccctcaggtgtccattcctttttaaatgtatgactggggggcaaaggaggaccctttgtaaattttaaaaccaggactacagtggatattcaatgtgctctctcacaaaccctaatcacagagctcatttaagtgctaaaagctcaacatttaggaatatctgatatgtcactgggacttctcccacctgtcctataatatcctgcctttgaaaaaggaatcagagtggtaaaaagaaaaaaaggaactaaaaatagtaccacagcacagtggttctcaaagcgtttcagagatactgttccagatgtccatgaggtcaaccctatttttatagtaacactaaaaacatttttttcattctctcaaatatacagtagagttttctagaagatgcatgacttctgatacactgcaaccgactataaacacaaacagatatgagaatctagccatcttttactaagccaaatataaaaagactagcaacaattttaagtgctattctttaatatatttctcacttaggaaagtatgactattattcataaatgtgttattcacttaatgggtttttaatgatttaatgcaatttaaaaatcttatcagtttcagttccagataaatattaatatgtaaacaaaagattttggggcttctcaaaaattttaagagtataaagctatcctgggaccaaaaagttttagaatactgaaatatcagacttctattgatatttcatggaaagcacttcccctaaaatttgaaaagataaacacacctaactcactgtcaaattacaaggactaaccaaacaatttttaacttgattgctgtagcaggactggcattaaagtaagcaacaggattggaaacaagagtcaggggtttcagccaccatcatcctcattcctccctccttcctccacaatcaatttgcagaaagtaagaaagagcgaaactgacttagaatttgacctgctttccttgatcacgttctataacagaactgtgccaatgtaaaaagcttacagtgataagaagactgaataatgtgtaagttagataatatgaggtccctcaataagccccactgacacaactgattaaagctaccctgaggtattttccatatataaacctgttcttaaaaaagcaaaactaccaaaagtgggaggctagagggtggggaaaggggacaggtgaaggaacagaggatggaaaaaaggaaagaaggctttcattctaagaggtcatagaatccaacaaaattgaccagtgcatgattaaactatggcatacttagataaggattcctattaaagtctagaccattggcaatatgatagtaaattatattctcaatttcaatttacaattcatcatttttagatcataacatttttcttttttcttttcttttttttttttttttgagacggagtcttgctcgctgcccaagctggagtgcagtggagtgatctcggctcactgcaagctctgcttccaaggttcatgccattctcctgcctcagcctcccaagtagctgggactacaggctcccgccaccatgcctggctaattttttgtatttttagtagagatggggtttcaccatgttagccaggatggtctctatctcctgacctcgtgatctgcccaccttggcctcccaaagtgctgggattacaggcgtgagccactacgcctggccaacattcttctataaaaacatttcaacacctaatggttaggttctcaggctattctctatatccttattgtggagacagaaagagtattggtgaaaatgaacgccaggccccactagaaaccctctgcaactgtgagatctagccctgatccttctcttaggaccaccgagaagctgcagggatgacggccttggggccactgtgtctgggaagctccaagtcaggtaaaaacatagaccaaaagcttctcaaggtgataagcaaccttggcgaagtctcaggatacaaagatcaatgtgcaaaaatcactagcattcctacacaccaaaagtcaagccgacagccaaatcatgaatgaactcccgtttataactgccaacaaaagaataacatacctaggaatacagctaacaagggaaatgaaggacctcttcaagaagagctacaaaccactgctcaaaaaaatcagagatgacactaacaaatggaaaaacattccatgcttacagaagactggaagagtcagtatcacgaaaatggccatactatccaaagcaatttatagattcaatgctatccccattaaactaccattgaccttcttcatttaattagaaaaaaactattttaaaattcatatggaagcaaagaaccacccagacagtcaaagcaatgctaggcaaaaagaggcaagctggaggcatcgtgctgtctgacttcaaactgtactacagggctacagtaacccaaacaacatggtactggtacaagaatgaacacacagatcaatggaacagaatagagaacccagaaataagactgcatgcctacaaccatctgatcttcagcaaacctgacaaaaacaagcaatggggaaaggattccttatttaatacatggtgctagaaaaactgggtagccatacgcagaaaactgaaactggatcccttccttacaccatatacaaaaatcgactcaagatggatttaagacttaaatgtgaaacccaaaaccaataaaaccctaacagaaaacataggcaataccattctgcacacagacatgggcaaaaatttcatgattaagatgtcaaaagcaattggaataaaagcaaaaattgacaaacgggatccaatcaaactgaacagcttctgcagagcaaaagaaagtatcagagtcaacagacaacctacagaatgcgagaaaaattttgtaatttatccatctgacaatggtctaatacccggcacctacaaggaatttaaatgtataaggaaaaaacaaacaatcacattaaaaagtgggcaaaggacacaaagagacacttctcaaaagacatatatgcggccaagaaacatgaaaacaaccttaatatcactgatcaatatcgcaaatcaaaaccacaatgagataccatctcacaccagtcagaatggctacattattaaaaagtcaaaaaacaacagatgatggcgaggttgtgaagaaaaaggaatgcttttacgctgttggtgggagtgtaaattagtttaatcattgtggaagacagtatggtaattcctcaaagacctagaaccagaaataccatttgacctagcaatcccattactgggtatatatgtaaaggaacagaaatcattctgttataaagatacatgcatgcatatgttaattgcagcactatttacagtaggaaagacatggaatcaacctaaatgctcatcaagggctggataaagaaaatgtagtacatatacaccatggaatgccatgcagccacaaaaagagaatgagatcatgtcctttacagggacagggatggagccagaggtcattatccttagtaaactaaggcaggaacagaaaaccaattaccatgtgtgctcacttgtaagtgggagctgaatgatgagaacacatggacacatggggcagaacagctcacagtggggcctgtcagagggtggagggtgggaggagtaagaacatcaggaagaacagctaatgaatgccaggcttaatacctgggtgatgggccagttagaatggtgatcattaaaaagtcaggaaacaacaggtgctggagaggatgtggagaaataggaccacttttacactgttggtgggactgtaaactagttcaaccattgtggaagacactgtggagattcctcaaggatctggaactagaaataccatttgacccagccatcccattactgggcatatacccaaaggattataaatcatgctgctataaagacacatgcacacttatgtttattgcggcactattcacaatagcgaagacttggaaccagtccaaatgtccatcaatgatagactggattaagaaaatgtggcacatatacaccatggaatactatgcagccataaaaatgatgagttcatatgctttgtagggacatggatgaagctggaaactatcattctgagcaaactaccgcaaggacagaaaaccaaacaccgcatgttctcactcataggtgggaactgaacaatgagaacacttggacacagggtggggaacattgcacaccccctgtcgtggggtggggagagggaggagggatagcattaggagatatacctaatgtaaatgacaagttaacaggtgcagcacaccaacatggcacacacatacatatgtaacaaacctgcacgttgtgcacatgtaccctagaacttaaagtataataacaaaataaaataaaaaataaaaaaataactctgtaaggtatcaaaatagaaaaaaaaaacaaaacaaaactgggtgacgagatgatctgtgcagcaaaccacgttggcatttgtttacctatgtaacaaacctgcacatcctgcacatagacccctgaccttaaagttagaaatcaaaagatctttgcaaataataatttaggaaaaaaagccaggtaagacaagacaaacacggcaccaaggagataggagagaggactccaaaggagaaggcagtgctagcacagtagaaattatgaccatggatggaatctacagcaggggaaagctcagagagaaaactgaatgccaacgatagctttcatggcagatggcatcacctttcaaggcagagggcatcacagatacagagaagcacagacagaagaggtatccacagggaagatattatcctgcaggacgatgagaggatagcctgcaaatgtacttaacagctgccagttacaatagtgatcattacagatgcagagagttcttgaggatattaactctatgaggttcatcaatatcatggaagtctgtgatgtttttgacagtgaaaatataaaatagcacaatatgaagctgtggggaaaagcaagagagatcagattgttactgtgtctgtgtagaaagaagtagacataggagactccattttgttatgtgctaagaaaaattcttctgccttgagattctgttaatctataaccttacccccaaccctgtgctctctgaaacgtgtgctgtgtcaactcagagttgaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggaatgtctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgccaagacctttgttcacgtgtttgtctgctgaccctctccccacaattgtcttgtgaccctgacacatccccctctttgagaaacacccacagatgatcaataaatactaagggaactcagaggctggcgggatcctccatatgctgaacgctggttccccgggtccccttatttctttctctatactttgtctctgtgtctttttcttttccaaatctcgcgtcccaccttacgagaaacacccacaggtgtgtaggggcaacccacccctacatgaagcattaaatttttaaaataatttttataatagtcattttccactactaataaaccaaatatttatccactatttaagattctaggctcctagaaagccaatgcaataattaagtttatagattagaaaagaaataatgaattcttacaatctatctcacactgaactccacatttttttaacactgttctgtgacaaaacctaaacatactttcttccttgattatattcttctccctaccagtaagttgtactagatatggtttcaaccctttccaaacttacaacccaacactaaaaacattagtaaggtcgtgcctgatcattaaactcagaccacagggcatgatactcaacatgctctgagtatgtcaagggtaaagtatatgtaggaggcccagcccgagaaagagagctacctctaagaaccacaaccaggctcttataccaattgtacatggtgggctggcttctgccaatactggagaacagagggatgctggacaaaactgctactgaaaatctcaagccttgatgttaaaaggtacattttgtcaaaaaatcttgattaaaaacaatgccctggctactgcctcttaccatggcctgaccttggccagccactgacttgtgtatctcttgtgactttctagttgtggaactggccagctgactatgctctgatctatctcactcctcactgctatgcaattctatacttaaccctcctaccaccttagaacaccagccctgggtgataatcctgccaggacggtaggaacctgactaaactgtgactgaagtacaagcaagctagttagtggtaggaaacagaacgcatttgaagatccatccagaaagggagtaagtataaacttattctgacatatcaaatcttatccataccatttcaaacaaggttgaagaaaaagactttcaactcttaccttgttgatagttgaaacaatattcaataaaacttagttccaatatagcaaagaaagaaactctagagtttaagagaaatgtatctgtatgtgtagaagtttaatttacataagtattttgtagataaagaggcatttcaaaaataaaacaaattatatagcaaattcaccacacgactacaattataaaatatttaatttaagggaataaactacttgcagacaagtaaaaacaagtagatactcttgctaggaaaatgatatatcagtcacatttttttaaaagcaggtactgaattctccccccaaatattgtatatacttcagattgttttttatctagcctaattagagaagtttaacatgatccaacatgaaattaaaacacctccccagtgttttcccatcatagcacctcagcaacctgctaccatgtcttcagtgaaacctgactaatgaggtcagcctagccaataccatcagagaggattatttggcttccatgaacattgtctcattcacctctgatccttacccaaatggcaaagagtatggaaaggaggaggcacacgcatgctatatacatgtttgttgaaggggaaagttagaaaaagaaagggatttcaacatgtcacattagctaaatgtaagtaaaatattagtatacattccattattttattagtaaggaaattagcaggccaaaccaaggcccatattaatgcattctcagtgcctcattcctcagagtaaaggaaaggttcaccaagagcagccaaaacaagttaatctcccaagaggggagtcagacctcctcataggggagtcacccctcccctactgaaagcatatgaggacaagctggtcttggcacttcttagaaagatcatgctgcagtattgctattatgacacaacggtaaggaaaaaaagaataatggttgattagtgtattccccatgaagattattctggcatcggatcaagtaatgggtggtcatattctaggtagtatagcattaaggagaaggtgaaaaggagcagaacagtagaaataattcattttatctcctgcatgattcgatttcataggggccatgctgacaagtcaaacagacactaaaacaacaacaaaaaaatcaggcaatcatgatgcaagagaagctacatccagaattatggattaaaaacttaccacctagaagaataatttatttttaaaatgaatccagaggagaaagatagaagaaacatatttacatggttagttcttatgatagctactatatattcaacagacttgtaacagcatgcattatggaaaactaatacataaaacctaaatagacaatcccaagtatatcgcacacatttttaaaacagagaactacttatcaccaaacacatgatcctgaatatgacagagattcactgttattgataattttctccctcttctatcagtaattttgccacgactgccaattattaattatccatgattggcctaactcaaggtaatattaaaatgttaatttatgtaaactcttttccatcccagttgccaagaagaagcaggatgcttcatctaatctccttacaattccttgtaagtctaaagaagagcaaatgtcctagatttgcagctctaaacctgtagctactgaaacctgggtgtccacagctcatctagacatcaagcatgctgagatatctaataaaaaataacatctttattggttgctacatttcaagttcttatgattcagatacatgcttatgtaaaagtattattaaagctatattagctttttaaaaatgcaatctaggatttagtagaaacaaatcatcaaaaatgtgacaaaagctctaagagatctgcaacctttaaagagaaattgcaatattactgaatttttttcctcccaccattaaacttttctcagttaacagatgctaaacgtacaactcttttatgttgatggaacctcaaaatatctagtgtgaagggaattcttcacgctggtgatcactgacttgattcaatgttatatgtggccaaacgcactcaaaattttctcctttggccagaaaggctaaggaaaagaagggtgcaaagagcaactgttatcaccaaacagccagacaaagcagtgaaaacttgcttggccagtaacacgaaaaaagtggtcatgacaatccactgactggccatccctttaacaagctggatgaacattagattgcggtagtcatgtcaagattcacactgtgaaatgcctgcatttccacatggtgtattagccgtgctatactgcccaagaatgcttcctgaaagtattttcttttcatctgtattatctctggacacgtgctacctatgtttacaagccactaagtgattctaaattcacctcttatatatggcaaaaggaactttctagctgagtattttgagatatgttaaaatgatgttaaaattaggattctatcactatatctcctgtttgctttctggtggtggaaccctttctccctgaaccccttcctcttataacagctagtccaacttaatggtcccatagagctccatggttcctttcttaaaagggaacactatattttccaaaaaaggaaattatgtgactagcagaatatctaaatatcaattttttatatgtaatttttaaattgtaagatatattacggcaaatcaagggataatatactctacacagacacctgattttctcttcaaaatacaatcagaattcgttaaatatggactaatctatacttacttagagcaaaaattacttcatagtcccaggttcatttattttaaagagtattatgaagagttcgagtaaatgctaaaattctacttctacaaaacttgcaaatttatatataattatacattttaacactttatcttgtatcttaagtagatgatgagacggtaattagtttgttttattatttcaactagtaaaagactagataagctgaggggcacaagaaaggctgagttattcaactcactatggtatgtagggaaaacacaattcacattttcagatctaatttgtattctctccatcattatctatcaactgtaattctcaaccagaaaacaaaaataagtaaaagctctgtctgccatctactggacaaagaagacacagaacacacacattactgctaaaacaactccagacaccaggacgatggatttaaagtcatactctgtgctagcatgtgaaataaaaaaattatttcttttttcaaagatttctttttattcacctgccatgggaaccatgtagagaatgggaaacggggaggcagaaaataaatgtgtttgaacataaaagcagagataagcccgacatgttttggatctaagtttcacaaatccacacttacgtggccatgtagatcggtattaagaagcattattgcacaggtaaggcaatggactccatctaaagaaagatacaagaaaaaaaagcatgaattcgcttttcactgttggactccaccttattatcactaataggatacactcagaacctatgaaaacagtactgtgctaggtacaattagtcctgttttaagaaacaaaaaatggataagaataatttatagaaagaacctcaatgcacagaactggactccactgttgataagttgttcttacctctctggaggacagtttggtagtagatatgtaaagccttcaaacaatgtcttttgatacaacaaatcggcttctagggctttgcactacagcaataattagtgatctatacatagtacaaggatatccagacaagcattgcttacaatgggagacaagtaaatatgagcctccaaagacacattactgttaggttaaagtcatataaaaatgttctccaagtagagttaagattctcctttccaaacactacaattagttgttctcgttactctcactctgctaattctctacacaagtacagtagacaatagcagtttcagatgcagtaaaaatcttttcaatttacgctaaattagaaggtctaattattgcactcataaattaaagccagggtattttcaaaagtaagttctttagtatagtaggtgatttctgttatcagtgtctctaaatagacactaccaaatggctaaaagtatatttattctagtaccactttattatcacaagttctacatatatttaaaacaaattctcgaaagtattttaagaactcagcagccaactctcaaatatcctcatcaacagccaattaagtcacgaatccatatttcttattttatccaagaatgtaaacatattcttagatttgaagaaggttctaataaaaatggcccacttttatctccttcattctcttgtcagggctaatggtgacagagatagtgaataactggtctgaatagcatcagtttaccgataggaatgtgaccttaatcaggtgataaactaactgtgactgcagccttggacatggaggggaggttgaggcaagcaccttggccaataccaagtaaactatccaggttaactggcaatactgaagctaagaggtaattactatttcttgggaatctagtctcagtgatttactccatcatctgtaagtttatgaaacattttccagtcacaagtcaaagtgcttcacttcaaacactgaaaagtgtactttattgcaggaactgaaatggaggaaagatctctcttcacaaggtaggtccacaaacaaacagtttaccattaagtcacttactttgtaaaaatagtgtaatatgcataacctcatagtttattaaaatcatcaacaaaagtttgtggtcagtatagtacaattaatatcaaacgaaagcaccagagacacagcgcaaccaccagtgagatttgttaatttttccaaaactaactccaacactcaggatacatgagctttcatcaagaaacatagagaccaaatgtataagaaataagaaaactgaaatttcattcattacataaaatctcagagtgacaaaccatgaacaatttaaagaaagtacgctgtcacactagagaagtggaaaacaaaataatttaagtaagagtagaggatatcatgctgtccttaaatattatgcttttaaagaatatttaatgacatgagaaaatgctcacaatgaaataaaaaggcagctaaaaacaaaactctaattccaatttgacattaaatattaaatagactagaatgaagtaaacagaagtgttaatagttatcactaggtaactgaagatacataatttctcacaataaaatttaactttcataataaggaaaataaccattgatataaaaaagaaattcaaggatttgtatcagattaccttgtgaagcaatggtatctgggttacaataaaaatatctattggagaagtgtattaaaactctctctcgttcttgagtttctcccacaagagagaatgctttaaagaaatacctacaagagaattaaaaatttaaacagtgaaattttcgaaaatgctatcacactctttcatagttaaaagtcaatttatataaacctaagatattaattatacaaagtaagatattatgaagttatctccccccaaaaaaatcatttactagacagccattcaatataaattggtattagtatttaaattctataaaaagcactgtgggaggccaaggcaggtgttcacttgaggtcaggggttcaaaaccagcctggccaacatggcgaaaccccatctctactaaaaatacaaaaattagccgggcatggtggtgggcgcctgtaatcccagctactcaggaagctgaggcaggaatcgcttgaacccaggaggcggaggttgcagtaagctgaggtcgcgccactacactccagcctaggcgacagagtgagactccgtttcaaaagaaaaaaaaaatgtccacttaaaagatgacagggtgataacagagtggtcagtacatcaagaaagccttgggaaggtaggtaatttcctcattatgaccaagtgtcaagtagccaattttaaaaggtcagatttaaaaaaaacaaagaccgcttaagactcaatacatcatcataaaggctatgttttaaaactctacacgcatcagggtgcttctgtcattttgttacatgactgtcatctctattaaagccactatggattgcattgctttgtgcacaggagatttctgttaattgtgtctgttatcacattttaatattaatttgttataggaggaggaaattgggagatataagtaatttattccttacataatggaattagtttatgtataaaaatatctttaaattataggaagtgtatcaaaaaccacacattaatctactcggagtcactaagagcactgtttatttgagatgaatccagatgaccctcacttgacaatgtagattcattttcctaaacatgagatgggaaggaaaaaaaaaatcattcaaaatgtctaagaaatcttactatggtaaaaaacataccatgagcctcatttctatgaaaattttgccttcttccttattataggtataattaagattaacaaactatatattgacaaaactttaatttttcataactttaataaactacatcagaatgcaaggcaaaaatacagatctttcatccactgataactgtttttgttagaaaatctgagtacctttgctgcatgaaaagagccccacgataaatcactgcagtactacactccagtccaaacatcctcccttcacctcccagacctcagtttcttgatttgtaaaattaaagggttacactagatgatctcagaattcttccagacatggacattttataaatagtgttgaaaattaaatgctgactaggttttaccttcagctacttagaaacttgtaatacaatataatgtaaaaagtgagaatcagtgagttttagacaccttcatttgaaaaggtcagaaaaagtggatattgttgcaaacagttttatagatactttctactgattatgctgacattcatttttattccactgaagagttaattccaaagtatcaccttaaaaggctattggggctaggtgcggtggctcacgcctgtaatcctagcactttgagaggctgaggcgggtggactgcctgaggtcaggagttcgtgaccagcctggccaatatggcaaaacctcatctctactaaaaatacaaataattagccaggtgtggtggtgcgtacctgtagtcccagttattcgggaggctgattcaggagaactgcttgaacctgggaggtggaggttgcagtgagccaagatggtgctactgcactccagcctgggtgacagagcgagactctgtctccaaaaaaaaaaaaaaaaaaaaaaggctattgggctatagtaagcaaatataataagcaaatacttaggaaaaaaatctaattctaattctacaatctataaactgtgtgtgtgtgtgtgtgtgtgtgtgtgtgttaaactcatcattcaaaaaccaaactccctactcaaaacaattgaaaacagggtcttgaagaaatatttgtccactcatgttcacagcagcattaatcacaatagcaaaagcatggaagcaacccaagcgtgtcctgaagctgacggtggtatatatattccccataatggggtattactcagccttagaacgggaagacattctgatatatgctacaagaatgaaccttgaagacattatgctaagttaaatgaatcacaaaaaggcaaataatgtatatatcaatttacattacagtagtcaaaatcatcgagaagagaagtagaatagtgtttgccaggggctgggggaaaggaggggaaggaaaaaaaaagtcattgtttaacgagtatggagcttcagttttacaagaagagaatcatggagatggacggtggtgacggctggacaacattatgaatgtttttaatgccactcattgtatacctaaaaattgctaagatgaaagattttatgctatctgtattctaacacgataaaaaaacgaaaaacagaaaaactcctacagatggcattttttatccagatttgctttgctaccaattgtttaccacctgaactcaggcttaccagtaggtgtagactatcaattcatgtgtcatttcgttaaatgaatacgtttttcttactctttgctgtgtttaatatctataatacaatttgagctaagttcacaaactacaggttaaacgtcccaaacccaaaaataagaaatctaaaatgcttcaaatcagagatgctccaaaatctacaacacttttcagtgctgaaataaggttcaaaggaaatgctccctaaagcatttcagattttcagatttgggatgttcacttggataagtataacacaaacatctctaaacctgacaaaatccaaaatccacaacacttatggacccaaacattttggagaaggaatactccacctatacatggaggtttaaaaaaaaaaaataagattctagctagaagacattactttcttctctaagaactaatcatttgaaagcaatgacgagcagcaaggaggcttagtcatacctgagtgactgatccagcgtcattcctgtaaaatcaaaaaacttcagatattcttctgcaactagtttgctaaattcgttgctataagaaaacagaatagacttggttattgaaaggtaaactatttaaaacacacacaaaacaggagagaattcagactccagcaatgggtcagaacgtacttcttgccaaggtgttttgcaacatctgatcttttgaatctgtccagctgataaaggcgtttggccaaccttttggctgcttccacattgctgctggtaccattactgagattttctggggtctccttttccaaaatttcagtgctccccatttcagaatgagcttctagccgtgttgttttcaccccagcattgctatgataattgataaagagagaaaataatagatttttcttatatggcaaaaaggaaaatatctgatgaaatattgatagttttcttttagttcagctacacttagatgagatcactgtatgtttaaatattcataaaaattttttcagttaccatattttaaagaactaaagaacagattgcctaaatcttaggcaagcagttcccaaacttttcagtctctagacctttacattcttagaaggactccatacggctttcacttatgtgggttatacctaccgatatttaccctcgtagtaatgaaaatagaaacattttaaaaattcactcacttaaaaataaatctgttttacataacaaatactataaagatacaactattgttttccagaagaactaaaattcactgtttttttaaaacacaaatttctttaacagctggcttactacaagacagttgaattctaagagccatttctacattcaatcagtaacaatatattattttggttgaaacacattaagaaaatgtgccctcactcatatttcattggaaaaaagaaatattttaatatccttttcagataattgtggatattcttttttgatacaacaccaaagtgagacaagtggtagtttcttaaaggatattcttacttgcaatatggaatctaaatttgtgtcgattaactttttgtactcttatattaaaatctatcttatactttgaatggatcttttaacccttacatgattttgtaacatcacacattggttatctgcaaaacatgtgttgacacatttcattatataaccttaaaaaaatcatattcactaatgtcaccattaatgaaaagtctaagtattgggaagctgccaaacctttgcgggcagatacaagttttccaaaatcctaacttttgttcaaaagctcaaatgtaatcatttgctacaaattattatcagctgttttccttaaagtaataggcttactccattttcaagaaaatgtttgccaataaccatagtttgtcagtcattctctcaaggaaaaatgacattcaatgaaaaaagtgactagtttttagccccaacttaaatgacagacgaatgtttttcctggagactaccaggaacagaagtgctttattcccatttcatcacacacaaaattaaaaagacatgatctcaagcgctgaaatgaaataaactgtactggtttcatcaaggatttttttaaaggtgaaactggcctatatttttattttgagtgcatgacagtggagaatacgatgactagaagagtttggtgccgctgccttaagttctactaagacctccactattgtttttgcaccataagatatcaacgcagtgaaaaacaaaaatagtgttataataattagtgtaaaacaattttgatctcataaacctaactgaaggaagaaagctccacaggcaacacgttgagaactccgccctagaaagggcttaaagactacagcctgtggtcaggtatagagggttctcttgtatttataacagtgaaactaatgaggatacattaatttccaaatctttatcttaacttggaagtaagacatgctcataataaaatgtgcttacacggccttcgaacacacttaccacagatgctaaaccaagggcggtcagaatttttccataatggatgaaataataaatatcgtaggcgtgcaggccacatatggcccctgtcacacatgctgctttgttgttgttgttttgttacaaccttaaaaaacctaagagccatgccagctgggctgaattgggcccatggatgggagtttatctgcccttgctctatcccatagttctttaacttggcttgcattaagcacaataaccatttactgtctaaaccaggacactctaaaggggaaacggagataataaatccttaaatattctattataatcattacaaaataaataaagaaggcattatcaataaaaaagcagtactgctaatgggcattgtttcttttggggtgatgaaagcatccttaagacagtggtaacgactaaacaactctgaatatgcccaaaccaccggattttatactttaataaagcaagtgatacagtatttcaattatctcaatggtgttatgtttttaaaaatctgaacctaaaaaataggttgtaaacttacatcacgaaatgacaaaaaccattgtagtaaaaataaatgcatttctaagcagaactgctccatcttgtcacttattctacctcatttacaagttcccttttcccactgctctaccaaggaagcactggccttatgcttcaaggtcactgaaaaagcagccagggctcctggacaaccagctggtataacaagtagctgcaaagtctcatactccctcaaccaccacaggattagaaggagttaactgtccttagcaactcttctccaagcacactttatcggcaagcacctgacatcctgcccttgaaatgaagctctaagaatagggaaaagagagagagttttttagactcaactgtgtaaaaatgtcaactcacacattcccagatgataccatgggagaagctgggaatacgaagttaggtctaccaaacccatgctggcttattttgccatagctattaatggtaatagttcagttattaaaactctaagtcaaataccaaaccacagtcaatatcaatggcagaacagcaggcattaactggaactgacccaggcaaactaacatgtatggtaaccctcaacaccttgaacagtttcccaatacacatgcctaccagttaaaataaattgcttcattatgataaaatctccatgaaaatacatttttaaatgcatgattttttcatcctacatcttcctttatagacttaacattacatggctgggtgtggtggctgaaacctgtaatccctgcacactgggaagccaaggggaggactgctttagcccaggagtttgagaccagcctggacaacacggtgagaccctcctgtctatgatgtaaacatttttttaaaaagagacttaacactaccattcagttttgtgaaatctatcccatcaggaaactgaataatcattatcgacagtataacctataataagaaaactcacagtagaaatttcttttaggcaattcatggttactttgtgttttcccatacaagtgacagaaatgtaaaatatttattccaagaactacgttaattacaatcaagtactttttataattatacaaaacacaaaacaaagcccttggagttgtgtttccatgtgtgcttttcctatcatgtagtaaaaacacatgtcaaagaaaggattttcttcttaattaaaccactactcactgctcatttcccagggaaaattcatggcatttatttaatcattctgtgcaaacaatgtaattataccacatatacagtactggcccaattttgttcaaatacaagaggcttattctaatgagaacacattttaaaaatttattacccaaaatcattccattcctcatgttactcattctccatatttgccccttttctactatgctgcccagtccagatgatttcacctaattttcctcacattcaccaaaaccatataattgcaaaatctgtgtgcatcagactttctggatcttcttcaaaaaggtttcagtaaaaggagaaaataaagcacaaaggataaatatgtccctagatggcttcattctgtccatttcacagtttaggagattatttgaacaagaaccggaattgctccttttaaatcagaaagcttgacaatatgatggcaatataaacttaccagcaaccatacagacaccaagaagagcccatcgcaacccctggggtgcgcctggaccatccttcctctccgaagccccgtccagtattcttcagctcccaagttcagtgactgccgagcctcacagccttccaagaacctggctccctgtgaggtcacactactatgacctcacattctcagccgagtgttcattgttgcggtttctgtaatgtttctgcagttctaataaaaacagcagccagaacacaagggccactgtctatcgagaacgtaagaaacagtgagcccagcctcgttcacacttgataaagccaactcagtgatccctctcggaggggataacaccccattttgttttcttgaatacacaagacattgcagctctagtctgctgagcattagatgcgttctgtagtttggattttctcttttctatggttgttttattttccctctttttcttgatcaaatcactttacagcctagtaaggttgcaaataaataaatccctaccagtcacttaaatgtgtaagagacttcccaaaaggttctccctgtgttctagaaaatgcttccctggggcctttatttctgacctccaagtaaacatggtaataattctctcatcaaaacactgcatcatcaaatgaaggaccagatcattgactctgatcaccatgccttctcacaaccttttgaatcatactaagattggcagattttccaaataaaaatagggtacccaataaaatttgaatttcacatcaaaaaacagtgtctagtgtaagtacgtcccaaatactgcacaggacatacttatacaaaaatattattcatcgtttttctgaaattcaagtttaactaggcatcttatattttatctggcaaaacttcctgaaatgtttttttctaaactttatttcaagaattccaataatggtgttccatgattgccaactggtagcttattcacaattagaatccttctggattttttcacttgtttctgcgattttattcctactgtttttctacagttttatcaagactttgttgcctataatctactgattcttctctaacgtcctctaaatacaaaaaaaacaaaacaaaaacaaaaacacaaaaaccctcctctgtgttttcatccttctctcttgacctgcatgctaccaccacaaatgtgataatgtagccactttacacaaatcctacacaagatccatattctgtagcatgtcctaaggccttttccaagctgaccccaatttcttttttcaacctgtcctctaccatttccctcctacttgaaccacacaaatacaagctgtgctcccatgccttttacgtatgttgttccctttgccacactcatcacccccagccctaccatgccaaattctgtgaactcttagtgctatcttttaaaatctcatcgctttcacctaccactgtcttgaattctggtttgaatcctcaacacaaggggcggctgaaggtactcaacagccatctgctaagagaatgcaagaacacagccatctgccatgtctacttcctccactgtcttccatgctatgctatcaataatggtatgtggcactaattttccaattcactgtagctaatcctggaaaaaaactgacatcagtagaatactattgcctgtataaaacaatatactcaatagtgtactgttttactttcaatttttcccagaactttaataaacagtatactattgcccgtttcatacaggcaatagtatactttgaatttaaatttaaaatttctttaaatttttatgtaattgtggtaataaaactaggaccaaaaagaagttaggttaaggtgtcaaagctccctgtatgaccctgtatttataaagtgtaccccaagggttgtacatagaaaataataacagccacctagtcgagttgaattttatacataacttaggcaaaggcaaattagaagaatctcaaggagtgagaagaaatgacttcagctgcaagtggaataaaaagaccagtgggaacaacatgactcctttgccattcttcaggctgatgacatagaaacacagaagactggaaccaacagacaagagggcgggtacaaacgcacagcttccagggctgaaatacaagtcagaagtaagtacaccatcagcaaaaaataagtaaaaccctaaatcataaattgcctctgaaaagggaaaagaaaataattttgtccatcattatctatggcatttatttcctaggcattgtagagagcacatcatctaattcccaaagaaatgtaaatgagaagttattcagaagagccatagcacccaccatggtaccataaacctaataggttaacaatggttaggcatttactatgtgccagcctctgggcttcttcctagggattgaattgtcagtcttatgaaacaggcaatagtataacccattttacagatgggaaaactgaggcaaggagctggacatggtcagtgagactccaatgctttactacttttataagctttactactatccattttgctcctgccagtcatcttctggtatgtctgtcttcaatgattcaatgaatacgtatttaattccctatactgtgccacatattttaggtgcttggtagactacagtaagcaaaacagaattaaaaacttctaccctgggtggggaggggagctaaaaataaagaatttaataaataagtaaattctacatattagaaggtgacgtttgctctggaaaaaaatagagcaaagatagaagaggaaccctaatttggggatgagggtggaaacatttttctacgaagtggtcatggtaggcctcatggagaaggcaacatttgagcaagatgtaaaggagataagccttgcaaatatgataaaataacagcattccaagcccagagaaggcccaaaggctgcagcatgttagatgtgtgagggcaagcaagaaagccagagtggctggggcagaggcagtgaacggagaatacccagagagcaaatgggcttgtgggatggaggttcccacattttctcgactcagagtctttaatatgtaagttttttatgacactccaaggccaaaggaaatatattccatttagtaacagaataatagtgtataaatgcttattaagtttggacccaacaatttacagtcatttgaaaaaacaatacatacaaattgaaagaaaaatcatttttattattaaataacgattgcttactaatagatgtgtgtgcctctgggccatatgacttcctaaatctcggatcagactgaacaccgccactcatttgttttctcatagcacttaatttttatcacaacaactggtgaaaatccagctcaaagctatgacgtcaaaaggaatatagcacaatctgatgttgacgctgaactagctgttcacatgatgtttgacagatgatgaggagagctgtgtttcccttgacaatttaaatatcctgagaaacacctgtgagctcactgcaatgccccagaacacctctgcagagttggggaacgactttgttgtttaaaggccttgggggccactatggagactggtttttactcctagtgaaatggttaatattgaagggttctgagtaaagatctaacattaatttatatttttaaaggatcactctaagtattgctttgaaaatagactggagaagcagggtgaccagtcagggggtaatgcatgtgccagggaggagctggcttgggtggcagtaggggctataggtcccggaggacctgccaactggtcctttgggagggctgagagaatagtagttaagttttagtcctgagcaacttcaagggtggggttaccatcgaccaagacatgaaagaccaaagttaacacaggttgtgagaaaaagaagttccatttttgatgtgttcaccttgagatgtccattggctatccaagtaggatgtgaggacacgtggagatttcaggaaagacacgtgccagggtgcactgcagggaattctcagtcgctggcctgcggtgggccctggcattcttctgtttaaggaccaagatgatcctgatgcactgtcagagctttgagttacccctctaacacacaggaagtcactataggtctaaagagaggaacaacaatcagacttgggttttggtaagatcagttttgcttgtggtgtggagggaaaactgcagggactcaaaattgagacagaaaaaccagctacaaaaggtatcagaatagtacagtcaagagatgagaaactaaattgcgtgtctgtgtgaatatgaaggaaaagcctcctccgaaagctatttagaaggtaaaatggaagaacgggatgagtggcttgagatgtgcatggagctatgttcaagggtgggtacaagactaaccctgacttaaaagctggtggaaggtgatgccaccaaacaagacaatgaacacaagaggaagaagagggaatgggtaacagtgtgcacacatggaaagaaacaagcactcgtggaagaccaggagtttggttcgaagaaacgataggtacaaggtacacacaggttaaccaggcagagctgtctggtagcaatggcaaccatcccctgtctgcaagaattcagtagatgtgaactagtcacccttatgttggtggagggaatcacctgggagaggctagagcactcaacatgaccaaagaacaccaaagtgcgccaaagaaatatgtctagcagtagtgtattcatttgaattctgttacaacagaagaattcaggggtctcccttcatttgttcaggaaattctacctgtgagtgttcagtttgccagcaagcaatgattattaatttagaagatgccaaaagcaattatctgctggagaactccagttagaccacccaagttcaaacactggctccagtggtcaccagttctgggaccttaggtaggtaaggtcatcattgtctgtaacccttaaggtttttagctataaaacagataatagtatcatattcacaagctgttgtgaagatgagatgagaagatccatgtatgatgcttggcatgtaagatgtctggcatacggtaaacaaaaaacgtctgctcctatcaccagatccatcttcgtcaccaacaccaccagcatcattaaggttatgatgacgtgagataatacatgacagcactttattaaatataaatctccatacaaatgttagttagcgctcagtaggaatacttaggacaaacgtctcaaatgaacctgttttcaacagttacatagaatacattccctggaagggacagcctcttatgatttaagactctttataaaggaaacacacaaaacctaattagcagaattcctaagagctatttctctgttcagcacagaagacaaaattcagtcttcaccaataaaaaattttagtaagcatcacatacagattctgcccccagccccacccgccgcataccttccaaatctcagtcctttttctcagccttgctttcactattccagaagagggcacccacatgcaaggcagtgccatggaaaatgacccaaactcactgtatgagtcggggagtctgcatttgctcctgaggcactggcttccaacataacaactgtacttttcacccatgtaggggttcaaacgtttctaggggcatgatgcaggttttcactttttgttttatttacttatttatttattttcctatactaagttgctgctcttgtgggatagctctcacatgagaatgtaatatgtgcaagtcaatgttaataaacccatattacaatcatttcaaatgaataatttgcaaagaaactcttactggatatccagctttagaaatagaaatacatttagatgcaaacaaatgtatatgctcattgtttgcatagaagcttctttgggcaaggtaggatcagtgagccccatttccggtggacaagacaggaagagtgactcacttacagtctgaccaactcatttttctggagtcttcttaagatgccattggacattctcttctgtctgaatttctgtcaggttgaattagtatcagtgtatatgcactggacatcagaagctgggcagcaaaaggcggcacaaagcacaaagtagacatgccttatgtggataagaactacaattttcatatcttaaacagtttgtttagtgtttatgttaaagagctgggtacccacaccaccaccagtccttagaatactcacttcctgtctagtgcacaggtaaaatatacttataaatatgaatttagtttgatcaaatactctcctttcttgattaggtaataaatgctacaatctagccagggaatattagagaagttctggcctcccattgctcccacccccttttctcttctaactcttccatcttctgggatacaagaggctgaacaaatattttctatggttatataatgtccaaattttaccatctctattggtatattctgccctttcttcaaattcttttttttgtggggttggaggtgtgggggatggagtctcgctctgttgcccaggctggagtgtagtggcatgatttcggctcactgcaatctccacctccagggttcaagcgattctcctgcctcagactcccgagtagctgggatcacaggcgcatgcccccatgcctggctaatttttttgtatttttagtagagatggggtttcaccatgttggccaggctggtctcgaactcctggcctcaagtgatctctccacctcggcctcccaaagtgctgggattatgagagggagccactgcgtccagcccctttcttcaaattcttacgacaccttttccagtgtcctatagcacaggcgttgctgtgtttctctttggcgtgtttggaactgcgtatctgttctgcagtgtccctctcctgctgacacacccactgacgacatggccgtacggtctcaccttgcacataacttcactttctctttatgcacgctacaggcagtttctacagcagcagcctgacaacatatcctctctacactgagtttcccctaagtgctacctactacaactacactgaaagctgctctatgcgatatagggaaggtttcttggattcacttaattttgtgtgcaatgttaaaaaagaggaaagaattagtaccctggcaagaatacaaggagtaagaccctccccttaggaaataaaatcctatctctgtcacttcctgctttcatctctttaaaatattccagctcccctggagacagatccaaagggtcatcttcatctggggctatgggattaacaggggacgtttccactctttagtacccaatatgaatgaattagtaataatatcaataaatattttgtcttaacatatttttatgaagaattccagaatgtttactctgtttaatacactattttaagcactttatactaactcacttaatgcccttgaccttacgataggtacttccatcattcccattttacaaaaaaggaaactgaggtatggtgcagttaaataactttgccatgaccattctgccagcaggaggtaaagctgggattggggctcagcaatggcggctgcagttgtgcattcagcctcttaactaataagctatgtggctttctaaccgatattactacaggttatactgcacgcataactttggtgtatataggaacaaacatttctactttttaaaggacatctgtatatgtgtttactatggttgcataattaagtatacacaaccaaacctgcacaaattttcactccaattatttatttaaacattgactatgtgccagcacatttctaagtgctaggggtgcagccttgcccttgtggacttttaccttctaataagagagagaaacaataaaatacatgaagagttttccctctgttcctgcctttcaccctcccacaaatatctgaacatgttacgactcacacactgttccaggtaaatattaggtctaataaagcatcaacagatgaaagtccttgctttcaaggagtttacactcagacagtgacattcataagtgccttggagataaatatagctaggtatgcaagaggagagggaggggttgctattttattcacagcactcagaaagtaccatgtgagtagaaaatagaaggaactgaggatgtggctttgcaagctatcttcagatcatttcaaacaaatgcaggcctgggcaagatggcgtttggtaagttttaagtgatggcccagaggagcctccatggctggagaggagtgagcaaggggaagaggagttaaagagtcccaaggaaggcctgaattcacttacaatttcaaagtagtcaatcacttggaagcttcaaaattaactgccgattctccaacttccacaatcggagaaggtacaacaatttacaaaaggttattagtatcatatatgtactttagacacatgttagcttccaaagttcgtgggctgtttcgcagttccccctgtaattctgcagtacctctccatgaccatcacatcatctaagggtccagactcttatcaatcacctaattcaccctgtaggtcatggattcagagcatactctccccagcactgtgccccgagggctagtctgtgatttttctaaggctgaatccttatcttaatgaaatttctaacacagcaccttggataatggctgggctttaacatacgctcagtacaactgtcctaaatcaaattgcaagaagcttaaaggaaaagtcaaacaactgtgtactcgtctcaatgcagctatcaacttgagtagaagatgcccaaaagcagtaattcaaatgttttctttcatgaatctgtatacaaagctgaaagtttctgagttttattgtaagcaatttccttattacggaatctagagactctgatcagcggaaatcatctgccaatgagctctctctatgttgcagatcttttaatgcttatcccttattgttgccaaatggggagcaacgtgaaaaagtggcaaaagcaaagtggacagaatgcagcggtgaagaggggaaggtcttcagctcttaatatctaacctaagaaaactaaaaccatgattactaaatagattatatgcattacgttttttgtttttggttttggtttttttgagacggagtctcactctgtcgcccaggctggagtgcagtggcgcgatctcggctcactgcaacctctgcctccccggttcaagcgattctcccacctcagcctccctagcagctgggactacaggcacctgccactacgcttggctaatttttttcatttttagtagagaaggggttttgccatgttggccaggctggtctcaaactcctgacctctggtgatccatccgcctcggcctcccaaagtgcttggattacagacgtgagccaccgtgtccagcctacgttacctttatgaaagacaactattgttgtcagtttctacgcttttaaactagtttttccttcccttcatttattatattttaaagtagggagctactttttttttttagggagctatacatgatcttactttgccctttgatttcacactagcgcctcctagaaccaaactacctgtaaggcgaggagggtgagcgctgtgttctttaatgtgaattagatgttatctgccatctaactcaatctcaaagtgtttggtattttaagactgaaatcatggcattttggaggtaaaaagaggttagtgacataagctggaacagattcagttattgggcacaagacaggacaatctgctctgcaaataaactgagaattaaagagacccagtagacaacaaatttagtgaataatgtcctctccataccccccccaacaaccagcaaaaaaaggaaagaaagaatgaagagtctttaaaatcagttgggaagaaaaacattgcattttctggctttctaaaatgtgacaaggcctttacatttataatcttatattagtgacagtcagaacctcctaacagattgttagagtaaatttaaataggaatccccttggactgataaatgggggcaggtgggttggggggaaaagtcatccctgccagggctcacaggtaaacaagcagaattcagggcatgtctgcctgttacatcagagacccttgatgtgatccagaggaattgtggagtaatctggacaagcacctacctctaggccacaaggacttaagaaagtgaactggagaacttcccggcaagactacctaacgactgttcatatcaaaacaactggtacccagagacagaactcctgactccaaatccaacactttttgtccactgcaccattgtatacagcagagatgacaaggtaaacagctgttgacaaagccaggctttccagagggtaggtttagtcaacaaatactttgacaagtatttttcaaggaaactaaaaaagacagagtctaaaggagaggataaagtaacaggcagcacaaaccagcttgaatcaccaaaaagaatccttcagaaccagatcatgagccttcatgaagggaggggatgaggacagaagcagccagagatgctactcaatagaaacaaaaaaagccctccccaaactcttcccctgaacctctccagagggataaggcaaaagtgctgtttttggcaaaactatgtaaatacaaattcatatttcattagttcctagacacattttttaaatatttcaaattctttaaaattagaatggatttttttttttttttttttttgagatggagtctcactctgtcgctcaggctggagtgcagtggcgcaatcttggctcactgcaacctccgcctccagggttcatgtgattcgcccacctcagcctcctgagtagctaggactgcaggcgcccaccaccacgcccagctaatttttgtctgtttagtagagatggggtttcaccgtgttggccaggatgatcttgatctcctgacctcgtgatctgccagcctcggcctcccaaagtgctgggtttacaggcgtgagcctccgcacccagccagaatggttttctcatgcatcaaccagtgtgaaccctggcagccaggtggctgtcagacttttattacctgtgcacaacgcaaaattatactgttggtttaatcttgatttaattgatgtttacagtgtcttcaaaaagatgctataaaaggtactgagacaaaagtattatttatgcaggcaagcatcgagaatatgccaaagtcatttgtatgtaaaaatctgtaagtttaagaattattagaaactccaagagaaagcactgtgtcatagttaattgctggcatttttttccttttttttttttttttcttgattttgtatttaacaccattttctccaagtgaaatggcatattcttttctggcagtagcagaaaatatatgaaaatatacttttaaatatgtaaaatataaaatataataaattaagatactgacttatctcccaatcaatagtatcttagattcaaaaaatttgatgttgtttgttttcactagtactgtcatcccttggtatctgtggggtactggttctagaacactcccctacaaaataccaaaatccatggatgttcaagtccctgatataaactggcactcagtatttaaatataacctatatacactctgctgtataccttaagtcatctctaagctacttttaatacctagacaatgtaaatgctatgttaatagttgttatactttattgtttggggaataatgacaagaaaaaaatacgaacattctcagtagagatgcaaccatttctttttttttaaatctattttccatctccagttggtggaaactgccaatgtggaacccacaaatacaacagtctgctgtatgcagttgccttaaaactcagtaacatttaattctggttttcttttctcttttgagacagcatcctgctctatcacccaggctggagtgcagtggcggaactgcagcctcagcctcctgggcacaggcaatcctccctcttcagcctcctaactgggaccacaggcgtgagtcacaatgctcagctaatttttaaaatgtttgtagacacaggggctcatgatgttgcccaagctagtctcgaactcctggacttaagtaattctcctaccccagcctccccaaatgctgagattataaaaggcatggagtcactgcacccagcctaacgtttaatgtttaaaaacaagattttattctgtttattttcatttataggtcatgacattcaaacaatgacggcataaaaattccttctgctttgggcaaaacaaggtattttgaaattcttttttttttttgacatttaattctaaagttttatggccaattcctcaaacaagaccattcaaaaagctacagaaattctctctattcaacgccttttaaaatgctatttttcagtgtagctaaatgagaatgatattttgtaagcactgctattattagagactaagaatacatttgagattattattagaattttactttttcattttccaaaaaaaataataccaggttccaaaaagctgcaccttgagattataggtaactattcctcatgaaaaaaaattacaggttggatgaaatttgcgtgaattagttaagaccagtatttataatcaaggcctaacaaaattacaagctcttgagtttttcctaacaaaactgaataatattgtttctcatttgtgaccagtttctatggaaatgaacaatattccagctaattcaaacactgctgcagataatattaaatagcaatgtcattttaattccaaaattttgacccccacaacacacacacacacacacacacacacacacacaccccaataacaaagctccaattccaggtggctcttaaacttctatacccatggcttcaaataataattttgattttaagtcataatttagcctctcacttcaagtgttttgagaagggaatacccacacacacatgcacacacatgcacacacaccacacacacacacacacacacacacacacaaatggttgcttagaggacaacctccatcctaagaaaaaataagactggcaagtaatcgagttctttaacttctaagcccccgactgcagagtcacaatgcaccttagtacccttagcaaagacaataaagacgtaaaagtccttcagaaaagaaaaaaaattttctttgtttcaccaccttgataattttttgtttacttcctatttactttctatcttttctacatgcaacacactctttgtgaaacaggcattccaacttttgctaagctattagatttacacaataaggtttttttctacacagaaactttggttgagaaggggccatgggaaggtcttgtacatgatacaaagaaatatcctaagaagaagtatgatgcatagccctaaataaagtctgtcctgtgtcccatccagttctccaaaggacatcattcaggcatcacttgacagcagaaccaacctgtgttgttcctttagtagtagtacagtccatccccgggagtgtgttccaagtaccccttcaccaccccctaagctggacaaacatactcttaagagcaatactccacctggtgcgagaataaagtagaatcatcctcaaattcaactcttaaaatggcaaaagtctgtgacctggctgtgatgtcctgtgtcaaactgtccctcctacgccaatatctccctagcgacagtctctgcctcctgacctaaatgacataagctatcagtgtgaaccactaagcaattcccaactatctgcctcaagaagctgcatatcagagatgaactcagaaaacagcttgcactcatgttttatgactttcagagaacactgacatttcagaatgaaattcaccacggaaaagtcatatgctgacctccctagtatattaaccccatgtacatctcatcttctcaaataaaaaaatccatgtcagatgaccaggttcaggtattttaaagtttacagcacaagaatatttgcttaaatgtgcttctcctaggtcctggcactacctcactcccatccagcacatgtgctcactccaaaaatggcaagccgatccaatcaatcagctcttgaagtttcaatttaagctccattctttaatattatttctaaagcatataatagataatattaatctggttttataaagaaggaggaaaagggagaatggagagacaggaaaaaaaaaaaaaaaaccttatcacttcaataactagaaaagcatacctgaagccaaaatagacctgccagtctggaacttcccctcagaggatacactcctttcttcggagtctgcagaaaataagatgcactttggcaccattcttcaagctcgctttaaaatttctccttcaactataatcaagtcatctagacagtctaagttttacattttgaattcctatcattggaactagggctgataaaataaaaactaaacatcctttaaatcagttaaaagatctttaccctagccactcaaaataagaacaaaatacaagtaaagtggcaataatagcaaaggcgtgaattctcccctcccctttattcactagaggtatgaaaagtcctgccctattgatgatcaaaccgccttctgggtcctgccacaagagatcctgaattccgcaacttatcattgaattctgcaatgtcaccagctgcaagtcacccaagagatgacgtttctacaccttgtcacacagtactgtcacatgctagtcactccatagcaactaaaatacttgcagatgtaactctcattgataccatttaaaacttgcctaagtttttgggaaaatgaggacaccatacctcctctctccttacaattacacatggtgctttatcttaaacacactcacacacacacacacacacacacacacacacacaccccattccatgttcacaagtgtttcctaatacgctgacaaggcggcctagaaagcactataaacttagtggagaaaaagtgaggtcaggcatggtagctcaagcctgtaatccctgcactttgggtggctgaggcgggaggattgctcaagcctaggagttcgagaccagcctggacaacaccgtgagaccttgcctaaataaaacaaatttccaggcttatctgtacatgtctgtggtcctgcctacttgggaggctgaggcgggaagagcacgtgagcccaggactttgaggctacaatcaggtatgatcatgccactgcactctagcctgggtgacagacatggccgtgtctctaagaaaatcagtaacttttttaaagtgagacccaggctatgtcaattttccaaagacacaaagatacttagatataaagttagaattaaccacatgtatctgtcttcagtcctagagtaccttccacagtaaacattccactgcccttatatagttgaaaggaaggcaacatggtgaagagaaaagaaatgataaatttggaggctcaagccgaccaaagttcaggtctcagctctaaattatgtcacctttctcatccttagtttcctcatctgtaaatactaaggatcagaacacctgccttacagggttactgtggggattaaacaaaatcagtaactcaaaattaggtattagtcttaagatatttaagactttaatggtttctgcttcccagaattcttgattttacaaaatagaaatagaaaaattaaattctgcgcaattcccagaataaattcaggggccatctatcactggctaaggcatacactttattatctatggtaaatgctacaaagaaatgtgtagtgtttgggggaagcagtgaataagaacagagatcaagatggctttgtcaacacctgactgcgatacagataactagaagagtcaaattagatccctaggcagagtatcaataacacacagtacttcagccagcgtgccagggcatacacgagtccagcatcatccttttagtcaagtatttgaacaaacaagaggacaagaattgccctctttccataagtccccccaaaacagtattctataaaaccctagtgtgctctaggctctgaaaaatcaaagctataaaaaaatacacacatacaatgttttaactttccagcatttctcagatttatttgactatgaatcattttgtacctaaacagaatttgaaaaaccctgcctttctgcaatactacaatatactagtgcagtccctgaaacttatgtgtgtattagaactacatgggaaattgttagaggcaactttaggtcccatctcagacctaaagtttgagaacccaaaagttagttatatttcaaaaggcatcctaagttctaaacaaatttagaaaactactgcaccagtaggtttttagagttgtcagttgtgaagaccaccagactctccaaattcagtgtctgtaagagtcacctgggaagcttgttaaaaacacacatggccaggtaccacccccaagagtcagattcacaggttctggggtgcaacccggtttgagaatcacaaatggtctaactaggcattcagtgtccactggctataagcatcctcaccgtaactaccttgtattttattagaggataaataataattagggatatgagtgttgaggggaagagaatcctattcactggtacaaattaactcagagggtttcagtattttgaatgaagatgatttcttctttttccagtcccagctcaaaggagaggatgatttaagaaattatgattcatactttgaacattactgttttaactgatcaatattttcaatggactgagaacaacctgtgaaaatctgatctcttccctaacctccacacgcaactcattgctggctttaaaagcattagcaaaatcagcacatcccacagggatctatgtagtcgattcacagtctcttcatttgatcagaatcaagttcttccgtatttccccctacagcaaaaaggtcctgggatggttaattttacgtgtcaacttgactgggccacaggatatctagacacctggttaaacattgtttctgggtgtgtttgtgaggctgcttctagaagagatgagcgtttgagtggtggactgagtaaagcggatggccctccccaatgtaggtgggtatcatccaaagcccaaaggcctaaatgaataaaagggtagacaaagtctgaattcaatctcttcctgactgctaaactgggacatttctcttttctgccctcagagctcctggttctcaggctttcatactcagactacaatctaaattatcagctctctgtcgctcaggccttccaacaacaccagaggcttccctgggtctccagctcgcagatggccgatcgtgggacttcttggcctccgtaatcacgtgaaccaattccctataatgaatctcatgatagatagatagcacctattgattcaatttctctggagaatcctgttacaattacactactctctacatgaactggacccaaagagaattgtatcagtagcaatttcccttctaacttgcctagtccaacttactatatggctcatcaaacagcacatcttattactttattattaccttatattccctgtgatgtaaataagattattcctcaagatcttttgtatctttcccttgggaatataaattgaaatgttaccatcaaagaaggaaagagtcatattacctacagctgattttggaacatctactgtgttatctttgaagtttgaagaatgcatgtcagcctccataagtttggcaaaggccctttggaaaggcttgaaggttttgtttttgatttttaaaaatctaattatggctataaacacccaggatcaactttcattttgtactcaacactgagatgaatatttctaaagccagaggcagtgtactttctacctttcaaatgtactgtaagtcctgggccttaagtgctataatataattagtaccagctcataccaaagtgatatcaatggtatgataatattatcagctcacaccaaagtgatatgaatggtatgataatagtatcagctcataccaaagtgatatgaatggtatgatggttctgacattgtttcgtaccaatattaatgtcacagttaagagcagcagcttaagaggaaaacaaagttctctcactgatatcagttaccaagcatgcatccacacctcctgccgggcaccatatgaataaagagcaaaatacagctccctatacccagaacttcatagtctagagagtgaacacaaactctgcacagaaaactatatgcaagacagaaataatggaccaactagtgcttcaatgggaaaaggttacaccacacacaaccctgaaccaaaatgtggcatttaccaggtggagagaaaggaaagaaaagttttcccagcaccagggataggtcacagaagacagagacgtgtaagactgaatggcttgtccaaagcagtgcaagagccaatgtcactagactacagggtgcgaagatggggcagtcagagaggggcgtggaatgcttaggcaagggagctaggaaaagactttaagtgggtacgaaaaatggccagattcaagagcggtaactaggtggtattatggaaggtgactggattaaatagatagattaaatgaattggaatttataaagtgcttaaagcagtatctggcaagtaagtgctatgagagtgttttttaagagggtgagactgaagatgggggtaggtccagttagcagactcctgcaagggtcgaggtgacagatgagaaggattccatgtaaagtaatcaatacagggtggatggagcaggattgtgagtaaaaaagtaaaaccggttgaatttgaggccaattatatatgagagatgaagaagagggaggactcaaggtagacttcaaggtttctgacttgaacaccttggtgaatcatagtgcctttagccaacctttaagcaacacaaagataagccagacttttaggaaggcagcagattaaaaaaaaaaaaaagaagcaaaagctagtatttcacaacacttaaatcatttgggtctcataaactccatacaaggtagacaatttatatatacatatacatatatataatatatatatgtatatatatatatatatatatttttttttttttacaaaaaaaatgaggttaatgagctattccctgaattgcataattaaaagttgcaggcagcagagctacaagctatgtcctctggctccttggctcatggtaatttccatgtcacagatttgccaaaggaaacatatcatcctcatactccagctttctactttttctcctaagccaactatagaaagcagccaaaaatccacccaaaaaatgactttagttttatagttgctggttcttccattgaaggctttgttgtacctccttattagtaatgggaaatacccacaaacattcaagactcaagttcatttatacgttacagcaacaaccaagtgaccacattcaagcttcgatacaagaaagccatcttactcacaattttttttttaattctcttgacaaaaggtattttttacgatgaaaagtcaaactactggccaggcatggtggctcatgtctgtaatcccagcaccctgggaggccaaggcaggcagactgctcgagcccgggagttcaagaccagcctgggcaacatggtggactcccatctctaccaatcaatcaatcaatacaaagaaatacaaaagttagctggggctgggcgaggtggctcatgcctgaaatcccagcattttgggaggctgaggcaagcagatcacatgaggccagaagtttgagatcagcctggccaacatggcaaaaccctgtctctattataaacaaacaaacaaaaaattgggcatcggggcacatacctgtaatcccagcactttgggaggctgaggcaagcagatcacatgaggccatgagttcaagatcaggctggccaacatggtgaaaccctgtctttactaaaaatgaaaatataaaattcagttactaagaggctgaggtgggcggacggcttgagcctgggaggcagagattgcagtgaacagaggttgctgctactgcactccagcctgggcgacagagtgagactccgttaaaaaaaaaatactgaaaatttaaaaattagttgggcatggtggcatgtgtctatggtctcagctcctaacgaggctgagacaggtggatcaactgaaggcacaggctgtagtaagctgtgatcatgccactgtacagcctgggtaacagtgagagagaccctgtctccaagaaaattttttaaaaaacgggcaaattatctaacatttagaatttgaaaagtatgttctctataccatagaaaaactaaaaactcatttaaaaaacacacacaagggagaaagttttaaggttatctagtaacccaagaatcttgagatacatccaaattcttccatagttccccagcaattagaatggatgtcattccctttatctaaaacgttctagtgcctatagaatcccgtccatcaacgccctagcatgctgttccagatttgctgcgtttggctgaccaagtcttgagcctcatttcccactaaatttttcccttgtacactatgtggtctttggctcatgttattgtttcctaagcttcaggtgtcctctcccttctagcacacacatctactcctcctgcaaggctcaaatcagatgtctctatgaagcctgcggaaaccctcgactgacatgacttcacaatctcgtagcactgttgttaagcctctaatagggcacttctttaactgtcttgaaataaaatacatgagatgaattaaaggatactctaccgtttgagagaatttttactacaattttgtaaaaagacatttttaaaagacaaccgtttcacagggcctgatagtaaaaaataataaataaaaataaaaaataataatcacaaccataccttcttccccaaaaagctctgaagataccaaatcttaataactttattttattttattttatttttttgagatggagtgctttgtcagcgagcctggagcgcagcggtacaatctcagctcactgtaacctctgcttcctgggttcaagcaattctcctgtgtcagcctcccgagtagctgggactacaggcacgtgccacaactcctacaaggttttaccatgttggtcaggctggtcttgaactactgtcctcaagtgatccacccaccttggtctcccaaagtgctgggattacaggtgtgagccaccgcacccagccagtaattttctactgaatgaaataggctccagatcccactgagtcctcaagctccaaggaccttgctatattaaagcctttaggtcctacaagtgctgttgctgaaatgtgctcaagttatatttggtgttcccaattaaactccaatagaccacacctaaaccagactcattgtgggtgactcttgccttacaacaagttttatacaccaaaacttctgggcatctcttttagtcatttcccaggaggacacagaacacaggcacaatgcaacttgtttaaaagaacaacagaaattatcttctgtcattcaaagcagaggagcagatatcaggtatcaaagtacactttggttatccaatcaatcactttcatttgttggcttttgggcaaacttttttaaaaaatgagttacctaaagaacaacatggtcgcgaaaggagataaaaagactgcagcataacccgaactccaccccttcggaaggcgtagctgtcctttggctgcactgctcccactgcagtgtagacatggaagtatctgcttcccgtttcagggttctctaatcacagactggattctttcaacctaaaccatctatgagaacagagcatcttggggaaaggccaataccattttcagctatggaaaatacctacaagagccatttactggggaaggagcttccctgaaaccattcattctaggaggcaacattgttaagggcagagaataatggactgcctatccagaaagcgaggcagaggcaaaacaacttagaggttaaaagcaaggacttgtgacaccgaccaccttggttcaaatcctgactctgacgtttgcttctgtgcctcagtttgcccatctataaaatggggtaggagtgcacctaagtgcataaaatagggcagctactattaatctggttctgaagctaaacgcctgcatgacctcaatcaagtcacttaacatctcagcttcctcatctgtaaagtgaaagtattaaatacacacccttctgcagctctagaatggctctgaacttaagtatagtaccacctaactcaatgtaccaggattagcagtctcaacttgcttaattttattagtcatatagtaatttcacataaaatcagtttgatcaccgtatttttagttccagttctccaaggtcaaccctcagttcaacatgacatcaggccagatgccgtggctcatgcctgtaatcccagcactttgggaggccgaggcaggcagatcacccgaggtccggagtttgagagcagcctggccaacatggtgaaacccagtctctactaaaaatacaaaaattagccaggagtggtggcgggcgcctatagtcccagctagtcaggaggctgaggaaggagaattgcttgaacttgggaggcggaagttgcagtaagctgagatggcaccattgcactccagcctgggcaacaaagtgagactccatctcaaaaaataaacaaatgaaataaaataaacaaacaaacacgacatcaaacaggttccctcatgaagacatgttgcaaataaataagctatagaaaatagccaaaaaaggatttggtcttgctattcatattcagttctgagttcagtgtgtaatttatagtaacagaataaatataacaaaaaaaaaatagaaaaagtatgggaagaaaggtaagtttactataacttgagaaaagttgaaacaatgtctttgtattaacttctgaaaacattttcataaactggaaccatccaggctcacaaaagcaaaaaccttcctttctgttgccaacaaaacagcaccaaatacttttatgtacattcctgtgttttcctccaactgcctttttcactctagctcttgaaatatggtctttattataggtggagttctcatactttatgagccagcctgccattttagatgctgtaaaagcccagtggatgtatcactgcaaccctaaagagtaaggaaattaaaggataaaagtataaagtatagggttatatcttgcttcacgtccaaggatgcacagaggtcatctatgtataaaactgcttttttttttcaaattcctcaaaactgtgcacaactccagtaaacagaaggcaggctttcccttcagttctgcatagattcacatcaggataaaactcaaacgttttgggcacaggcttattggccacactcctttcaactccaatttccctacgccgctacttctgccaaccagtacagctcactgtggttgctcaagttcaccaataacatgtcaagcattatcctccaacccccttttaactgttaacttaggaaacactgagtgactattgtgtgtcagacataatggtcaacatattagtccattctcacagcgctaataaagacacacccaagactgggcaatttataaaggaaagccgtttagtgggctcacacttccacatggctggagaggcctcatcgtcatggtggaaggcagaggaggagcaaaggcatgtcttacatggtggcaggcaaaagagcaggtgcaggggaactgccctttataaaaccatcagacctggtgagacctattcattatcactagaacagcatagctcccatgattcaattacctcccaccaggtgcctcccatgacacacggggattatgggaactacaattaaagatgagatttgggtggggacacagccaaaccatatcagtaaacaaggcagatatgctctctggcatggcagtttgaggttataattgagcagccatgagagatgatttttaaaaagcaactatgttaaagatgaatgttatttttaaagatttaaaatgttactttaaaggagcaatgcaatagaacacatagcctagtctaaggacatcagccttcctggagaaagtgacagcgaaactgacactgaggaccaggagcaggaaagccccaggcaagataacaagacatattttaaaaagcaagggacattcactcaggttgaagcttgtgggacggaggtgagacagtgtgaagaacacagagcaggcagaagatgaaggtggaggtgagcagctgcttcattatgaaggctcacactgacagcaccatcaaaacacttttccctttgcttgaggtccatcttgcactttcccaataggccagtaccatttattagaaaataatcagataactaaatatgtgacatgccatcttagcaggtataatacattttaacaggaactttgtggaggcagtgctttgaccagaaagactgataaatgagtgaaattttaaggctccaagacaagccagtggagaaaatctttggggttaaaatgagttttccactagtttcattcctgtatttgctgtgtaagttaccagagcattccagttatctagacagcatttagttatctagtcagaataattatcactaaaaaatacaacagtgtaagacatgtgctacctgccattacaattattatcctcattttaaaagatctagcacaataaattgagaaaaagaaatgaaagaaaaaatagaaaaaggtagaaataaaataattacttgcatataactgttgacatgtaaagcccaaaaatattaagcaaaaaattacaactagtaagatagtcagttacaaaaatataaaaacaatagctttaataaatcatgagggaccagttagaaaacataactgaaaaaaattctaccaagaataaaatttatgaagtagctaggaataaacttaagaaaactaaaataaggaaagtacaaaattttgctgagagaagtgaattacagttaaataaacactatgctcctgcaataaacattgtaaagatgtttctctcactaatccctctaaaatgtaatccaattcaaagagcacatgaaagataagaatgtagagaacttgaagaaaatatatttgaatgtataatttcctcataaagaaggtatttctaacctagaaactagcagaaatcatgatttaattgagccttgattacatggcaacaccactaagcaaaattaaaatgataaatggatagaaaaacacccattatacaaaaggcaatactatccttcaaatggaaagggcttttgggtacccataagagaaagattaatacaacaaatcaaaaaatcggcaaaatacattgtactgagcattctaatcactgcatccttgtgtcagggctagagaagtcaattcatccacagcccctggcaacaggccccaagagcctcagctctctatgctgacctcagctgactggaacaggagtgaccagctgataaaactgatccaacagactgctcaccctagaaatctgggccgcggatacccatgcacttaaactatgactgggtacgtgaactgaaaggtcacataaagtaggggctgaactaagtggcatggcacaccaaagccaggtagaatgaagagttatatagaggaacaaagacgccatgaaaaaaagggagagtagagatggcagagagaagcagacccttcagttcttgtgtctgggaggtctcactgttccttgcatcctgttcttggatataaacccaacgcctgtgacatccatccaatacaattaattcaagtaggtttacagtccactgcaaccagagtctagaccaaaacagatgtgagcaagcaattcgtaaaaaaagggtaagcagataagaattagacatgtggaaataaagctcatccatgtcaaagacatacaaattaaggtattcagatagctttttcagccattaaattggttaagataaaaaagcacttagacaaaggacagtcaagtatgcgaagaaatacaggcactcatacattaaaggcagaagtacaatctgatatatattggactaggtctaacaactcttaaaatatgcatatcctaagaaccagcaattatatgtctaagcatttattttaagaaaagaatcataaacatacccaaaaattacttaagggtatttactgcagtgataattataataagaccacaaaagaaacaaatttacaacatatcactgtttttcacgcattactcatcacctttttgacttttacagatccttatacctcatgtattgatttactattattaagtcaggtcatgatttttatttaacttagtcttccaactagtatttattgagtgcctactacatactacattccaggaacttttctagattcaggagtgaccaaaacaagacaaaaatccctgccctcgtggaacttacattttagaggacagagaagtgataagtaaaatacgtagtacgttggtaatacagccaaggggccgtggggaagcaggcaaggagaatatgaaaccgtgagaggaaaagagttataattttagaaaaggcaggcaggtaagtgcccaacagaagagaatcattaaaaatgtgaagtgggagagcagggctctggggatgaacacttcaaggagaaagaaaagcaaaggcaaaggccccgaggtggaagcatgcccggcgtgctcagaaatggccaaagaggccaatgcaactgaagcagagtgagcaacaagagtgggaggagatgaggccacagagcggtgtatgcggtgtagatgggggggcggatcgtgtagggacttggaggtcatggtaaaggctctggctttgactctgagataagtcaacaaattgagaaaagactaaagcagggtgttagttgcaaagatatgggaataaaccgtgctcacctggatcacttgaatgagagtagcattcagagtggtaacacagttgagatatgaatgtattttgaaggtagagctgaccaaattgctgacatgctgaatactggagacctagcgaaatcacctgagtgagatgccaaaaaggtgctggagactcccgcatttaatgggctttcaaagtaaccgtaaccctgaactcacgtttgatgcagcagttagaatttcaaatacacataaaataaaaatataattattaaaaagcaaacatgctcaggtgttccctacagttatctcaaatatcatcaatggttcctgcaacatactttcggaatcagttattttaaataaatcagattacctttacaccatagaataccaaaaggacattaacttatgtggattttatttatctgtgcacatgcaaactcaaacacaaacacacagaggttggaaatgcatatattaatactaaaatggtaacaatactaattttttaatagtggactaatagatttatttgcttctttgtgcttttcaagttgttttcagtgaatatatacatttgtcccgccatatccatgagggattagttccagggtcctttctggataccacaatttatggacgctccagacctttatataaaatggtgtagtatttgcatatagcctacacacaccgtctggtacactttaaatcatctctagattactgataatactgaatacaatgcaaatgctatgacaataattgtttttctgccttgtttaggaaataatgacaagaaaaaaaaaggtctgtgcatgtttaggacagaggtaaccatcctcccctgacccgcccaatatttttgatccacagttggtttaatgcgatgtggaactcacagataccagggctgactgtactttgcttctaaaaaaaattcaagtttcttacgtgtttttttttttttttaatacacatgcagaccttgctcaaatcaagttttgtttccggtttgatctgatggcaaggcttttaactaaatatccagaaggagagaaagggactgagctaggagcctacaaggtaggagtgaggagctatggtcagaaactagaaactgaatcccagatagcagtgacagagacagcatatatattcccaaaaagtggatggcttatcacatgcaaaaactcaagatccagacagtataagatagacagcgaatgtgagacgctcttgaaccagccatgacccagctctgggtcactctgtagaccaggggccagctctccactgagacttcactgctttgtggtaagcaagtcttcctgacacaagccaatactatgacaccatgtatttataaactactcaaatgcttccaagtaaacgtcacttaaaacaggtaaaataaacattcctatgcatacgccaagctcaagaggagtaggagcaagttcaataaaaatcagagggggctctaaaagaaactaatcatgcttctgctctctgttctaatagtgtattcctcataggtaactgggattaagtggaggttttaggtcaaaccatttagttcttgatgttttaatactcactggcaaaagatgataaatgtagatagtaactgaaatgagactaaactctaaaagtactctaggccaggcatggtggctccgtctgtaatctcagcactttgggaggctgaaacaggagaatcacttgagcccaggagttccaaaccagcctgggcaagatgacaagaccccgtccctatatatttaattaaaatttaaacatatttaaaaaaataaaagcactagtcatctctgagatgttcaagtaattctccacttgaattaagaacaaggatggctgttcactaatctcaatcagacccatgatttgtttgatcttgaagatgccagttgtctatcaggcagatggctagtaggtaaggggagagtcactctgggatgaaatgatagaggactgttgtaaatacctgtcgtgtacagacacagctccctaatttctctactaaagaacataattatgaaaggttttaagttatctcattgatcaaatgaatcatatggcttaactcattaataatttgtgaaatcatataatgccatctgacacagctcatactgtattcaccttacaaccctgagtgggacttttaatttctaaaacaatattctgccaatgacagtagcgcttcagttctgatttcatgtagagcgatggctttatgtgatcaagaaacattaagtacgaaaaattacctaaaggtcagcaatgcctcaccatgcttggaaagtgaacaaaacgggtttccatgaaaggaaatcgtctgaccctcctttgtgtcttctgctttacaaaagcatttctgcgcttcataaatgtaaatattattcagtaaatgtatcctgtcctctttaaaaataaataaatgaagttggggcaactgagtatgtgcaaaccaaagttctgtttttaaaaataatgttccggctgagcgtggtggctcatgcctgtaatcccagcactttgggaggccgaggcgggcggatcatgaggtcaggagctcaagaccatcctggttcacatggtgaaaccccatctctactaaaaatacaaaaaattagccgggcgtggtggcgggcacctgtagtcccagctacttcgggaggctgaggcaggagaatggcgtgaacccgggaggcagagcttgcagtgagccgcgacagcgccactgcactccagcctgggtgacagagcgagactccgtctcaaataataataataataataataataataataataataataataataatgttcaagaaaaaagtaagacttcagtggctcacaagctagtaaactgcatttcaaaaggttttgccactaggtcttatttgtttctcaatcatcttaattggtctctgaatatcctatagatgaaaagcctgaggaaaaggcttatcatacaaatgggatgacagacaactcaaaaccaactttaaaacaagcagaagggagaggcctttaaaaagggaactaaagctccaacactacttcctgcactgagctctctcccaaacagccaggctgcttgcagctcatcttacccagaagagccgcaattgcttcccaggatcctaacttgagcacagacataccatttacaagtgtaaatgtggtgagttcatcagtttctggcattaccaatacagagcatggacagaagagacatttcaagtccaaattttctccatcgaacttttagacacaaactcagctgaatgtttctatgtttttataggaaaatattttcttaagcatgaaacaggataaacaccaaaaacagtggggccaagtttgccttgtaaaagatctattgtccaaaggtgaatttccctggcatctcttgcgacatgagaacacctcccatttgcttttcctcccacaactcctcagctctttaaaggtggagtctgtttgctgcagcaaagccaaggggaatgatggttccgggcagtcacagaggcggcctactttaaggagaaacacttctgcaaatgtaagcaggaaccaggtttactcacccagagaaaaacacgtttcctcagaaggttttgcagctccagtagttatagaacacaccactcaccaccagcatcaccactgtaagtcaactccacgtggaactcaagtaagatcagagttctcctccaagtatcttactcatcacgcaaagcaacacttgggcttggctataactctcccatgacacagggatgacacaaattagctccacactgtgtcttccctgcctcccacacagtcgatggcagtggactgacaaatgtggtagttacttagcaatactttgtggttatctcacccacatcattcacagagacagacagtgccacccttccataaaaacttctcccctcccacaaactgttgaattctacataataacttacattattacatggaggaacaaaatactggcttgtgcttagtagaaagtagtcattccatggacctttaagaatcctaatgctgatcctgttgttctctaggtcttgagcaaaatcactccacagtaaatcaaaggaatgtgaatgccaagtgaataaagccagaagagtttaatgagaactaccacccacctgcaaatgtcccccccacatcattctcagcagctaagcctcaaaccctcaatcactctgagtaataggtggggaagttgtgtggggtgcattaaaccaaaatgtctcaaacacttgtgatgaacatgttggcctcccaaagatgacctgaagggggttggtagggttggtacagacattctgctgtccttaaatgaaccctagttggtctactcaagctgagaaaaacatttcagtgggatctatcatgagctttcatttgtccccactgtcattcaaagcattcagacaaaaacgatagttagtgtgtactaagcacttccgatattccaggttggtctaagacgtttacaggcattaacacatttaatcttcacaacaatcctgcgaagtaggtattattagtatgtccacctggcagatgaggaaaacaaagcacaggtgctaggtttcccataacacggcaggccagtggcagagctggaatgtgtatccaggcagtctgactttagagaccacaccctgaactacagcttatcctgcctctctgggagaggtctgtcaggccagtgtgggacagcagattcacagacagcagtcagattggagaggcacatgatgataatattctggaatacagaatatataaagggaattctagttccaatttcactattaacggtgtgacattgggcaagttgtcttacttcctcgagatcagtacattcatctgggtgtgtgtgtgtctcgagatagatgaatgcaccttgcccctctaaaattctactacagtctactacacttggtaaggttattagaatatcatgctctattttaaaagtactaaaacaagaacctaagtagaggatagaaagcagaagaaagtcccatgatttcagttgggtaaaaatcaagtttacaacccaaaccacctactaagcctgctgccagcattgacaactcaggcctaaggcagctaggtagtaaccacactaattggatggcttagcagactgctgtgtttgttatggctggctagtgtgtatgccaatattcatgcatgctcaggcactgcgtggaaaaaaagtctgttgtgtattctcagcgagggcagcccactaaaacacagcaccttgggagtgctggggaggcccagagagtggagctcagcagctcccattcaggctctcaacaaagcagctctactttcaaacagctgataaaacttaaagttcttagtaaatctttatttttaagagtgtctgctatttaaacacacacacacacacacacacacacacacactgaatttaaacactcactagcatggagagagcagacggggctctctaggtctcatgtggaagagcaggcattgtttgaagtgggtaagaggcaggacactggtgaatgtgtgggcttctctggtctgtgcccagctagtatcaaccagtcatgcctaggcgactcaagtataatgaagatagccaaaattctttgagttttcaagagacctccatctggcgctaacatgaatgaaccatcttcaggaagtctctgaaagacaggcatagaaagattcttctacaccattccacctgggggagaagccctaaacacatgaggatgacaaaatgaatctaaacacattagctagtaaagagaccctaatcccttcattaaagactttaaaaaaaactagacttttgatataaaacctactctatttctaaacaatacttcagaccagtggagaggtagggaaggaagagctgccagaaaccctgcccacgtgtcacaggagcagaaaggcagtggatggctctcctctgctgtttccaaggccaaaaacccagtaagacctcaccatcttcccatgttaaccaggatttccaaagtcttggaataccaagaagcaaaaagtacctactgctgggtccataatgagcctggcatctgctgacagaggattacaccaactagcatttggcccacagccagagcagcttagaccaaagccacagctactctatgcgacatcactatgtgaattcccataaacccaaggcagctgaagactgcacagttccaaagtctacatggcattttataacccttttgcgctgtagagactacttagaagtaggacataaaaatgctctcataagggatttacatgggaaaaacaattttggttctctttgagagcaatctggataatttaagataaatagctctcacaaaattgtatggctttggccgggcgcggtggctcacgcctgtaatcccagcactcggggagtccgaggcgggcggatcacaaggtcaggagatcgagaccatcctggctaacacggtgaaaccccgtgtctactaaaaatacaaaaaattagccgggcgtggtgggaggcacctgtagtcccagctactcgggaggctgaggcaggagaatggcgtgaacccgggatgcggagtttgcagtgagccgagatagcgccaccgcactccagcctgggcgacaaagcgagactccgtctaaaaaaaaaaaaattgtatggctttactagtatacagactattaatattcagtgaagaagagctcttcagcaaaggttttagacaaacatctatcagggatgaatgcactgattaaatgaagcctcatgcaatgttaaggtacagaagaagccttcctcagaagttccctcttgccagaacacatggaaccaggcatggactttccttgagcaaaaacccatacattttcatatcattcttttataaagataaattcattttccatgttattttttccacagtcaatatgccactcaaaaaggctgcctttgctatagctgttaataaaaacataaaaccatcagtagtattagaggaacccagtagcaagagttattgctctctttgggaggccgagacgggcggatcacgaggtcaggcgatcgagaccatcctggctaccacggtgaaaccccatctctactaaaaatacaaaaaaattagccaggtgcggtggcaggcgcctgtagtcccagctattcgggaggctgaggcaggagaatggcgtgaacccgggaggcggagcttgcagtgagccgagatcgcacgagactccgtctcaaaaaaaaaaaaaaagagttattgctctaggtagacaagttgcagcatgaggaattagaatcaccatacctaaacatctgagcaaaattcaaagaatattttaatttctccattttcttccctttcccttcatataacgaagtaatataagaggtattaggaaaacccctcctccatggaaagatacttcagagcactctgtattctgggtttataatgcgttctcctcttctaataacagctttgagatacaatttcagtcctcacctaacacccctgacccaagggcatcaaaaacggtacaaagaatagagaagtagagaagtaatgagtgtgccatactgttatttgttgctaatctgggctttgtgattaagggaactaatatcaaaagcatggtaaaatagaggtatattccagtactgatgatggtggtgatggtgatgaatgacagttgacaatatttattgtgcacttactggttccaggtaccatgtcaagcacttcacaagcattatctcaattgatcctgacaatatctccaggaagtaggtcttctataaccactttataagatagactatttttttttttttttttttacccaaggcaatactgtcaggaaatgggcaagctgggctatgaagacaaatatcctgatttaaaaaaacaaggttaaccctacacaaggttctgtccattgggttttgagttctggtcccacaagacagatgtccagcagctggctctatggggttccaaattttaacataattatgggaagactcccatcaataccctttaactcataaattacctataattatctaagagctgtatctccccaggattaaaaactccaagagttctgataattagtcttcaaatacgaaggtaccatggaaagaaagaaaataaagttccccttctcccttgggtcccctgagaattctaaagatggtgaaattttttacaaattgatcttttccctgttgtatttcattaatatataaataatttaagatagacacttataccttccatcagaaactttaaaactctaataatgagtcctaggagatctaacacctttcctctttttagttcaaggtcttacatggaaacaacttaaagtagactttatcttgactaaacatgatccccctcttgtctactatatttatagctcttattgttctctacccttgagcccaaaccacattaagattgaatcacttctactgaaaacacactgatgctaaaaaagaaaaaaaaatcagactagaacatactggatttgttttcatttccaaccacaacccctactccacattaaataggatggattgctttctcagggaaaaataagattattagaaaagttagttagaagcacaaaaaccaatgtgtaagagagactgttcacttagcagggctcctctgctatggaagattttaaccaagagaagaatcgtacagccaaattccagaataagctactctgcatagcatttactttgggtataaagaaaatgacatcactacagcgctgggatccgaaacaagtgtttcatacaaagctggttacaatgatcagttcattccaaattggtgggaaaggctttgcactaaaatctgggaatgtacagccatggatggctcaaagcacgtcatgggagttcaaactggcctagattttctaaaatcttgttatgtaaaggggataaaattttaacttgaggataagtatattctaaaggaaaaacatgaggtaaaaatatggtatcttgtctattagaatattgctttgaaagtaaaaagaatatttcattactaccattctgatttgagattctgttactccaagaagctggcagcataaattataggtaatttatgagttaaagggtattgatcatagatatgactttgaagaggatggcgagaggaacggctgtcatctcagtagtgagctgaagaaaccctgcgtctcctggagtggatggggtcccctaggcctttggcggctgcactgtcccactcacatggtcctgtctgcattctcagacttactgacataagcagggtggcaactccctcatcagtccttcactcgtcacttccaggtgcatagcacggcattcggaagacaggtgcgtccacactgagagtgctctggggcggcccccaccaacactgtgggcagtgtcagccacacccatgagggccgctggacctctttcactccctcttctccctccctgctgctgacagcaggagtttcacaggcctactgcagcatcaattagaaatagcagaagagggtgggtgtggtggctcgcacctgtaatcccaacactttgagagggcaaagcaggaggatcatttgaggccggtcgttggagaccagccagaacaacatagcaagaccccacctctacaaaaaaaattaaaataaatggcggaagaagggaactcaaactggtcacttagtctcaggattttatgggaaagaatactgaagttactgtttggaagaaaataaacacatctaaatgaaatcctttatatttcttgaccaatagcatgaataattaaatgcatttgtaataatctccactcaatactgttcgcctaaatcaatggtatgagcctagcgaaagcattccactctctgggagtgactagactggtattctttgtagagatgggatgtatattaaatgcttatcaatttgactataaagttaccctgtggaagcaaaagaaagagagatagaagaaagatttgcagattccctcatgatcaaaaaacattcttaataagccatttaacgcatgtgtttgaccgtatcagtagcaatacaaatgttttgattgtgatatcattaccaagaaggcaaaggtaaatatttctctagagaaacagtgatattccctgctaaacctcactccaaggctcaagggcacaagtaggcccttcaacctgaatgccaacatttaacagaggctgtggggctacgaatgtccttgaggcttttgaagaaaaatcagatgaacagaaacgtagggggcggaaactaacgatagaacagtttctaccacgccctgcagggaaacatgttccttgtgaaggtacaggggttcgaaggttctactgctactcctggggaaactcacaccaggaagccatgaatgtctctgggaggttgtattcctggcagagagggtcacggactgctgacaaatgatcaacaaatgccaacaaatcagtacactgaccaaaagtaacaatcaactttcaaacatcttgtggtaacctggacttagtgctgtgcagaaattaaaagacggcctctgcctggatagaagttgcaggatgcacgggaggcgccggcaaaaccgactggtctcaactccctttgccctcacttgccacatctctctaggggtcttgctcatgaagagggaaattacagattatggcaggttggtgctggaaaaaaccctaaattgtttggcttggcccaacaacctcattttaaagatgaggtcagctcagaaacgggtaggtgacacagccaaagacagagctcatgtgaagtaccaggaaaaccccaggccccaccctgccaatcccatgctcccttaactctaaagggagaaaaattcgcctcaatttgtgcctacaatacccatgtcctggataagcaagagtcaagaaattcccgatttggcctcgacactgcctttcacctcttacatgctggtttcacttccgctgctgaggcgcacacttctgctttcatgcgagaaaccaggcccctctgaaaagggatggagaagaggcaccatcaaccagtcacttgagccaaggaaaagagactgcagtatgatctcctactgtcctggtgcttcccttcctggaaaaggtgcaattggggtttcaaagtaaatatctcccatcagtcaactcagagtgaagataaccagtggatgttacttccatgaaagaacaatgcaaaacgtcaagctgtgtaggcagcccaggaagactgcaaaccagccaaaagcactctctccctccctccccttgctctgccttaatcactgggcaagctatgcacactgttgctacttttttggtatattctacctgctccaatcccagtatcctcgttgttttcaatttgttttgaataaacgatcctaactggtcacaaataactaatctaaggagccagaattagtatgatttcgtaccgtcaagtaatgagttttcagaggtggaatacaccatgtgaattatttaaccaaatctaatttttcagataagtaaaagaaagcttcagagagagatgaagaacttagatataaacagagctggggccagagccaaagtctcctgactcccagcacaatgcttttctggtgaccctctgtggcacccgcaaacacaaggctaccctgggatcagagtcacgctggccttggatgtgcaatggccatagcagcataacaacttaaagtcctcctccatgaatggctagtgagaatcagcaagataggatgtgggctgcagaaacaatcggggagacatgagcctggttaaatattcagggaagaaaaagacccatgacaactcaaagaatgttgaagataaagcagactgcaaaggcagggaagagaaagaaaagaggggaaggaacacgtgtcatcaagaaagcaggtgaaaagaacagcatcagaacacaaaaaggctagctactgatcacaagatacacaagctttcgagagttaaaaaaaaaaatccctaaatcctgttacttcctttacagtgaagtaactttctctaaaagaaggcattcactgtttaaccatgttggtgtacagttacatcagacagtcttcagatgtgttttcctaaaactgaacgcaacacaacataaatatgacttctaccccagccaacaaaacatggattttgatactgaatacatactgcgtagggcaaccccacccttggcctgcaacctagcatctgcagatggatctcttagcctcttgccagagctggtcccctggttgcatggccctgagacctcccaagaagaactgggtgccacaggaagagatactgctgactcaggaaatggccacctcccatggagaggcagccaagccaggcatgcaactgagaagcagcttgtagcagtggtgattaagttttaaacgcttaataagactgcggctcaaatctaagtgctgtatgttctctctcatgtaggggtgcttctagaaatattcttgtatgtatgtgtagtggtgggtgcctatttttgttgttactaaaaatgtttttctcctttaaagaaagaaattactatcaaaacactggcttgttgctcacagaggagtcccagaatgaccagtaaactcaccctaggttggggcggaatgcagagacggtggggattatggtctaggttgtttattgtcatacaaaaatgtggcaactgccattctttggctacatttcaagcggatacttcttggttccctcatgtttaagcttttaagaaatgctcagctatgcaatttccacaaagtcaatcaatgatgaattcaaagctgtaatgcaagatgagacagatttgcttccaaaggtcaagatgtcagaaaatccaaggccaaaatcaccttagatcacccttaggtttatcttctacacctgttggccatatcgctgcctccagtcccgaagcagcatttatacacctggcaactaaataggtattcatctacttgttagaaaacttatgcaaggtaaagggatttagtaaaaagtgccaagtcctaaatcaacagaatttccacttacattgcaaatgaaagggtctaaaacagagaattccaatcacagacaattactcattcattgatcttcccacaccatctatcatttctatatgatgaaacttcggctcacttcttggtgcctgtctaaccctctagattattacagtactatttttggccatgcactatgcatcagacacctcaactgccttctcttcagtcgctcatatcagccgagatgtaaactacggctgaatggtccgctatttttatgctaacagcacttcaatatttttcatctgcctcttcttacatgttggccgaggtctatactaggtatcatttacatttctagaaacctgaaatatcggcattatcctcctactcacaactatggcaacagcattcataggctacatgctcccatgaggccagatatcattcggaggcgctacagtaattacaaatctactatcagccatgccatctattggaagtgaccttctgcaatgaatctctgaggtggattctttcctcttactgactgaccttgtcttttgaaactatgacttccctcatgtctaaggtaaacttttctccttatatctaaggtaaactgtttcaaccagaagcacatcttccatgggtctccaacccttggtccaatcgatgagttccccaagggacttgctagatgcacaagttctagcagccagtgactgtttcccaccactagagctattaatgagccttctggttaatcagctgcagagacagatttaactcttcttgtttatcttttcagcagcaaaatactgaagaaatacaaatgttatcctattactgtcatctaggaattcagtcttgccatgggaaagctagactaaaatgtccacacaggatagatgtacttctctgttcaacaacatacagataataaagagcttgagaaaaccaggatggatgaaaagcattgaaaaccagaaccacagcaatgcaaacatctcccacatagcctggcaaaggcccctcccctgtcccaaagggattgttgcctcacgctgaaagatattcattctccatgtcttctcatggtggcatctctatttcagccaccagctgtcatgacatcctttctccctggctcctttcaggtactcacagctcctataacaatggatctgagacccagaagccctgatcaaagatgatcagctgtggatgattacaaaacaaagcgatgtcaagatcagcagattataggcaagacaatttgatactcatccttaacaccctgtcacccttaagagattttcattcatttagttctcagaagtcaacatggcatctcagctagaagttcagcctcattactcacttgtcctatgttttctaagacaattgtcgtaagttatttaaaaggaggcaaaaattgcccagtaagacggtgaatacagcaaggtaaaggagaagtagaaaaggaaagatagtcactatctctcctccccatgcacaaaaaggtcttgtagctcaaccccctctgcagatgggcaaactgaggggtcatgagaggacgcgactcttcccaagtctcaccatcaatagcagagttggaccaacagaggttcccctgctaaaaagcagggcctcaataaaggaccagctgaatcaacaaaagggagtggcttccttaagaacatgctgggcacagaaactctattgccccccctcccttctgaatacaggttcttatgcataccaggagcattcaagaacagaggggacaaaagatctccacaaaagcgagacaaagtgcaaggacaccagaacaccagacagctacaactgttccttggcctgcgaagcatcaacagttcagtctatctcaacaggtaagaggaataagccactgtcctttgaacatccaataagataaacaaaccaaaaaatccacagagcactctgcagtccatctagcactttcccatagttattttgtttcatcctcacaatagtcccatcttgcaagtaaagaaactgaggaccaaggaagtcttacccaaagtcatagctggtaaacaacaaggccggaagttgagcctacatcttccaactccatattcagcaccttctactctacctccacccaaagatattcatgacaaaaagccaaatataacaatagaccaaagggccaactgaaccacagcctccggccagctaaacaatgactaaaatcccagctggaacccaaagcaggctctgtctcctcaggacttcaggacaggattccagagtggattcagaccagccctctgctacgaggcaagctcttcgctctcctacaggaactctgggttaatcacatgtcccacagcagcatggctggagctagacctgtcaagcacattcggctcttggtgacacaacccagctgtgcaggcggttcccatcaagggagctccagacattccagacactgtgccacggaattgcagggagggaccgagctgcacagggagctggcaagcccgacagaactttccctaccacatctgtacttctgcaacaacaaggcagtttcaaatcagctcccaaagagctacacagattctgccttgtgaggatagactagaaactgacagtggagattccttctggagagtgggaccaatggaacttttaccgttggcattgtattcctttcataatatctttgaaaactagatcaaaattcaatctaaaacccataaggatgacagtctacactggaaagtggtgaaggcaaaaagaaactgacatcaggtgacgtaaactaatcacacaacagttttaaacaagagctttagaaacactgaattaaatgtaagacctttataaagtataacaagattcttatttacaaattttacaaaaatttcccttgactgttaacagaagaaattgagccatttttgaggcaggaaaaaaaaaagtctttagtacttaattcttttaggcattttcacatactttatctcatttaatctcaataaccatggaataaaaatattatctacaagtgatagaccaggaaactcagaccaggcactcagagaagctaagcagctttcacacagctgcacagctaccaactcctcgagtgtaaagacagaaagggacaatctaggaatacagacaagtcctaaaaaagctgccaccactgctgggcaaaggcaacctgcacctatgaaagaacccagacacaatggccagtttctgacagtcctttcttgagtgggtcacatgctgcctatggggtacatgtgtacacaatgctgctccccatatttatgaaactgacatgccctccacactacatgagcacacagatgttttcacaaagtgctgatggacctgcggtaatctacccattttcctctcccagcccccgttgccactgaaggctgcatttgagagatgcccaactgactgagacgagaacagaggtgctaccctggaacctggccacaaggaagccctgatgtgtttacagtgtgagcttgcccacaacttcaaattcatcaccatcatgctctaacatcgaagtcctcacgtgcctcacataaggaagcacaatttaaacgtcataatagccaatgatcattaatgtttactgagctcttttagagcagaaggaactatggtaattgcttcccatgcactacacactagttaatcctcacagccaccacccctcatgttagatactattatcattcctatttcatacacgaagaagctgagcttcagaagtggttaagtaacttgctagagaccaaactgtaaggagtaaaactgaagcctatgggcctatgactcctaagtcagactcagagccactctgcttatgtctctcataaaatatatttcatggcctttttccctcaaatattctctttgtcatttcttattaaagttatgaaacaaaatgtccaaacagaagaggcaaaattgttatactgatgggctagccagacaaatggcattataaaaatactggaaataggaacttacaatccatagtcaaggcaagcaatgccaatgttaccaatgcatacccacaaatacacctgttataatcattgactaccctggaagatcaagccctggagttcttgctgggttctggatggtcaggaattattcttcaatcccaggcatcttgaaaatggacataatatcaacggactaggctcaattccccttctttagcatcgttgacctcacttatcccctgcctgttgaacatcacaacagaaactttcccagaaagaaaccgtgaggctgaaattccctcagctccagggggaaaaaaaaaactccctatgcccttttcattagataactggttaatctttgaagtttcagtaaaacgttgaattctaaggtgaatcacctttccatactaacagcacagccaactttcccttcagagcagtgatataccaaaataagaatgatagccttgtgcagtagtcattacggaccccactacatgactaagctcaaattagtgaccttccacagcctggatgaagtttcacaaagggtagctggagttcacatgcagtctaggaacaccaagctatgtctaagcgcctcaaagagcagcacaactccactagggaaaaatctcattttgcccaaacattgtagaccctgtaataaatatactcttcatttgtcatccttatttagaaattaacatatgatcattttcctaagtctttcctaggatctccttacaatgcttttcatttgaaataatctattttcaaatccaaggaagtttctacaattacaattatacataatccagcactgcctaggaccagacaaagacaatacaccaatttccagttaccttcgtcagcaaacagtctgcccataattttgtcaggaattgaagagcattctcccattccatctgctcagcaaactttcatcttccgcaagggctcttttaatgtacttctaaagctgcttctgttgcaagtacaaactgctacacactgactccgcagtgacattctcccagaatgccactggatccctcaggggctcagggatacgaacttgaaagaagttgaaggaggacgtccccctcttcccagcctcctctctcaacacagcttccctccaagagacctgcttcaaaagtccagacccaatgaagtcactcatgacctcacaaacctctagtttaactctttaagagccagatggcaagctgacagcagtcagaaaaggcaactgtctaagcttatttggagtggttgccgtttaagggaaaggagacatttgtccagcatcgttcaaaacaaagtaactttgccactgatttggtttaatagcactaaagttttttgaacaactattttatagactgcaatttcctacagcacacacagcctggtcctaaagaaatgactgaaatagacaacaaaatagatttaagtcattaatattatacacaatttagctctgttaaattcacacttgactgaaatagacaacaaaatagatttaagtcattaatattatacacaatttagctctattaaattcacacttaatctcatgtaatttgtgattttctattttcatttctagttttgttttttctgctcgtggatgtgaaaatatttattgtcctgttggttgtccaaagcctgcttcagacacgtaagtggccaggcaacacacacagctgtcagacacaggcaacaactgccacagaggcatccgagaaaccagggacagcaggagttgagatccactggaagccgtggccgccagacctaaccaatggatgccagagtgtgtgtcagccctaacagggataggagaccagcctcacttcagtttcttttccatgcttttcctggggatcctgctatttttgttgggatacggggattatgaggacctggagatttaaaagactaaaaattactttctaaacagaagtggataaaaattatacactcgaagaacatgtaatatgccctttcaagaatgttctggtttaccagaaaatgattatacttaccatgcagtaattttattcctaaatatatacccagactagagaagttcttccatgtgttcccaaaaagccacatgaaggttctgtgcacatcgccatgctgtttgacataatatgacagtcaaaatgcccataaatagaaaaatgaaaaaaataggttatagtatgttcacataatgaatactatacagcaattaaactgatcaaactagggctgagtcaataagaatgaatttcaaatactgaggaaaaaagggtaaagacagaaagggacaatctagaaatacaggtatgtcctcaaaaagcagccaccactgccaggcaaaggcaacctgcatgtatgaaagaactcagacacaatggccagtttcacaaaaggaaacaagatagcttgtatatgaagctgaaaagtgtgtgaaacactgtctaatgattacagatgcacatctctaaaggaatgataaacatcagcagctcatggttacttcactacgtagggaaggaaagagaggaatgagatctgggggcataaagaggagaggagtttgcaattcatctgaaatacttttatttcctaagtgggatgatgagatcacaggtgtttattattgtctacactttttggtatgcctcaaatgttacagaagctttagaaagccaactgcataatgactacaacctctttgagtgcagcaacacctgttcagtctggacaattaacagaacagggggcaaagaggttaacaattcccttcactctcaagtccccaaatccaagcagctgctgctccttctgccatagttcagctccttctctctggcatgtcaccctgctccacgccacccacaaccctttacacatagccaactcagccttcacagcccacctcaaaatgcagcacccccacaaggacctccgtgacatcccacgatgcaagtaacccccaactcagaaccatgaagcctggctctctgggctctgcactagagttatttctgaagttatctgatctgcctgtttgggagacaccttagtatctactatagagcagctgctcattaagttcttcattcaacaaaaactgagtgcccagtatgtgctggccactatgccaggggttctctgagtcccaaaacgtagaacttgagaagaccacggcctaacagaagagacaggcctgtagcgaagtataacactattaatactacgtgctgaatcctcaaatagttgctaagtgaatgccaactacgaataatgaaattttaggattgcttcgcaatagtaactattcaatacatcttattttctctatactaaagactttataatattactcttgacaagaaaatgtcaccttgtttgcgttgaggtggggcttctaaatagagtaattataaagacaataaaagaaactatcattaaacctcctcagagtcaaggaattgaaggctcttagaattattattacagaaaaacaacatctcaagtcaattcgattttaccacagtccattcatactgggtgactttgaagaggttttaaagacatttcaagcatttcaagcactgttattactgataatagccaacatttattgagtactcattaagtgccagtaaatgattactgattatgtgccagtaaatgacttagacagagaattgactaaaatttgaaccaaagcactccgacttaagaacccacactcttcgccaccaaccatacgtttcctaagcaggaaaatcaatcaatccctgctgatatagtttggagggactccctatcaccaccacacctaagacaacagaagaaatcatttccaggttcacagccaggagcactcactttcccaaacctctgttaggagaatcctcccctccaaaagcggagttacctttaacaggcccacatccccctgagaacggggactggctcaactttgtattctgcctctaagcaacttgcagtaaacgcctctcaaaagcagcttccagtaaacgcttcccaaacttcaacgtgatcatggatcacctgggaatgtgttaaaatgcaaattttgctcgagcaggtccagggtggtatctgagagacacatttctaaccaggtccaggtgatgtctgttagtctgaggcccacacctgggagtagcaaggtgttgagaacctaggctgcgcatcagaatcaccggggaagcttttaaagctatccatgtccaggtgccactctaacaaatagaatctctgacggtgaaggctggagatgagaagcttacagagctccctgtatgattctaatgagcaatcaagtttgagaactactgtgctacagctttactactcaagctttgctccatggaccaccgttgtagaccagtgctttgcaaacttccacgtgaatgtaaaccacttggacctcttggtaaaatgcagattctaatgtagtaggtcagggtggggctgaggattctgcaattctaataagctcccaagtgaatgctgttgggtggcaagatggtgagtaaaaacatcagaaaatctcaggagttcagtgtgtgtgatttttaaggctttccttttgtaattttagattcagagaccagtagaatacctgcaaatagagcgtcaggcacaggcataagaaacagcatatgaggtatggggattacaaaatggaagcatttatctaacattagacaggacagagattaatattaatcctcattagcattcatgagaaacttatttaccttcccttgcaccatgaccactgtctgtctcaagtactaaaaatgaaggctctgctaacagcttgagccaattcaatagacagacataccttggatatattgctggttcaattccagaatgctgcaataaagcaaatatcacaatagagcaagtgatacaaatttctggattttctggtgcctataagagttaggtttacgctgtagtttctcagtgtgcaacggtattttgtctaaaaacaacagtgtacatactttcctttaaaaacaaactttattgctaaaaaatgctaatgatcatctgagtactcagcaagtcctaatctttttgctgatggaaggacttgcctcaatgttgatggctgctgactgatcagggtggtggttgcagaaggttgcggtggctgtggcaacttctgaaaataagacaaaaatgaagtttgctgcatcaatggactcttcttttcacaaaatatttctctgtagcctgtgaggctgcttgatcatcttttacccaccacaaaacttttttttttcaaagttaaagtcaatcctctcaaaccttgccactgctttattaagtttatgaaatattccaaatcctttgtagtcatctcaatgaggttcacagcattttcatcagcagtagacttcatttcaagaaaccgctttctttattcacccataagaagcaactcctcatttattaaagttttatcatgacactgtagcaattcagtcacatcttaaggctccacttctcgttcgcctgctatttccaccacatctgcagttatttaatctactggaagtttcaaaccactcagccactcatgaaggttggaattaacatcttccaaattcctgttcatgttgatatcttgacctcctcctcccacaaatcataaatgttcttaatggcatctagaatggtgaatcctttccagaaggttttcaactgactttgcccagatccatcagaggaatcactatctatagtgactacagctttacacaatatattccttccaaaaaagctcaaagtcaaaattactcctcgatccatggtttgcagaatggatattgtgttggcgggcattagaactacatcagtcttcttgtacatctccatcagagctcccgggtgaccaggcgtcttgtcaatgagtagcagtagtattttcaaagaaatcctttttttttttttttttgcctctaagcagtaggtcttaatagtgggcttaaaatagtcagtaaatcatgctgtcagcagatgtgctgttatctagcctttgtagttccattcctagagcacaggcagagtagatttaaggataattctgaagggccgtaggattttgagaagggaaaatgagcactaacttcaatttagtgtcactagctgcattagctcctaccaagggtcagcttgtcctttcaagctttaagaaaaggcgatgcctcgtactctctagctaagaaagtcctagacagcatctttttccaatagatggctatttggtttacagtgaaaatgtgttgtttagtgtagctagctttatcaattatcccagctagatcttctggataactcactgcagcttctacatcagcacttgctgcttcgtctagtacttttatgttacggagatagcttcttttcttaaacctcataaaccaccctcggctagcttccagctttttggctgcagctccctcacctgtctcagctttcagagaattgaagagagttagagccttgctctggcttcggcttaaggaaacgttgtggctgatttgatcttctatccagaccattaaaactttctctatatcagaaataaggtgttttccttattattcatgtgttctatgaagtagcacttttaatttccttcaagaacttttcattgcattcacaacttggctgtttggtgcaagaggtctagccttcagcgtattctggctttcaacatgcctttctcaccaagtttaatcctttctagaattttatttaaagtgagagacatgagattcttcctttcatttgaacatttagaggcattgcagggttattaactggcataatctcaatattgtgtgtctcaggcaatagggaggcccgagaagagggagagagagggggaacagctggtttcatggagcaatcggaacacacaaaacttattgataaggtttgccacgttatatgggcatggtttatggggccccaaaacaatgacaatagtaacatcaaagatctgggaccacaggtcaccataacagatataacagtaatgaaaaagtctgaaatattgagataatgactaaaatgtgacacagagacaaaaagtgagcacctgttattggaaacatggcaccaacagacttgtttgaggcagggttaccacaaatctgtaatttgaataaaaaaaaaaaacagagtatcttcaaagagcaataaagctaagtgcaataaaatgaggtttgcctgtagctctgtatttcagtttacagagggcttatgaagtgaaaaacaagattaaagtactgtaaacaagacccttttgagttcaggcaaatttgtattcctgtgtaaaacaccttcagagaacaatttactcaagaaagttggtgtcttttttcctccccaaaacaaggctcaatggataacatccaatgttgcaaatatggtgctaagagacctctgctaagatgaatatcacttcctttaaaagttaaatattgtactgatatatgaataaaaatattgctgtatcatctcgatcaattaaagtattaaccaccattccatttttatttagatctatgattctccttgtaatcacttatacctccaatgtctgttatcatttgatgccattctttgatcaaagctcatccaagtaacaggcgccgcaccatgctcttcacaccagtagccaccaatatccagggaattactttggtttgtttgttttaaggtttaaaccacagaattagaatgtctccaggaatagctatttgaaatccaggaccatttcctgaagtcatcactaatttataaaagaggcaccaaacagacagggagggcacaagaccaccagggcaagggctgtctgaagggcactgaaagaacaaccaatgaccagtgcacttagcttccatcctgggctccctgacaatcgacccactgctggagaagggacaacacacagaagagcttccaggaaactgaccttacagggcacattttctacagagatggcattagaaggacacataagcaaaacccaagtgctcctgtgtgagcccctcctcacagtcccatcctcagcccactcctcacccttgagagccctctcataaccacagctgcaagtcttacatctaaaagggtgactccaaagtctctccagtgaccttcagtcccatattcccaccagcacttcacaagtaaccctctctctcctccaatttgacctctttatatctgatcacactaggtgtcctcctaccaacctgctgcttcccccaactccagtgcagggtttcttgctccagccagtcacccatgcttgaactctcacaatcattttgactcagccccatgtgtcctagagtcaaacattcatcaaatccttgcatctttctttttaccaggctatttcttatctattttcttattattccttagactcttagactactacaacacccatgataggtttaaaataaatatccacaaattagaacttagcaaagtcttaccacaaaactgcacattggttgataaggctatttccatcttaccaataagcaatcagaagttccacgaatgaaaagacctccccgagaacaagctgccagaaaagaggatggcttcacctcttctcttcagtctcaaccctccaggtttattccacctaccacagtgcactgtgcttcatagacagaaagtgatttctaaggaagccccgtagtaagggtccgatgcaggacttctgtccatggccgagtggcagaataacttttctttgggttactactgtcattggtattcatttgtatttaatgagctcctactgggtaccggacattgttaggccacttgactttcttttcttgatttttgttccatctgattaatctcgtttcctcctccttcctcctttacgagataggtattattcatttcattttacgcttgcagagggtcccagattttatgtatttattcaaaaatacgcacctagaaagtgaaacaattcgaaaccaggaataaatggctctgagacctagaagagcccctaacccacatcactgagcaggaactcctttgtggtttttaaaaaaaaaaaatcaaatcaccattacactactttggaaagaagccagaaagagaaaaatgagaacctcttttttgactgaacaaatttaaaatgtaaaagaaaaggattaaagagattactggagcaacagcaacaggctcatgaagccacaaggcagcagaccttcccagcaccaatggcagaaaagaagcccggagctccgtgggcagccagatctctccaatttcacaacatgaaaatgttgttctctgtcaccagcttcactaatgtcacattattttaaattattcttttaatatttatatattatattaaagtgacttcaagtttaaactgggatgttgaaacagtttttcaaatcgcacttcaacaaatttctacttcttatttcacatgaattcttcctaagcggacaaacaatacagatagagaaaaactgaggaagaaagagaataatttccaaacactgcattccatttgagaaggaggagaaagaaataagagcaaggcaaaaaaaaaaaaaaaaatccccacaaatatcaaattcagagtgggctgaagacagactgaagcgcttccctcaggcagatcagctgcacgcagatgtaattcacctgttctgccatacccgttagtatcccgagcaagatctgaaaggaaaacttggaagcttagatataaaatagatcatcacgctacaaaggttatttcaaaaagcagcttcatatattccaaagaaccaaaaaagaagttcctgccatgtcacggtatttgctatttctttttctcctgtccaaacccaagttcaatggaaatggacaatatccagctaatggtcacagtgacaacacttgtgccttaagaacttactgattgaagttgtggtcatctgctgataagccggcgagcgagaagcactcagacacaaaggaacccattgaaacgtgtataattgtaagtctctaattatcctttctaattttggagccatgtgacaggacttcacacagcaccgctgacccccggtcagcctgagggccatgtagctgggctacatggggaggggatgctcctctttgcttcttcattgatatattgtgttccatgcagaggctgagctgtttccggctgacatgtggctcactcatcaacaggcaggcagagcaagcacctgggagaatgcattaggctggtgcaaaagtaattgcagtattgccattgaaagtaatgacaaaaaacttaattatgtttgtgacaatctaatagtccatccagatttattccaggattttaagaggcttttcaccttacacagagtgagccgcttgatgtcacaaaggtatttaatacttttaaagacaaatagacacgcactcaaaaaaaaaactgtctttcccaactgcatactagaatattatagatttggaatattttcttctttgacttgagtagagagagtaacagggaagaacagtgtccctctggccgccaaaggatggctgagcccaagactggaaggcattcctgagagaaggaactaagtgctacaacaccacaatcagccttcccaacctcttgcacctttctttaaaagagcaattcagccgagaacagtgtcatcctgtgctcaaaaaaaaaatcactgtccaataccgccactgaaataatctttaatgacaaagtaaagacagatcttgaaacagaaaaggatttaagtaaatctaggcaatagcaaagcaaatacatttttgttttgttgaagatatctggtcttgttctagatctaccatgaaatcattaccacttggtccagttcagcatagctcagtaagagcacgggctctggaggctgactgcctgtgttcgagggctgagtatgccacttaccatctgtgtgacctttagcaagttactcaacctctctgtacctcagtttccttattcggaaaattagaacactaatagttcctttcttccccctatagctcattatgagaacgaagcatcatgtgtttactaaataaatcaaacctatgggccacatatgacacacaattatgttcagagactagctaaagtaataatattttttacaagctagcgactaacactttatacattaaaatcaatatttaatttccttggttcatgtctaccaaatatcaaggaggcgcgatcaggggagaattcattagtcttattccttttcttttaagccttcctcagagctcactttatgcaatgtactcagacccccaccactagcaaggaagcaggagaggcgagtgaacacagatggaatggaggcatggccactgcttttatttatgacttttcttttgtaaatatattaatacaatgggaaattttttttcctttaattctaacacttgggccctcagtgcttggctgaaggacaggcttaatacctcaatgtccacttccttgcctcggcagagggatgttttaacgcagatgaaattttaaaaggccagctcactgattgctttaaaaatgtgtggaaacgtgtgtattattgacctggtaaattttccttcaaattgaatgcatacaccaccaccgacaacaacaacaagcagctctacatttagaacttagtttcttgaaaacagaccatctcagacttccggctttatcaacacatggcatgagagaaatccgatcaaaagaagaataacaaaataaaagacccaacacctagcacagtgaatgaatccggcctaggagccagacaacttgaattctactacggtatctgtcacaagacagccacgtggctttgggtaagatatcccaccaaactggaatacagattctatgttatatatatatatatatatatatatatatatatatatatatatatatatatatatatatatatttttttttttttttttttttttaaaggctatctgaggccccttcaagtagtaaaatgttctcattctctaacccacaatagtaacacaattcttctttggttacaacttctccaaatcagcaaggaaggtagaagggagtaaagaaaaatatgggtttttcagtttccttaaaatttcttaggatcattaaacctgccctaccttttaaccttgaatagagacatacatcacaaaataaagcttcctccacctgtaaccacttattatcatatgccaacctcaaataacacaaaatgggggagtcctgccaagcttgtctgtccaagccactggcagtgctcagcacatggtaggatgaccaccaatcaggaattgtacagtaggagtgcccagactcggggagaggcaagctggcgcgtctccaaggtgcttgtcactcaccactagaacgtggtcctttaccactagacaagatctcctggtttgacaatgcaggtgacacagctgaaactttatctcaacacggcctgaagaataccactgtctaaatatgagatgctaaaatactatgacctactctaatattctctcccaactctgtccatcctcgtgactggcacccatgctggcccaaatgatgacaacctcctgttctaagtgcacaagccgcacatttaataaacctttcacccagttccttcactggtgttcatctctcggcttcacttacaaccactccctgtggcttttgcagtgaagcctcttagcccaaaactcttccactccccaaaccatgtttggtctgtaatataaacaacttccactcaccctagaaaactgagtgggaatttcagtgcaattatctgcatacctttcctacagcgttttatcacaatttgcagtcctcagagacgaaggtgaaaggggaggactaaggtggcaccctccactgaggagcaccgcctcacggggacactgctttcaggaatgcctcctcgccagtactcttccactgagagacactctgatctcagagatacaagaagtctagatgtggactaaccaggcaaccagttcatatgcacacacttacccaggctctgctttgtaccatgtcctgtgcgaggtgctttagtctctattaaccctttaaatctcacagcctcacaacacactggatcattaaccccatttcgcaaataaataaatccagtttcagagaacgtaagtggcttgcccaagtacttcagaccaaagtcttgtggttttgacaccttgttctttttattctcactgtgacccagtaagacaaccaatatccacaatccatattcacaagaaaatgcatagctacaatgtcacaaggagccaatcctgaatttgctcatctaatgaactataaaccttcaaactggttatagaaaatgctcagcacagggcagactgctcaaaaagagaggtccattgaaaacctgtaatattaatactggctttttttttttttaacaaaaaacactggtattatttaatacagctttaaacagctttaaaatagttgatcaccatttaacacctcccaccagctccacacaaacatacatacatacacacacacacacacacacacatataccaaaacaaaattcataaaattgtcacaggtagataacctgaggatgacgagcatgaagaaatgaaacgctggataatccataaatagtcgcggaatccccaaataacaggcatggtggatacaatgtacataatttgtcattttatctcccagatagattaaaaatcctaaagtagagagagaaaataaatacggagcctagaccaagatatcagctctctcaagcatctgtctaatcggatccttccttcaacacgtcaggaacaggaagacagaacaggaactctcagagcaaagggctggaagagactttgctgactgtatagtccaccactttaatttccaatgaaggaatctctgagctaatcaaacaatcttcttgaagtcttcaaccaccctcagtgccagactaaagctacgatctctcagtgttcgtttcacagcaccacgtctctgccatcatcggagctgataacctcactcatcatccccaaatatttgtttggtatccaatttatatatagtcatccaggaaatcccacagactaaaatgatcacagtgtgccaatgtgacaaaccactaaggtgtgtctttcctgccctaaaactcaaattactttttactcacatcatttgcttatgtccacagaaattggccaaatgatttaaatatatattccacactcagatttcccagaaaagaaatcctacaaaaaccaccagcatgaaatgaatgagaatgggacgagtaccttccccagaaagcaatctccggggtgcctttcgtgtagatggagtcgctggcatcattcagcccattggtgacgccactagaatagcccatcacgatgccaccatctgcagacacactcaggatatcctgatgtcctccccctgatgtcctctccaagaactgaccaccttctttaatgcgctgttgtatcattggagtgaggggcatttcaaagctaaaatagctatcaggctctgagtataatgtctccagggactctgcactgtagtataaagaagtgttgtccaaaatggtttcaaactgggagctgtacacgtcggtggagtcctccgtatatccaggcccaaggatgtcttcatcttcccccttaacgtgctcctcttgttcgctgatcctggaaagtaaataagagtgaagaattccaatattaggttaatgtctttatttctcccacttcaaccatataaaaaggacaacattctgaagatctaactcttctattcattgacttatatcttaacatatttgggaaggaagctatgaaatataatcaggttgaaaaattcttggcatgcatgtggctaggacactataaatactttaataaagtttcaaactagtttcctaatgtgtgaatacatctggtccaatgaagatatgaataaaatattcaattctcattttagccaaatataccgtacacattcagattatttgcaactaccagcattcctaattataacagaagcagataaatatatcatggaaacttgatacggcaaaatttcagtaaaaatacaccaaactttcatcagttgattaatactttctgatttaaataaggccaaatgctctcaagcagatgactgcatcagaagccaagagctgccccctgctgacaacagagcagcactgcagagagatttcacgtccaaaattagatagccaattaacggcctaacaaaaaggcaacagaagcaaggctaaccaaagctttgagagattagaaacagctcaaaagtcaacatacagggtagggcattcactttggcacacaaacgtgaacaattaatatgcagcatgttctacaaatattaaaaacgaacattaggataactaagtaaaattaaaaacttgggagatagatcactactaagagcaagaggtcaagagttagaaaaaccagaagctgaattttggctgtctcaattactagctatatcacttgaagcaactttacttaacctctctgagcctcagattcctacaaataggaataacatagaattaggaattatctattaagcatctcataagtcatccacattcccaggtattactggaatccacattcagcattgcaattggtttgttgtttttaaatactgaaggtcacccatgggaccaaatgcttgttcttaatggctttccactgcacttggcataaactggaccgttcctaagatgatgctcctccctacctctccacactcactgcaccccactctcccctgctttttttttttttttttgagatgcagtctaactctatcacctaggctggggtgcattggtgcaatctcggctcactgcagcctccgcctcccaggttcaagtgactctcctgcctcagactctcaagcagctgggattacaggcatgtaacacaacgcctggctaattttgtatttttattggagatggagttagccaggctggtctcaaactcctgacctcgggtgatctgcctgcctcggcctcccaaagtgctgggattacaggtgtgagccaccatgccaagcctcccctgctcttcaggcattagccacacagggagagtttcaaatcttcaagcctggcacaggccttggcttcacacatctgcaggaagcacacactagtcagggagctcagcagcctcctgtgcacatgctgttccctctagctggaacattcttcctaccccttctctggctggcaaactctttccttcctcacgtctcagtgtaatttccatttccacagaaaagctttgtccaagccatcaactaaactggcctcttccctccatccaaattattcattcttgtaggtctctgttctttccttcacagaacctagcacactttgtgatcctatacctattagcatgtttatgtgatcaatgtttatcttcagtggtaaattccatgaggacagtatccgtgagccacatctattttgaccattcctttacgcccagcatcttgcagtgtcaggacataggagacaattgaaaatatttgtgggaagaaaagaggaatgaattattaatctgaacaacagtaaaagtgcatattccagtgggaatataaacactgggccacatgccacatatcaaggccgctttggagggaagtctggagagctgatgggttggggaggggagtgggaaggatcctgccagtgatcccaaaggagcaccactctcagtgggttttttaactgcagaggaaaaggcatttccttacaccgaacaaaaaaacaaaaaacaaccctcggccttgacacagatgctctcccgtataaactataaaatgtggtgtcatgagggctgacagaagaaaagatggtaccaattagaagtacagtacacaacaaatgactacgatcaaagggagtgcagaaagatgggtcacgtctgccatttatccagggtctaagctggtgtagatgtcagaaatgcagggaaagaccaggaaataccacatgatgtcaagtttcaatcataaaggccataaatctcataagtaggagttaaacaatgagaacatatgggcacagggaggggaatatcacccaccgggccctgtcggggtgttgggggctaagggagggatggcattaggagaaatacctaatgtagatgacgggttgatgggtgcagcaaaccaccatggcacatgtatacttatgtaacaaacctgcacgttctgcacatgtaccccagaacctaaagtataatttacaaaaaaaaaaaaggccataaatcaaaatatatgctacttgtgagaagaagaaattcccatgtgaataccagggaacaactgaattataaaatctacttctgaccccctgagatgtcatttcaaaacataggaagggcccggcacagtggctcacacctgtaatcccaccacttagggaggccaaggtgggaggatcacttgatgcgaggagtttgaaacagcctgggcaacaaagtgggaccccatctctacaaagagtacaaaagttggccaggtgtggtggtgcacacctgtagtcccagctactcagagggctgaggtgggaggatctcttgagcctggaaggtcaaggccgcagtgagccgtgatcacaccaccatactccggcccgggggacagaacaagaccctgtctctgtataaataaataaacaaacaaacataggaaattgagtgggccaagaacctctgtgttcatacatgtatgtcggctggactgaaggcattggtgttatacccagaagaaatgccaaggttggaagtaccagctatatagggtgtgtcaaaagagtccaaaccttttcatattactaaagatgactgtggggtatgttagttaccttgacgttgggaaacttgaaatctgtcaaatgttaagaaaatgtcagaaaagaattcacagtttagtgttcacagtctcttcagaactctgtttccctggtccatgcctaacggatgactttataacaagatcactttaatatctgagaagcttaggaggaatcttagcttagaaggacctagctcacagtaactcatcttatattccatgataacaagaacccaaggtattgtgattgagttctcatatcaagtacaggataacagttttctatgatatgtaccaggcatctgagacagcagggctactatgggagctcacctttccctgtctctctctggtttaggtgtcttctcaagatgctgtttgttttcctgtaggaagacttcatcctctccactctcatcaagacgcacaggggaaaatgtccccgagctagtgccaggcctctctgaaggagctttccaggattcatcccaaacattctcagttaaactacttgaattacacaaaccagctgatgagatgagatggcgtggcactttggaagactctttgctgtcaggagaggctgttctttgcagtgatgtctcaaaatctataggatgctgggtctctctcttgtctcctcctgtccacagtatttccactccttgaaattccacatgtttgacccggcctgggcgtcccatggagctgcttcgatcacatccccctgggtgctctctcccaagagcagacctctgctctttcaagaaaccaacactgcctgcagagtggcaggtcactgctgagctcccgagggaggccaaaggacaagatggctcctgcacacagacagcccctttcctcccattattcattatctgggaaatctctgcctgagtgtctccagttaacagcgcggtgagatctttctggatgctcaaataaaaactttcctccgttgttacttcagctgaaagaggtatttctggtaaatttttttggccagcagggagcgttttgttgactctctgtgttttacgactggcagtgtccagctctttttccacctgctgaactgaaaaactagaaacagcatcttggtccagtacctttgtagcctgtaatgttccggaaatgattctggcttctgtggctttcagagctgaaatcaaagagtcaatgggctgtaaactttgttccttgagatgactttgagagggggcctctctgacatcttttggtccttctgtaacactgtcgagcccagagtggcagccagtaagaggctggacaccctgctgctcttgtgggtggcatggcagagcctcaccatcaaattccagagaagcccttaggccttctccaccttcctccatggtcccatattctggaaattcatttgtgacatttggtgggagtaaagtgcttcctccatgatcacctgtgaagagaacacaatggacatatgacttgttgtagaaagacagggcccagtaggtaataatgcatattcacacagattaggcactcaataatacttattaacttgattattgcattatatcagtcctcccaccaccctgtaacacacactcctcatgacactacagtgatcccttctactcagcctacgcgagtataaccacaaaactttcggcctagaaggcaatctaatgacacctgccatatttaactttgcttctgatgtcccatacatgaggattcagaacctcagttgcttcatatgcaaaaaggggttacaataaggatatgtaccaacttccaaataccactcatgaaacagcaactaaaatgtgtatattgggcttaacactaaagagccctatgatctagccaacagtatctgtgcagtgcaagctccgagacagagcctctgcaaaatgcttatgatctatttaaactcagtcaatatgttttttctgccagaagtctccccttcattgttgggtttctgtggagggaaaaaatgctttcaaaacatccctgaaaaataagaatgaagccaacatggaatgagaaacttagtgtgttgagaaagacttccaggaacccaactacggaaaattcatttttctcattttattcatttattttcccaattgacaaaagtttgtttatatatctagatatatgtttacatatataaagtttatatatatatagtatacaacataatgtttaatatatgcgtacctttgtagactagctaaatcaagctaattaacaacataccagtactgtacctcaaatttttggtgtgtagtgaaaacatttaaaatctacttactcttctagcaattttcaagtatacaatacattgttattaactatagtcaccatgttctacaacagacctcctgaatttattcctcctacctatctgcaattttgtatcctttgaccagcacctccccaatcccaccacccaccagtccctggtaaccatcattctagtttctgcttccaagagctcaacattttagattctacatattagtaagatcactacctgcataaaattgtaatggcatcttacgaagaaccccaatacacgaagtaaacagtattagtatatattcactatattgaaccaaatttataatattttcttgttaaaatgatagccagtgagaactgaaaatggggacattctgacaaaccaaaactttcaattgggggtttacagatagcagctgtagtcctatcagccctagtatccagtcttcttctgaacttagttttggttactttgtatcatgaaaaccctcatctatgctggaaatacagtgtactcacttttactttatgaaagaggacattagttgttaccatttttattttattttattttattttatttatttattgagatggagtctcactctgtttccaggctggagtgtagtggtacgatctcggttcactgcaacctctacctcccgggttcaagtgattcttctgccccagtctccagagtagctgggactacaggtgcgtgccaccatgcccagctaatttttgttttttgttttaagtagagacggggtttcatcatgttggccaggatggtctcgatgtcttgacctcgtgatccacctgcctcggcctcccaaaatgctgggattacagtcatgagccatcgcacctggccattgttaccatttttaaactactgcagagctacaaccttcctatttagtgaaatattttataaatgtctgtgtatatatatacactgaaatggctgaaaagacttgattctgcctgtaatcccagctacttgggaggctgaggcacgagaatcatttgaacctgggaggcagaggttgcagtgagccgagattgcaccattgtagtccagcctgggtgacagagcaagactccatctcaaaaaaaaaaaaaaaaaaaaaaatttgatttccaaggtaacttggaaacatcagttatcctaataactgataattattaattactgatacaattactaataataggtgtattgctattgaacacacggtatcccccagtgtgttaaatagcaatacctctgagagtacatgctgtttcatattccatgttgtaaaataatttgaaatatatacacttttttctcttttttaaagacaggatcttactctatcatccagactggagtgtgggagtgcgaacatagctcaccgcagcctcgaactcctcggctcaagtgatcctctcactccagcctctcgggtagctgggaccacaacaggcatgcaccatcatgtccagctaacgtttttactttttgtagagatggggtctcactgtgttgcccaggctggtttcaaactcctggcctcaaatgatcctctcgccttgaccttgggattacacacatgagccaccatgcctggcctgaaatatattcttaaaattaaatctgaatcaagtgttgatggaatctaacaagcacttctctgggatagtatttataacaccttctacaagacagaactaataaaatgtagcttgcttacatctgaagaggaagtgacttttcaaacaatgaattgaaaaagatgatagctaaaaacaataaagagccttcttcctagggtggaatattgatattttatgtctttcagtaaagaaggcagtaggtcttttcatggttccaccttttaagattcaggcatttttagtatattcacaaaactgtacaactatcaccactatctaattctagaactttttttttttttgagatggagtcttgctccgtcacccaggctggagtgcagtggcgcgatctcggctcactgcaagctccgcctcctggatacacgccattctcctgcctcagcctcccgaggagctgggatacaggtgcccatcaccatgcctggctaattttttgtatttttttagtagagacggggtttcacagtgttagccaggatggtctcgatctcctgaccttgtgatccgcccgcctaggcctcccaaagtgctgggattacaggcgtgagccatggcgcctggccattccagaacatttttatcactcccaaaaagaaaccctgtatccataagcagccaatccccatttcagcttttctcagcccctggtaactaccaatatactttctatctctatgaaatggtctatcctggacacttcatataaatgcaatcatacaatatatggcatttggggtctgacttctttcacctggcacaaggttgtcaggtgtactcatgtcatatcatctatcaaaacttcattccttttattttattattttttacatgtaaagagagacagggtctctctatggttcccaggctggtctcaaactcctgatctcaagcaaacctcccagttcagcctcccaagtagctggactacaggtatgcgccactgagcctggctgagaacttcattctttattattgccaaataatgtttcatcatacgggagcagtcttttctttggccattcatcagttgatgagatattggagttgtttcaacttgttggctgctatgaataaaaaatgtgtatataagtttcagggtctaaatacattttttcttttcttcctttttttgagacagggtctcactctgtcacccaggctggagtgcagtgggacgatcatggctcactgcagccctgacctcctgggctcaagccattctcccacctcagcctcctgagtagctgggactataggcacaggcatgcaccaccatgcccagctaatttttctttttttttcttttggcagagatggggttccaccatgttgcccaggctagtcttgaactcctgggctcaaaggatacgcctgcctcggcctcctaaagcgctggcattacagacatgaaccaccgcatctggcctaaatatatttgttattctcttctatatatacctaggagtgaaatttctggatcatatagtaaacctatgtctaatattttaagaaactgctgaacagttttccaaagcaaatgcactatttacattcctacaagcaatgtctaagattctattattgtctgtttattgttacagacatcctagaagtggtatctcactgtgattctcatttgcatttccctaatgactaattatgttgagcaccttgtcatgtgttttttggccatttgtgcatcttttttagagacatgcccatttgatggctgaattatttgtctttttattactgagttctaagagttctttatatattctggacataagttctttattagatgtacactttgcaaatgttttctaccattctgtgagtggtcatttttcacttaattgacagtgtcttctgaagcacaaacgtttttacttttgctgaaatccaaattatccgtttttcctttggtctcttgtgctttttgtatcatatgtagcaaatcattgtctaaaccaacgtcacaaagattacttttacgttgtcttctaagagttttgcagtatttgctattacatttagctctctcatccactttcaattcattttcgtacatgatgtgaagtagaaatccaacttcattattttgtatgtggatatccagttgtcccagagctatctgttgaaaagactattctttacccatcaaaaagccttggtgcccatgtcaaaaatcaaacatatacatatattaatatatatgcaaaggtttatttctggactctcaagtccattgagctagatgcctatcttttttttttttttttctttttgacaggatctcactctgtcgccctggctggagtacggtggtgcaatcacagttcactgcagtgttgacctcctggactcaagcgatcctcccacctcagacttccgagtagctggggctatacgcatgcaccaccatgcctggacaatttttcattttttttaagagacagggtctcactacattgcccaggctggtcttgaactcctaggctcaagtgatccctcccgcctcagccttccagtgtcaggattacaggcatgtagcaccacacctggctagatgcctatctttatgccagaataacactgtcttcactattgtagctttgcagtaagtgaaatctggaagtgtgagtctcctccaaccttgttcttcctttttcaggttgttttggtcactcttggccccttgaatttcccattacttttagaatcaactcgtcagaaagctgtgattttgataggggctgcaatgaatctatacagtactggcttcttaacagtattactattacatctttcgttccatgaccatgggctgtcttttcacttacttaatcttctttaatttcttttagccatttttttttataattttaaatgtacagattttcaatttattcccctaagattctatttcttttgatattgcttttcaaatttctttagatcattcagtagccatgcatagaaattcaatttgttgctgtatgtgaatcttatatcctacaaccttgcttaacttggagcatataataacatatttgtagattcctcaggattctacataccagatcatgtcatctgtggataaaagctttacttcttcctttacaatcccaatccatctttctaatcaagtctctgtcaaccccctttcacatgttataccattgcctctacactgaagtaggaggcagcccatgaataccctgaaaagatttgttctaatcctaatacacactggaaataagcttaagcatacatacattctgaatgcatagacatacacacgctcctttgcctttgttcaacttcctttctctacctgacatactttttcttctcatttcaacataaatcagattattttcacatttcaacacctaaaccaaatcccctgtccttaattaagccttcccttgctcaccaactcttgaaaaaagtcctctcctctgtataaataaatgtcaaaaagacttttgcggtatggtatatatagtgtaaatatacaaaacaaataagcataatgttactcacgccttaaagcttccaaaggcaataatgtttaacccatcatgaagtgttttaagaaaattgaccatagtgactgctgaagctgtatttataaactgcaccaaaacatataacagtgaaatccattcaacaaagggaagaaaagttaaacttagacacttgggagcccgctttgctttaacagtttcaactgccctctggaaaaaacaaacaaacaaacacacacacacaaacacacacacacacacacacacacacacacacacacgcacacacaactgaacactggccccaagagaagtgaccaaaagatatcaaggggcctcagagaattctgataattccttcaccccatttttaatagttttcattgaaatgtccctcagaaaggggcagcaaattcaacaattgtgggcaagtgcttgtgatgtctgatataacaacttggcaaccggtcaaagaaaacgaggtcagataagagggagacagggcaaggcaaagccctgcgtgacagattgcttgctttactattaaatactggagtagtttctcgtggtctgtgtttactgttctaagaactggaacagacggggggagacaaatgttctgagaggcgaaaggacctgaccaaggtcaataaaatgatgttcaataaagtattgttttagaactctaagtcaggactaaatttctagtcttctgtctctcaggagtaaaagcctgggagaaactcagggacactgaaccgtgagagatcatcattcatcattgctttttttttcttttctgagatagggtctcactctgacacccagctggggtgcagtggcaccatcatagctcactgcagctcagcctcctccggtgcttaagtgatcctccagcctcagcctctggagtagctggaaccacaggcatgtgccatctcacccggctaatttttttatttttatttttttgtagagacggggtttccctatgttgcccagactggtctcgaactcctgggctcaagtgatcctcccacccttggcctcccaaagtgctgggattacggcgtgaactaacgcatttagccaagaccatcattgctaagagcagtaatgttaacaaatataatgaagaataaaaccagaagtgttctagttgtagcttctgggtagaaacagccttaattatcatgtccctaaggattcagcataacagcaagaatttcctttcaaataaggcaccctctgccacaccccatgagcagtttatttttgctgtttgcattggttatcacaacttgactgtgttgttaatcctgaccttttatttagaatttctgatttattccttctgtttaaaaattgggactatatgctaagataattatttttttaaaaaaagaccaaattattgttttaagattttttaagctgctcccttgtaaaatagggccttagatacttcctattaaatgcccattgtttccaaaattcattcacgcattcagcaaatattgattacctgctatgtactaaacacaggggattcaaaactgagtatttccagaacatgaaaagtctgtttggcatgttagaaagctcgccttggtggaatgtgaaggatgtgtagcagagagggcacaagcatagactcaggaataaccacgcaggcttctgacaatagtacaggtgagagacggtgagtgctagagccagaacaaaggcagaatagacaggaacaaagatgcaaggggtgctgcatctcccacgacactctacttggaccggcatccatgcccatcatctcctcatctcctctgccccaggcccctctagtttcaacatggcttcttccaactgctgtgagctcttacaccaaacttgaaacttgttaacactttccctttcagtctacatctattactaatgtaagaatccactgaaaacatttcccctccagcgagccttcctgaattagtcctacctgaatttggtcttgtatgtgtgacaaagggactcagggacttgttaaatataaaaaaagaactttagcacttacctaaatataaaccacacactagtagaatgtgaattaataaagagttcatactttactgcgtgtatttttccccttaaagaaatgaaaatgtagtgtagagtgtggaggagggaagagagaagagttttcacattcatgtgaaatacaggtactttttggaggtatctatttacagtccattagaagtcatacttttctatcagagactttatctgcggctttgtgtatctggttagattcctaacaaatcgtgtttcctgttgtttagcaaagatgcttttcctgcaatgacatataaacccactgattttttaaagaccttttttcttttgatttagtatattgagaaagaaatgagatacatttgaatgttaagatgaattttaggagtgctttgggttatatattaagtagtcatctgtttctggaacacagggacagagctgtaataaaatgaaatgaaatagaaagaaatttcttcaaattgtgagaaaataagcctgttccataagatcggctgcagaaaaaccagggtctttctaagaattatcctgtttgaggagcagtaaatcaaactggttttcttccactctggctagcaaactcctgaaaagacaatagttcaagaaaaacaaaatataagaactatttgccacatctaccgtagactcggtcactgtaagctgaaatttgaaccagataaaaccgttttcatgcgggattctcagcaacaggacatacgtttccccagactatatggcagtcacatctatgcctaggttcctcaggagagccacagttacggattctacacacatatattttctagaacctgggatcagtcatgccattttttagtaaaaggtttttgttttgtcttgtattgttttgttgccacaaaaatataaactctaaaaggcaagaactttatttgctttctttacaattatatctccagagcctataacaattttacctagcaaaatgggtatttttgttgaagcaatcaattatgaatgtcccagaaccaataggataccaattaatagaaggtgaaagccagatgaggtggctcacgcctgtaatcccaaccctttgggagcttgaggcaggaggttcacttgagctcaggagttcaagaccatcctgggcaaacagggagacccctcctctacaaaaaatttaaaaacttagccaggtgtggtggtgtgtgcctgtgctcccagctacttgggaggctgaggtgagaggactgcttgagcctgggaggttgaggctgcagtgaactgtgattgtgccactgccctctagccgggacaacacagcaagattctgtctcaacaaacaaacaaacaaacaaacaaaaaaccttaagacagaagcaaaaaagcagcctccttaaacataagcaaaacactatatgttagtgtcacccaagtcctacccgttgcttctaagtccaggcttgaaaaggattcaggaaacagtagggcgcttcctgatattagagccagttcattctctcatttactcagccaacatttcttgtggaccatgaatgcatcaagcagcagagaaaagggcaacaaacaagagcaacttggcctctgtcatcaaggagcttacaatccagcagctccatctatatatactgtctgctcgcaaacaaagttcaggcagtggtaaatttcagtggagataatctcagcctattctagaattcagcatgatcctacatgagctgataccattaagtataaatttctcaatggatttctctctaacactgtgttgtccaatttggtagccatatccacagaagcctatttacatttacatttaagttacttaaaatttaataaaattgaaattgtagttccttagtgctccataccatatatagctaatacctaccatactccactatacagatatatggatatatatatacatatatatagcttatgtagatatatatacacacacacacacacacgcacgcacacacacacagatatccatatatctgtatagtggagtatgtatgtctgtatagatacctgtatatttctgtatctgtctatacacagagaacatttccgtcatcacagaaagctctatttgaaagtgctgccctagagcctttctactcagtgtggtcttgagaaagcagcatagatatcaccaaggaggcttgttagaaattcagactctcaggcaccacctcagacattcccaatcagaatcctgttggtttctaacgagaatcccagaggatttgtatacacgttacaggatgagaaacacacctccagaaaactacaacaatatctacaagtcattctgattacatttaatgcctacttttttattttaaaagagatcataactgcctgcctcctaactcagaggtccaactgttcaatcaaatagacatcaactaaagtaagttccaagaaaacaatctcattactgcaaagagaaacacttgatcattctggtctgggtttaccctcaaattaccaagtaaccccggtccctttccaagagaggaagagaattgcctctgctgtaatatgaccccttcttgattttacagctcatagtaaatttctctcacaatgaatggccaatgactctctacttacacaaaaagatcctaaaataactgcaaatgtaaacttgaccattagtcaaaacctgtatattattatttgtacacagccttaaaaaaattactttggagcttaaagaaatgggctcagggaagggtaaggactttccaatttttaaaaaccagaatattttcccaaggtttttaatgttcatatctttggatgcgttgcttttaaaatagaaatgtacggggaaattcagtctgataagatactatggagaatgcactaagggtcttataatctatttcctatgactatagttcatcggattttcaatcctttataaattatggctaacccagccactaataatctgttttccctcctttctacatgtgatattcataaatgcaataacatctttggtgttctctgttccctaatgaataccagttagtaaacaccttaaaacatattaatattatgttagtacaagaaaactataaattagtaagctattttaacacttgaaaatttatagaagcaagcttaaaatcacattcccctcacttgtcagaaaggaattcagttccaaagacgagggcaggaaaaagagtgaccactctgatcccttagtgtgaaatttcataaatctgtaagattggaagataaatgcttaatttacaaaacaaatataaagagcaagccttgcagagttaaaaaaaaaatctcaaatgcatttcatttataagtaactataatccttaactgtaataattatcaacatttttacgtttaataatcaataaacttcaccagcaacacagtgatacatgactcaaatttgcaatgcaatagtaaaatttgtattaaaataaaacaagaggataatctaacccattttgcccagcaatagaaaataaatttggtatgataaaaataacggaaaaatgaatatgagtaatgagaattactaaatgagtaatctaaatacattatattttaagacactctcttcaccctaagaaaagtcacattttgaagaaaactacggtatgtaatccaggatgctggctattgcctggacactgataatgctaaaggcacagatatttaagttgtttatgtgttaggaaaaaaataaaaaaaaacaggaaaagacctgccaaccactacacaagcttctaacgtgtgcacacgaacagaaaatattccattaattggacactctttccccaagtgattaatagttacagctgtgcttacggcaaactaaatttcacatactaatgattcagaacccaatttttcttattcagctctaatccctagagaaatgatactagtttaccattcagtcaatttcagaggcagctctgtgagctaaggagtggcaccgcatacagcataccaaagggaagcttgagtgagacagggaacagcccattaattttaaaccgtagtctctgcaactgtgcagagcactgttacctgttacagagaagaaacactaagctgtaagagctgaatttgagctcatctttaaaattgccgtttttcaaagctggtttcctttttcaaccagtggggttctccactcttgtctgcctctctttgtcataacttctggttttttatatccacatcttgtgcttctcctttcagccttttaccttctgatcagggatgcccctctgatttcatccattctgtccactttctacgatcctttctgttggggaatccatacttttaaaaatccaattgtaaaatttctctctttactgactctttagttttaattttatttttaaaagacaaaaaaaagtttaaactaaacttttaaataaccccacagtctcgctcacagcaagctttcttctgctaaaattaacacatatatggtaagattaatataaactgtttcgtatatatgtaggaaatattgggacatttaagaatttgatgtttcaaaaaaccatacaattcttttaaaaaataatcatgaatgccaagcagctggagttcttcacagtgatgatcaactacagctgtggacttctttaaacttctgtctatgaagacagatgttaggtgcagtggtaaacacgccacctcactcagcctccagtgtgtagcagactcaggactcagctgatccacatttgcagccagtagttttcatgctcaataagagacccacagtttcactaaggattcaggctacaatctgacataaacaattgtcccaagtatatctagaaatgcaaattttgcagagagttgaaagtcagtttccatggtgagagagaaataaatcttgaattactataaaagcgacacttttaacaaacaggaaaaacacatccttgtgtgtaaactgagatacctgttacaaacttccagtaaagattctatctcagcctcaactagcgtgtttccagaacatttttggtgctacctttgagctaaccttgttcccttcaaggctattcagatactaagctgtacttcaggcacacagatggaaagcagtttgagctctttaagagaaactcctcccctattcccatccagcactacaacattatgtctttctaaaactggaggggtagcctgttttctctctttctgtctatataatatatcacaaacagggagcagacatagggtgacagaattgtgtgttcccaggaaagcttgtggggaaaaaaaaaagaaaagaagtaagattacaggtaagaataatattttgctttctatataaaaataaaaattttgaaaaactcaatgtcacatgctgaaatcaacattccaggtaaagccaggtgaggtgctgggcataggcattcagagggcagccggcatctctctgatgactgggaattaaagaatggttggcgcgggcatccccgaataaatgcaaaatgctctcctctatgtctggattcagcagaacctggtctagccccaggggtctcctactgggacgctcgaaagacaagactagtaagcaaaagcagtcaataatacagacggatactttcacagcagcatttaaaagaaatagatatataaaaatatatttgcctgcatagacctacaaatagaggttactcacagagattactgtagctccagcagttacccattgatcatagaaaatgcccagttcatcagtttaacgcttgagaaaagttagcttaaaaagaagcaagctaattcaaaatatgctgttctagtcaactggaagcaaattagtttcagatttcctggcagccccttttgccctgcactgcacacggtgatggaaatggaagcactttgagcacttggaacccgagccgagaggagctgctgcctcagtccctctcacaaaggcggaagcagcctgttctcccgtttgctctccctgtctgcctctgccgctctctaccttggtagcttaccgaaaacagccaccgtagggcgtttttatatttgtgaaaactacttccaaggagataattgagatgacgggagttagctttaatgtaaccatgtcccccagtgcagcagcaggaagcccagcaaaggcttggagaggattgtaccatcctgggtgacatcagaggtggggctgtcatcttagtattatgcagcattttctctgatgcaagaatgacacatgggaaagagatgggtaggttctctttaaaagggtttaattcttgtattattttaacggacaagggaaatgcaaacacattgtttaaaagctgccacagaatgacacaaatcctgctttgccagtccttatctcactgcttagtgatgctaccatttaaagtcattttagtgacgattgtatcttgttcctgtgattaaattaatatttaatgggtgattgctgttacttggaaatgtgacatgagaagactcaaaaccagtaacatccatttttaaatatgaagccataaacttttatatcacttacagtaccttgtatgtatacaatgtctttcaacacagtctcagtataaaagcaccaaatgtaaaaactaataggtttatacatgagaaaagtgaagtgaggtggaaagtagcagaagatgagtaagatattgtaatattattgatacttaatagtgataatggctattaatacaaatattaaaaataacatgaagattccaatcttctgtaaccctaatatttccaaccagtatgaggatgcatgggctgacaatacaaaccacttcacagttgcttttattcattccatatacatttactgagtgccaaacagggtgctgaaaaatgtgttcagtttaatttggagaacgtttctgataagtaataatataagcaggatagaaagtatttacttatgtgccaggcactatactaagcagttttattgtattaattcatctatttctaccagcagccctgtgggatggctactatgattaacccattttatagatgaaactactaaaactcaagagaggtgtgtgacttgtccaagatcacacggctaacgctggcacaaccacgattcaaacacaggcaatgtgcctctaaagtccaccctccctacccctaagctaaagtgcctccagggggattccttgccaagtaaaagaagtctaaagaaagaatataattttcaggattcagaaccatcgcaagccaaaaatatccacctctcaagaagcctggcccaaatataagaggatatagatgagagtgtgcacctagagacagcaccagggtagtggaaatacacccagaaacagaagctcagtgccgactaccggcatgaccttgggccaatgccttaaaactttccagctttagcttccttatctctgagctagagatgtttaaattacagatcagtataaccacgtggttaaagcaaacaatctcggctattaatctggattccgtcactttccaattatgttaccttgagcaagttatttaacctctgtgagcctcaatttccatctgaaaaaaaaaaacgggaataataatggggttttctgaggactaaatgaactgtacatagaaatacataaagcactcagagtagcaaccagtatagaataaaagctcaaggttttattactgatactataatcactatgacttttagtagaattacattttttataaaactacccacttcttcccttttcaaaatcctctcaaagaagagctattttttgagttggtttcaacagcagaaaggacaacctttgctggcttcatacaagcactaaccagtccgtgaatcaccaattccctatgagatgtaagctggatttgttgggcaagccttctaagaccgctccttccaaggggaggaaagagtggtaagcgcccttttgttctccctcttccttatgcctggaattcagaagatggagctggaagtgaagcagccctgaggaattgtgagcatcccataagctagcggggcaaagctgaaagcaccccttacccaccacagacctcccacccccacccaccatcttcacatgggggagaaatttacacgggtcaggttactgaattcaagttttccaaatgtctatagcatatcgcattaggctttagttaacacttactttgactaaccccctaaaacaccatttcaaaacgtaaagctcagaaataaattacttacatgttctctagtcttttacagcaccatctcttaaaaacatgcacaaaaacagcacctgcttagcagtgccatcttcaactcctcaattgttttgttttgtttgtattgattatattctcttattatctgtgttcttgatactcccgtatttggggccttgactgtggagagactgttcctccctgggctggctaattcctagagacagaaaacacccctgtgcgagcgtgcctgtgatatacaaaccaaccaatccagagccacagcaggtaatattcccccatcctaaatcacccaggcccaggtcctggacaactgggggccatccctatagcccaaagcctgccaaaattattcaaactagccaatcttaaacttacccagcttggctaccctgtcttgcccgttcccttctgaaaaaacaaacaaacaaacaaacaataaaggctctgggccatgctcccccatctcccatctccggctcccatcccaacctggtgtttccctgtgatcccgtgcaatgtactgagcctcctgtgtctaaggatctgtaagcataaacctctttcataacagtcatttccatgtctggatgtctccccatacctgaatttttaaaaaccccatgtacaaattttagaacaaaattttgggaggaacaaatgattactcactaattatcaggaacaaaatttcaaatgcacaatgtatttccagactcgaaagtcactagtgctttccaaagtttagtttggaaatgacaaactataggtaataaatttttatttgatataatgtgttatttctaaaaaatttcaaataaagtaatataaacaggcaagcaagctattattgcccaacctgatataagatttttagaaatacaactttttcacaaatcaagactgactgcatgatatcgagttttattatcataacatcctctgttttattgttacctttttttaaagcacgggatccacgtaggagacaataagattactggaggaactggtaacaataattccttatgtaaagtaacttttccttcattgaacaagttccagtaaacaagaaatcagttttcctagctcaatttaatactttttcagtctggttcttagatcttgaaaaaaaaattcaatgccaatttaaggcttataaaaattgagtttttgtattttagtctgttgtctccattaccaggtacatctaaatgttcaagcttaatctagagagaaaatcagaattccaagaagatattatgtgaaataaatccaagtgagccgagaggagagaggtgaaaagccaaaacctgtcaataatgatagtcacgccagagctctgtactctaatacgctgttttgaaaagaaaacaaaacctcaaaagtgaaatttaacttataaagggtatacatacgaccctcccggtaagctcgttgggaaacatacagtataaaaggtttgtatgctggaaacattacatgtaataaagaggtaattacaagtcacctgcaaacctctataattgtcctagagctacttcacagatgaacaaagtagctaagctcattgtcttgagttactgagtgtgatccctctcagcacagaagtgatgtgtgttccctgtgctgcaaactgcactgggggtaagggtgggggagggggaacaaagagaaaaggggtcgagtggcagaaagtcacaatgaacattttgagattcctgtcttccagggaccaagcaagatgcttttcacctctcaggcctcccctgtcactttctaagaaactctctaccagtttctgtgtcctaacccagcctgtgatagaaaggaaagatcaaaaaagagcaggaagcagatctcacagcaggtctctgtcagtccctgttaacccagagcttactatggataatgcttgctacatcacacacacccaattaattgtttcatttaatccttaaaaacctccctaccaggtagatatcaggtatacctaaatataaggcaactctaagtaactgttaggtactctataaattccaatggggcaaaaagttattggccatattgaatatttaaatttttaggatggatgaaataatcaaatggctccttataatattttattatgttaatttgcatatataaaatcacataatacattaaaacaataaataaatgcgttttcgttcgcttccacttcaggaaatgattttgttcaagattttcatgtgtaatttgtcataaggatctttgctacgactacagtctccttatcttgcatcttcagttctaagttatttgagatacagcaattttttaaatgtgtgatggaagttctatcctaacctacagtatccattcactagcagtgatctgaacatcacttactgcatgtatgacctagaaaagtcatctttaagaagctggtttatccaacatccaacacctgcacctccgagagcacttccccagaaagaattactaaatgtgtgttcaacttgttttctccctctttttaccctgttttagtgatctccataagcattccaaactgacattatctatagttatttcaagctcatatgttttctccaaagaattctttgttaatcaaaataatcaaaagaggatccctaatacagaacactttaagaacttaatgtaagaccactccctctcttctggtatctttttgagaaaaacatcctcaccctaactttgggatatattgagtattcattcctttttacaaaagaagaatatagagaaagtttaggcaacctgaagcatatagaggaagttaacccaacacacagttaaaagaataagaagcaaccctcagaccaaagtttacaaaaggggcatttagttggcagcccacatgtgaacataaagaagagccgaagagaacaaagtcactcttttacattatttgcactttttttctagcacagttggagaattttaatctttctttccctattgtttgctgtcacttacttacaatcacacacacacacacacaaactttattttctattaatataaaccatataaacttttttttttttttgagacagagtctcgctctgttgcccaggctggagtgcagtggtgctatcttggctcaatgcaagctctgcctcctgggttcatgccattctcctgcctcagcctcccgagtagctgggactacaggcgcccgccaccacacccagctaattttttgtatttttagtaaagacggagtttcaccatgttagccaggatggtctcgatctcctgacctcatgatctgcctgcctcagcctcccaaagtgctgggattacaggcgtgagccaccgcacctggccataaacatttttaatgaacacacgatgtatcatcagtaatacaatttagtcattgttgagtagtctgggtatttccagttatttccaatattatcctaattttcttttttttttttttttgagacagggcctcactctgtcatccaggctggagtgccgtggcgtcatcttggctcactgcaatctctgcctctcaggttcaagcgattctcacacctcagcctcccaagtagctgggattacaggcatataccaccacgtatggctaacttttgtatttttagtagagacgagttttcaccatgttggccaggctggtctcaaacttccggcctcaaataatccatccacttcagcctcccacagtgctgggattacagatgtgagcaaccgtgcccagcccctaagtaaattcttatactgacaactggataatatgattcagaatgtaatcaaaatattagtgcaactgatgcaaatgaaataaatgtccaagaagtcagtgatatgtatctgttttgtgcactattgtatccccatgtcactgagaaccccagaaagtaccagcatcaaattgcaaggtcaagatggcataaaacacggttgcatgtactgggcaagaagcactttgatggtgagctgagaaactgctttcgccatgtactgagcctgggatggaatcagaatcacagggtgcggggtcagcatgggagcaggaagcaaacagagggatgggcttaaggggctgacctgagggggtttatataatatacctccaaagaaaaagcaagagcaagttctgggagtaactgaatctccctaaaagtagaaaagtcactaagcatccaaatggcatctaagtgggcaacaggaaccagccagaagggctcgataaactgtacttatcgagttgatttccagctagcctttggttaaattaggtttgtaactctaagccgtttctttttatttattttttctttctttcagtataagattttcttcaaacagtctagtttcgtctcaagtatcaagtaaagtgaaatgtatcattccacctctctgtagggatgaatgagggtatcggtgggctagagggcagggaagcaggatcggaactccaggcccaggcccaggagcagagcacatccatgtgctagagggcagggaagcaggatcagaactccaggcccaggcccaggagcagagcacagtctggccaactaaaggaaaggcagggtaaaggatttcttttagaatccctctctctcactggctcacaggcaacatgctctcccagctgcggttctgccacggctgccattctgctccatttccttggcctgttgtacttctcccactcccctttagtgataggtgaaggcccagggattagtttttcacccgctgttcttcttatttcacattctctgcctttcaaaatgcaagagcttggaagcaatatctatcatccaatcaacacaccggtgcggtggcaaatgtaccctaagtcagtcaatatatataaattgcttaaaacagtgcccagcacataggaaatattcagtaagaattagctgttattactaccagtgctgggaaccagcctttgctacattaccatgtgatttgggccagtaattctgcctttcttttccagccttttgtactcactacaaagtacatttgtactcccaggcttttgtacaattaattttgaacctaattcaaacaatcactgtaggcaaacaagatgcttacttcacgggtttttgtaagattaaaatgacagaagtcacatgaagcggcacatgaaaacctcaaaatgactaaatataaggctctacatcaataattccatagctctatgatgataatttcaggtgtccagacctgacatctcccctaggcttcaggctacctcacagttccgttgtgtgagaaggaatcaccaaatagaaactattacacaggaaaagcaaaagatgtcagtaatttagtccattcagaagcaactatgtcaatcagccagaacagacatctgaggcaggagtctaaacttgaactgggtaacagaacaaggagagatgaaagcaagataactgtagatgagattgtattcttttaaccccaagaataaagaaaggcaaatacaaaagaaatcttaccaagcagaattaaccatctcaaagctacattcgcatctgtcttgacaatcggaactcccaccctatgataataacgtaatgagaaaaaaatacaaagtaaaccataaccaggagaagctcacacatggtctagttagctcactttgcgggaaggtctgaggagacatccggaagggacaagtatctcatgttttgaatgaaagggaaggatctgagttttgtatgaagtgttaaagctctcaagagagattttgggtactctgtcctgtgcatctctcacagacagtggtcaagtcattgccagtgacaggccatgctgttacatatctacattatctcagaaggccaccccaccctttgaaagacaccaacggaaaacaggaatcctgcactgaggacagagtctcactttcctgagatcctgtatgtgctcttggcaatcaaggaagcctgctctctgaactgtgtgccccctgcacctatcatcccctggaaagttgggcatatccagagaagcagaatacagcaaagagtcaacaattcccaactgtctggcagatgccccatgtcacacatttaacatgtcaaaaccaaagtgattgccttccctgaaaaactagctcatggtggagaattcctatttcagatgcatcattaacatctcctgtcactttactgccaaacttcagagtcatcatatctccccctatctacagtcaccaagactatcatgactttctgaaagtctcatgcatttacgcatttatattcctatcagcatctcttgtctacagtgcatacaattcgttttggaattaaatgccaaccctaacaagtctccctcctcaacactggttcatatcttccaatccactctaagcaagtttgctagattaattttcctatagcacttttccttttttaatttctgacaaaagcacaaaagaaacctgtgtgttgggggtttttattattactctcagtttacagatagtaactgcacatatttataagatacagtgtatttccacacacatatatgatgtgatatgatcaaagaacagtaattagcatatctaacaccttaaacatttatcatttctttgtgttgaaaacattaaaagtccactctttcggctatttgaaaatatacaataaatgtttgtaaattatactcacccagtcctgctatagaatactagaacttattcatcctagctagctgtacctttgtatcctgtatccgttaactaacctttggctatacctactccccttcccctccacacttccctgcctctagtaaccactattctactctacttctatgagatcaacttttttagcttccacatatgggtgagaacatgcggtatttatctttttatgcctggcttattttacttaacataatgtccccaagctaactcatccatgttgccatgaataacagaatttcattctttgttactgcaaaagagtattctattgtgtgtatataccacattttctttatgctttcatctgctgatggacacataggtagattccccttcttggttattgtgaatagtattgcaataaacatgggagtgcagatagatcttcaacatactgatttccttttttctggatatataccaagtggtaggattgctgcataatatgagagctctatttttagtttttgagcaacttccatactgtttttccttagtggctatacttttattttatttttgagacagggtctcgctctgtcgttcaggctgcagtgcactggtgcaatcttggcttgctgcagccttgaccccctgggatcaagtgattctcccacctcagcctcccaagtagcagggactacaggcacacaccaccacctcagctaatttttgtattttttgtagagatgaggtttcaccagattgcccaggctggtcttgaactcctgagctcaagccatctgcccacctcggcctcccaaagtgttggaattacaggcgtgcaccaccatgcctggcctccttaatgggtttactaatttacattcccacctacaatgtgtaagagtttcccttttctcttaatcccactagcatttttttatgttttgtctttttttgttttgttttgttttgagacagagttttgctcttgttgcccaggctggagtgcaatggcatgatctcggctcaccacaacctccgcctcccaggttcaagcaattctcctacctcagcctcccgagtagctgggattacaggcatgcaccaccatgctcggctaattttgtatttttagtagagacagggtttctccatgttgaggctggtctcgaactcctgacctcaggtgatccgcccacctgagcctcccaaagtgctgggattacaggcgtgagccaccgtgcccggcctatgttttgtctttttgataacagccattctagctaggttgatataatatctcattatggttttgatttgcatttccctgatgttcagtattttttcatatacctgttggccatctatatgtcttcttttgagacgtgatgtgtctgcttattgaagagactgtccttttcccagtgaatgttcttggtgcctttgttgaaaatgagtcggctataaagatgagatttatttttctgggttctatattctgttccattggtctgtgtatctgtttttatgacagtactatgctatttggttactatggttttgcagtatattttggagtccggtagtgtgatgtctcaagctttgttcttcttgctttggctatccagggtattgtgtggttctaggcaaattttaggactgttttttctatttctgtgatgaatgacactggtactttgatagggaatgcactgaatgagtatactgctttttgtagtatggccatttttaccatattaattctcccaattcatgaaaatgcaatgtgtttttatttttgcatatgcctgctgcaatttcttacatcagtgttttatagttttccttgcagagacatttcatttccttggttaaatttttccctaggtattttactttttgtagctactgtacctgcaattgctttcttactttctttttctgctatttgaatgttggtatatagaaacaccactgatttttctaagttgattttgtatcctgcaactttactgaattagacggtcagttcagaggtttttattttttgaagctttcatagttttatttatataagatcatttatctggctaaaacttctagtactcctgaaaaaaaatggagaaagtggtcattcttgtcttgttccagagctagaggaaaagtttgcagctttccccagttcagtataatgttggctatggttttctcatatacggctttgactgtgtcgaggtatgttccttcttacctaacttgctgagagtttgattaaagtgcagtttaaatccaatgttgctttgtttgttttctgtatagatgatctatctgatgcttagaggggtgtttaagtgcccaactattactgtcctgtttaagtgcaatttaaatctaataatatttgctttgattacctgggtgctccagtattaggtacatatacgtttataagtgttatatctgcttgctgaattgatcctgttatcactgtataatgaccttctttgtctctttttacatgagtttacttaaagtctgttttatctgatataggaatgactacatttgcttgcttttgggttctgtttgcatggaatgtctttttccatactttcacattcagtctacagttgacctttgaataagatgggatttaggggcactgagcaccaccaccatgcagttgaaaatccacataacttttgactctccaaaaacttagctactaacatattagcctactattgactagaagtcttactgataatataaatagggaatggacacatattttgcatgttgtatgtattatatactttatttttataataaactagagaaaagaaaatgttactaagaaaatgatgaagaagagaaaatatatttactattcattaagtggaaatgaatcatcataaaggtcttcatcctcaatttctcattgaataagctgaagaggaggagaaaggagttgtcctcatctcaaggatgggagaggcagaaaaggtagaggaagaagaacaggaagcaagagaggcaggcacattcagtgtaaatgtacagacataatcatagtttctgtctttttaactttttcatttctccaaaaatgtttcttctatacagtaccaatccttcttccactgtttgctttagtttcagtgcccatatgatagaagggtcaacatcataaaagaagtcaaaaacagtctggaatcatgggaaccattctgccagattatctcatgtcaatttgttttctagaactgcttcttccacgtctttttcctcatcatctggcactaattttgaagcactcatctccagcaattcatcttctgttaacttctctggtgtgatacctatttgctcttgaatttctctgatatctacatcttgaaatccttcctcaccacccctcataccttttttcccatatctacaatatcttgtcatgattttcttgattggctcaaatgtaaatcctgtgaagtcctgcacaacatctggataaagttttctccagcaagaacttattgtttcagatttcaaggctttcacagcttttcctttaacaatggaatcttcaacgatgcaatcttccagactttcatgatgttctgtcagggttctcttccatagcactaacaattctttccataaaacactgtgtgtagtgagccttaatggtccttatgaccccctgatgtagaagctgaattagagatactgtgtttgggggcaagcagatgacttcgatgtcttcactgttgaactcatagagttctgggtggctaagggtattgtcctatatcaaaagaactttaaaaggcagtcccttactggcaaggtacttcctgaacttagggacaaagcactgatggaaccaatccagcagaagagttcttgttgttcaggtcttcttgttatataacccaaagattggtatctgtgtttatcttttctattcaaggctcaggggttagaaatttatagacaagggcattcctcatcataaatccaactgtatttgcataaaacaatacagttggcctatcccttcctgccttaaatcctcgtactcacttcccttccttactaataaatgtcctttgtggaactgttttccagaaagggggcactttttttctacaagaaaaaaaagaaagaaacctgccaggcagatatccattcttctcaatgattttcttaatggtgtctgggaacttgtctactgcttcttggctgtctgctgcttctcctgttatcttgacattttttaaggcaaatctctttctaaaattatcgaaccatcttttgctggcattacattctccaagtttagatctaacaccttccttttgctttaagttgtcatacactaacctcattttttcttaaatcattgtagagtctataggcatgattttcttataggtatcctgcatccacataacagctacattttcaatataaaaaagttcaaggttttgtgcctactgagggagctgcagtgacaacaaatttccttttcttttcttacaacggtacttacactgctggattcttttatcttgaaatggcaggtgaccacagctgcagacctcaatccatttggtacatatcaagcaattcacccttcttataacatcatgaattttccctgcttcttgggagcacttccagcatcactagtggtactttgtatgggttccacggtgttattaaggtttatagtagtgaactaaacatgatgaaaaatacacaaaaaccatgagagacaactctttttttttttttttttttttttgggagacagggtcttgctctgtcactcaagctggaatgcagtgacacaatcatagctcaaactcctgggctcaagacatcctgacacctcagcctcccaagtagctgagactacaggtgtgcaccaacatggagatcactttttaatacaacacataatttactggacagatgaatggttcacatggagctgttagcatcacacagtgttttaagcagatacaacactcaagctcattgcaatagcaacaacaggtggcttcaacattattatatagtacagtatgtactacagttaattgtatgcagttatgatttaatactgcatctttatgtttctttacatttctcgggactgcaaatggcaccatgtacagtctggtgtatataagttttgataaactttaactttttaaagtagatgtgtttctatttcatggtaataaatgattaaactagtatctacatatattttatgaattcatgtcacaactcttgttcatttttccagtatttctagtctacatggtttgtctgcaagttttctcaaattgttgcaaatctcccaaaaaattaaacaacatatttattgtttaaaatatttgaatataagtggacctgtgcaggtcaaaacctgtgttgttaatagtcaacaggtaaagtgagtttcttgtaggcagcatagagctgggtcatgttttttcatccatttagccagtctatatcttttaagtggagaatttaatccattgacattcaagggtattattgataggcgagaacacactcttgttattttgttaatttgtttttgaagttgtttgtatatcctttgttcctttcttcctcctttcgttcctttcttcctctttttctatcattgcagtttggtggttttctgtagcctaagtcttgattctttcctctttctcctttgtgtatctgctccaccagtgagttttataattttgcctgttttcatgatagtgattttcatcttttcacttccagatgcaggactcccttgagcactttttgtaaggttggcctagtggtaatgaattctctcagtttttgtttgtctgggaaatactttatttctccctcatctctaaaggatagctttgctgggcatagtattcctggctggcagtatttctctttcagctctttgactatgtatcagcccattctctcctagcctgtaaggtttctgcagagaaatgtgctattagtctaatggagagtcccttagatgtgatttgactctcctctttttctgtttttagaatttcctctttgtccttgacttgtgtcaatttgacataaatgtgcctcaggcaaaaaagaaaaaagaaaaaaaaagacctttttgggtggaatttatttggagacttttgagattcctggctctagatgtccatatctctccccaaacttgggaagttttcagttattatttcattaaatatgctttctatgcttttttctttctgttttccttctgcaaatcccataacacaaatatttatttacttaatggtgtcccacaagtcttataggctttcttcacttcagagattcttacgcttgatcaagtcttctattgaaggtctctgctgtatttttttatttcactgattgaattcttcaaatacaggatttttatttaattcttttttataatttctctctctttgctgaatttctcattcacatggtgaattgttttcctgacttcattaaattgtctctcttttctgtttttcactgagttaccataaaattattactttgaattcatattccaccaagtcattgaattctttttcactgaggtctgttattacagagttattatgtttctttagtggtgtcatatttccttgccttttcatgtcttgtctccctgtgttgatgtctgtgtggcagatatctgtgtgttgatgtctggtggaacggtagcctcttccaaacttactagactggcttttgtacagaaagactttgaccttcagtagggttttactgtgctggttggaaagaatgtggtaactgtttccagacaggtgcagtagtagagtctctgtgcagactcttcatctgcattcaatgtcagcaataactgtgggtgcctcagtggcgtatgttgtagatgttcgtggcagtggtgacagtggcataggctgctaatgtcttcagtcctcctattctcattttccacacaatggggagacttagatgaggggatttctctaggtgtcaggtctgacatggcctacaagtggctgtaacagcactgagttgcttggagtggctgtggggccagggtcctaggctcagaatcttgtgaacctcctgtggcacctgcatcttggagtgcgaacttgctgtctgtgaaaggattggatgtaagttgcccccggaaccaggatctgtgactcagagctactccctagcagctcaggctcagggggccaggttgtagctgtgattttacttttagggtatacagtgaagcactcacccaactccaggaaagtgatactctgaaggtttaggctcaaggtgcaaggtatgactgcgatttgggaacttgacccgaacggcaactcgggtcccagggaatgagtcaccttgtggtagtgactctagaccctgggttggcagtgatcgtcagcatctgagcctctgtgaggccaggtgcagtggcagcaagtacctgggaatggcaaagaatagctgttttttgcagcatggtggggtgaagagtgtggggtcaggaaatagcacattgatgattccattcctcaagaacagatgtgtcccaacagctcagactctagggcctagaccagctccacggaagcaggatacaagagctgtttggtctataggccagtgtgtctcagctaagccactgttctacttccctgttatatggggtgctatgtcagttcagcccagggatgtgtagctacttagctcagccagggcactgataccccagggaccaatgtgctccttcagctcaggcctgggggccttgactgttctggatggcccaggcacagtttccctaggatgcaggctgctgcttcagcttaggtactaggatataggacctttctggggggccaaggcaccgttttggggacatgtggcaccctccaacttaggctgagggaaggtgtgacttctccgagtagccaaagtactgtttccccaggagaaagggcaccacttcagctcagcccaagaaggcggggagaggggtaggtgatgtggctctacttctgcctggggaagtgtatgattctgttttgcagtgctataaaggaacacccgaaactgagtaatttataaagaaaagaggtttagttggctcacagttctgcaggctgtacaggaagcatagtgccagcatttgcttctggtcaggacctcaggaagcttttactcatggtacatggcaaagggatagcaggcatgtcacaaggtgagagagggaacaagagagagagaaggaggtgctaggctcttttaaacaactaggtcttatataaactaacagagtgagaactactcattacctcagggaggcaccaagccactcatgagggatcaaccttatagaccccaggattgtacagccactgccagtgtgcactctgaacttcagaaaagctgcaggcattgcactccaacccaggctgtgcccaagaaagccatgaagatggggctgcccaaggcttcagcggatcaccctttgtaccagtgtacccaggatacaagacatggcgtcaaggactatgttggaacttcaaggtttaatgtcttccctgctgggtttcagacttgtgtggggcctactacccctttcttttggctgatctctcccttttgaaatggtaatgtgtacccaatacctgtactaccattgtatcttggaagtaaataacaaaacaaaataaaaattttaagtacatcttctgtaattatgttacagctgtaattgtttactcaaggtcagcaaatttttttctgtaaaggaccagacagtaaataccttaacctttctgggccataaggtctctacataaacacgcaactttgccattgcaaccaaaacaaccacagacaatagtaaattaacataagactgttttccaataaaatgtgatctagaaagacaagagaggaataggatttagcccaagggccatagtttgccaatctttcctttaacttgttattcaagaacttttgcaatctggctactaactccccaccttatttccctactgctatcttgctggcactgtgtattaggtttttcttttaaaatatagcaaatacataccatattaaattataagaaaggtactagctttgcaaattaaaaaactgaggcgagagtgttttaagtagcttatagccaggactagaagctggatgaagaatccaagctgttaaccattacaaaaagctgcctctccattggtcaactcagcatcccccctaagttacatgatcacctctgcacttttgcttattaaattatttccccctctctaattttgtcctactcatctttcataacctgagctctcaatgaagctctccatgcctcaccaactctcagtgacttctcctctccttttcttcttttgtttgagacggagtcttgctctgttgcccaggctggagtgcagtggcgcgatctcagctcactgtaacctccacctcccaggttcaagcaattctcctgtctcagccacctgagtagctgggactacaggtgcacaccaccattcccggataatttttgtatttttaatagacggggtttcaccatattggtcaggctggtctcgaactcctgacctcaggtgatccacccacctcggcctcccaaagtgctgggattataggcgtgagccaccacacccggcctcttcttttattctgaaaacatatattgcctatacttttctatgcgtccttatattttcataatttcatactgtcttccctacttactttttatcttacattttctagatcctaaatacctatcatagtattctgaagtcaaaaggtattcattattttttactggatgatattaacatacaaataattcacgaatataggcctaaaataatttttaccactccctatacttactaagattaaagcaagtggtctctttacagtaaatatatcatttttcaagatgaaaaaagaaacaaagtataaattggttctttgatctttctagaatgagatacgctttgcaaaaacaattataacaatatatattcagtaactgaactacttagaagagattattttatagtaaacatcatattagtgtgattgaactaggataacagttgtatctgaaagaccggcaaaaatataatacactgatttttctgttctttaagtctcagaaaagtggttttctttgagaaagacatccttgagaaagctacagaccctctcctgacaaaaaatatcagataaacatttatacgaatttttcatcaaatatctgggtgctccagatcccctaaagttaagaaaccctgcctgaaagggtctcatattagctactcacagctgtaactcacctaataaattttccttttaacacaagacattcaaagaaatttcaatgcactaataagatgtggccgtgtttttaaaattcatacccaaattagaaggtgtcgaagatcataaacattggaaatggggaaattcatagttaggagcaaacgggtgaggggagagcaggaatattaccaaagacttaaagatttcaatttcatgttactacttgctaggaaggctctgatggcctggtgatcctgccatgtatatgaggggcacaaacacaggttttgtagggacaatatatatgatcttattgctaaacttcataccttcaaatcagaagtggtagtatcatatcctaaaacaataaattgaactaagaaaaattagcataagaaagtaattgtagtgtctatttaaaactcagatttagaaataaaaacaagtaagttccaaataaaaacaaatacagtcatgcaccatataagaacatttcagtcaatgactaactgcatatacaaaagattatatacctaattatatacatacacgtaagattacaatggaggcaaaacactcccattgcctagtgacatcgtgaaaatcctgaccctgggtaggtccaggctaatgtgtgtttctgtgtcttcattttcaacagaaagcttaaaaagaaaatataaaaactaaaacattattaaaagcttatagaataagaaaataaggaaaatattttagcatagttgtacaatgtatatgtattttaagtatcattacaaaatagtccaaaggttttaaaaagttaaaagtttacaaagtaaaatagttacagtaatctaaggttgttactgaaagataaatattttttataaatttagcgtagcctaagtgttgattgttcataaagtctacaacagtggacagtgatgtcctaggccttcatattcactcaccgattcactcagagcaacttccagtcccgtaagctccaagcatggtaaatgccctatatgatggtacaattttttgtcttttcattgtttcattttatttattttattttgtagagatgggggtctcgctgtgttgcccaggctggtctttgaaatcctggcctccagtgatcctcccaccttagcctcccaaagttctcagattacaggcatgaaccactgcacctggccttttatcttttctattgcatttttattgtaccttttaaatgtttagatatgttttgacatacaaatacttaccattgtgttacaactgtctactgcattaaggcagcaacatgttgcacaggattagagcctaggagcaataagctataccatatagcctaggtgtgtctcatataccatataatctaggtttctgcaagtacactctggtgttcaaacaagggcgaaatcgcctgatgacctatttctcagaacatatacccatcattaagcagcacatgactgtaccaacagagtaacaaccccgtgaatacaacaacagacaaataacaaacagtaacattaatgatacatagttgccgcatttcaatttcctttcatttaaacttttttcaataagttgaatttattaaatgtattgctaagctggatttaatttttataatcttttgcactcggcacacaagaatgacagcaatatatcacaaaattctaaattttaagtatgcaacgtgaaatggttaaaatcaaactatctgtagaatatacatatattgatggatgtagataaactgatgaatgcagaattgataacaggtaaattaatatagaatttcaaaaatagccaaatgccaataagataaccagatgtagtttcatctctgttggcaaaagaaatatctataaatttgtgcctttcagaatgaatgattggttcaacaatagaggcaaattctaaggtggagtggaggccccccagaaagagggcagtcacccaaattaagcaattaagtaagacttttggaaatatacactttaaatcaccattttttggattaatatttaaggtcttccatgatcatatcttaatttacttctccatcttagtcaataatctactatcctccacaacatcctgtactcagtctcaggtctttttagaaccaaattctccccatgctttccatgtattcaaataatacttacctttcaaggcaaagaacaaatgagcatacctggaaaaagcctctgattacccctttcaccctgcactgcttctcccctcctgtccatatgataaccacatatccctgacttcccgttctgatcctgatcatctcaaacagtctgtctccttatgaaagcacgtctgtctctgtgcaggatcttcagcatgaaacaagtcatctgttcatgagattcgtaccaatcatttggcacttaattacgtatcatcttctatttaatggttcctcgtatgaatgttgtcttgcttgtaagttcattatctccttataagcaatgactagcaatattgggtacacagcaaatactccataattatgtgcagaaattagttaaacgtcattatttcctgccctcccctttttaaaactatctaaatatgagaatcaaaactatacaaatctcagttcccgacaaattctaggaaacctgcagccacacacaaaacaagagtctctagtcattttcactttaaatagaaaactaaaacagggtctcagtctactttaattctactcattttaaccaactcaaagtttactatgacaaagttcactatgacaattgttccaagggtaactaaaggaattacatttcagatatttagcaatcatcatcaaaagggcaaatactctaagttgctttttcctagtgtagttgggtattgcattgagccatccctattaatttgcttgggtttccctaaaaccaacaaacatatttctgtaaaatagcttgcaaagctcctgatgtacagaaatgaacgttatctctcccttaaggtttgaccgtggccccattaacaccactgtcttaccaaatgaacaaactgtgactggatgcttcaatatatgaacggtataggcactcacacacaaaatattgttgcataaaggcacagataacttagctatggataaaagggtatttggtcttgcttctcggctattttgtatttttcttcttcttattattattatttttaattttattttttaagaggaagccttgccctgtcacccaggctggagtgcagtggcatgatctcggctcactgcaacctccacctcctgggctcaagcaattctcctgcctcagcttcccaagtgagcagctcggactacaggctcacgttaccatgcccggctaatttttgtatttttagtagagatggagtttcaccatgttggccagcctagtctcaaactcctgacctcaagtgatctgcccaccttggcctcccaaagtgctgggattacaggtgtgagccaccatgccagtcctgtagttgtttttaaacttctttaattctacaatgttttaagtaaacagaaattgtaatttatgtttctttgtttttatatgtttttacttctatcgtattcctgacattgtaatttccctccgctgggaggcaggggctttaactttggttgctggaagttacagcgaaaggaaaaagtggcaggctggtgcccaattataacagagaaggaatttagatgtttcagcagcctgagacacagaggactgccccacgaagagttcgctcccctccctgaatgccctgtcattggcacccaaatgctcccaatggaaaggaacttgtattgaaaagtctccatcccattactgggtatatacccaaatgagtataaatcatgctgctataaagacacatgcacacgtatgtttattgcggcactattcacaatagcaaagacttggaaccaactcaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaagaaaagtctgatgccccaggccatatcctctttctcttccaaaggaaaaatacaaaaagctgttgtggtatgccaagatccataaagaaatggtcagctagatgggaaaaatcatatagtttagtggtttaagttttgttttgttttattttaacaaagaaattgtgccttcaaatggtatctgacacagaagtcgaaaaaataaaacaaacagaagttcaaggccaggccaggctgggtaacatagcaagactctgtctctacataaaattcaaaaaaataaaaaaaaaaaaaataagttagccaggcatggtggtgtactcctgtagtcccagctactcaggaggctggggtggaaggactgcattagcccaggagttcctggctgcagtaaactatgatcatgccactgcactccatcctgggcaatagaatgaggccatgtcaatcaatcagtcaaccaataaaacagataaaagagggagtgttttcggtagagtgggggtgggagcacagtttcatagcattatcccctctttcctcaaaccacagggagacacagacacagactttggtttaaagactgaaataacaaaaataaagccagagaagttaaataatgtattcaatactaacaattaagaacaaagccagaagtatagcctactttcaaggaaagttagcacactgtcacttgggagccagtggcacttcactccaatttcctgtaaggctgcaggatatggtggagagacagccttgatgtcatgcttgactgggcatggcagacccgtgacttccttgctgtgtaacctgagcttagttaagttactgggcctcagtgagtctcaggaacctcatctataaaatgggggtgaggggagaaactgtatcagaagatctgtctgaggttccaagaataatacaaaaagttcctagcagagtgtctgttgcataataatgatgtaagagcgttcacttctgcaatttggtgtgataaaacagaaaatgaaatctttatgtttgctttccaaacagcattttcattttttataattcataactcagggatatatatatagacatagatatataaatgtacacatacacctacagatacacacacacactctaccccccaccacacacatcactagtcatcatgaacacaatgaagcagagaactcaggtttgaacaccccaaattaagaaaaatatcttacacattttgtcagcctacaccgtaacttaatacacaccaaaacaaatgcaacaactcaaaaactatccgtccacaaacagccaagttaagtgggacctttcacattagtctttcaattattatgactccaacaagaatgatttcttcagaaggttttgaaaaatttatacatgaggaaaaaaatcaacccactagaccaggtttcatatattcttgttaacacatcttgtcttctggggcctaccaaaatgtccatctgagaagtttttgccatgaaaatcccagatccttatttcataatgtcataatgagattaagatataacagggaatatttgtacaccactgggattttgacaaacctccagattaaattaagcagaaagaacaaaagagtattaactccgaaacaaatctgaaggaaatctgctagcaggaatatccttcaggaacagcgcttcacaatgttaaccgctactgaaaagtgttgcaggttcagtccaccagggggcagtgttgtctaactattaacagaactgagttcttaaaaggaataaaacttttgtacttaaatttctttctaagctttcagaaggaaaaaaatatatatattctttgaaggaaaacctaaaaatctttaatttagatatctttaattaggtgaaaatctaaaagatggtccacttctcaaaatcattttgtgcctgttaatgtttatcatctctgtggctaggattctcctaaaagaaatgaagacactcactcaccacacctagttccacaacctgaccagggctgcttcagtcccgaccagaaccctcctcctctttggcaacctgatgttgaagttcagagaaagcagtgaacagtgacaggtgggaccctattgcttcatcacaaatttcaagctagttcatgatggccactgtattaaatatctacccactattcccaaaaaacattttcatgcaacaggaaatacaccctaaattttagcttgagagaaacagttaccatgctgtcacaatgacaaaagccccaagtgggctgctgagtggcaaggcacccaggggatgtagagtacactcctagagctacttaagaaacggccaccatctaccctgagtaatttcaataattgtgtgatcattaaaaaaaaaatctggtttaatctaaacaactttataaacacacacacacacacaaacacacacacacacacacacacacacacacacacacactctccttctcctatttcaatgcattcaattacctcctaattgctagatgcttcagtctttattggactggactcatccatggcatgtctctgcaactactgccaccttttgaaaatcctctctctcgttttccaaatatttttctgttaaagtttcccttctctatctcgggttgattcttctaaatttattttaaatactactttgtcaacctgttcattttttttttctttagagtgcaaacttcagatttcctgtcattttccacatgattcctgggcaatcatacccacttccaaaatgtcttctaagccccaatggccaaaggcttcagacctgcacccacagacccagaaaccagtctggcccttgcagatagagactccaggcctcccaggagccaggccagcctcaggggcctcatgctctacagaaccaaggatccaggcctgcttcagcagaccctggggccacacaagctgccacgaacccaggacccaggcccatccctagggacccagtctccaggcaggaccagtgccagcggactaaggatctaggcctgcccccagtgaacccagggtctaagcaccaggctggccttcatggactcaggatccaggactgcccgtacaggcccaggtaccaggatggtccccacaaactaaagatcctacctctaccactacagactcaggctttaagcacaccccaatgccaggccagccactgcgaactcaggctcctaccccaaccctattgatccaggtaccaagcccatctcagcaccaggctggcccctgcagatccatgctctgggcctgtcctcacaaactcaggctctaggcccaactcaacagacacaagctccgggcccatcagagtaaacccaggctccagacttgaacctgaaaatccaggctctaagcaaaccccaggggagccaggaaccagcctgcccaaaggctccaatagcaagcctacacacattcccttccagatgggggattataagatcatctccatagactcataaacagcatttgagaaaattcaacaccctttcatgataaagaaaaaaaaaaaaaacacctttcaacaaatcaggtaaagaaggaatgtacctcaacataataaagaccctatgtgacaagcccacagctaacatcacactcttgagaaacaaggcaaggatgcccactctcaccacttctgtcagcacagtactagaactcctagccacagtaattaagcaagaaaaagaaataaaaggcagccaaattgaaaaggaataagtaaaatggtctctttttgcaactgacatgattttatatacagaaatcctaaagagtccaccaaaaaaaatgttaaaactaataaattcagtaaggttgcaggatacaaaatcagcatacaaaaaccagtagcaattctatacactaataacaaactatccaaaaaaagatatcaaaaaataatctcatttgtaacacctacaaaaagtaaaatacttcagaataaatctgaccaagagagtgaatgacctatacaatgaaaactataaaacactaatgaaaaaagttgaagtgacaaaaataaatggaaagatatcccatgttcaaggattgaaagaattgttaaaatgtccctattacctaaagcaatctacagatccaatgtaacacttataaatattctaatggcatttttcagggagatggaagaacaattctaaaattcatacagaaccaaaacagaccccaaataaccaaaccaatctggtgcaaaacaaagctggaggcatcacgttacttgactgcaaaatgtactacgaaactatggtaaccaaaacagcatggtactagcataaaaacagacctaaaccaatggaacagaataggaagcccataaataaagccttacttttatagtcaattgatctttgacaaaggtatcaaggacacacaatggggaaagaacatcaatgaacagtgctgggaaaacggaatatccacatgcagaagaatgaaattaaacccttatttcacaacatatacaaaaatcacctcaaatggattaaagacttaaatgtatgacccaaaactacaaaactactagaataaaacataggaaaaaaggcttcttgacactcgtctaggccatgattttttggtatataacaccaaaaacacaggcaatgaaaggcaaaacagacaaattggattgcatcaaactaaaaagctaacacacaacaaaggaaacaattgtcagggtgaaaagacaccaacagaagtgagtaaatacgtggcaaatcatgtatcttataagcagttaatatccaaaatatccaagatataaatacatatatacattttatttgtcaaacaactcaatagcaagaaaacaaataacccaatttaaaaacctcctatgggcaaaggactgaaacagacatgtctcaaaagaagacatacaaatggccaacagatatattttaaaatgctgaatgtcactaatcatcatccagaaaaagcaaatgaaaaccacgataaggtatcacctcgaatctgttagaatggctaatatcaaaaagataaagtaccagatgctggagccatgtgggaagaaggggaactgtgtacactgttggtggaaaagtatggaagttcctttaaaaaaataaaaatagggcaggcatggtggatcacgcctctaatcccagcactttgggaggccaaggcaggaggaatcacctgaggttgggagttagagaccagcctgaccaacatggagaaaccctgtctctactaaaagtacaaaattagccaggcatgggtggcacatgcctgtaatcccagctactcgggaggctaaggcaggagaatcgcttgaacccaggaggcggaggttgcagtgagcggagatcgtgccattgcactccagcctgggcaaaaagagcgaaactccgactcaaaaaaaataaaaataaaagtaaaaatagaactaccatatgatccagcaatcccatttctgtgtatttagccaaaggaaatgaagttagcatgtcaaagagatatctgcattcccatattctttgcagctttattcacaagagccaagatatgaaattgacctcagtgtctatggattgctgaatggatttaaaaaaagtgatatatatatatatatatatatatatatatatatatatatatatatatatatacacacacacacacacacacacacacacaaacagaatactatacagccttaaaaataaagaagaaaatcccatcatttgtgacaaaacggataaacctagaggacattatgctaagtgaaataagtcaggcacagaatgacaaatactgcacgatcttatttacgtgcacaatcttaaaatgttgagcacacagtagcaaagagtacgatggtggttaccaggggctacagcagggaggaggatgaggaggtgttggtcaaatggaacaaaatttcagttagatggaatgaatacattctagagatctgtcagacagcatggtgcctataatcaataatgtatcacacacttgaaaattgctaaaggagtagatcttaaatgttcccaccacaaaaaaataagtatgtaaggtaaagaatatgttaattaatttaatttaatcatatcacaacgaatatatgtatgaagatataatactgtatgccataaatctatataatttttgtcaattatatcttaataaagctgaaggaaatgaaaaaaaaggaaataagggagagaagtctttaacatttctttttaaataatataaaatctcttccctctagcccagacctgatacccaccagcccactgaatatctgcatctgaatgtgccatgggcatctcctacgcaacatgtcccaaagtgtcagcattcttccaccttacccccaaatcctccctcccatccacccagctgcccaaagcagaaactaccctcaatgccttcaccttcttttcttcccgtatcatatcagtaaccaatatcagcaatccctgcagtatgtctcgtcttctgtatctccactgcctcagttcaggtcttcattatgtgtccctcgcattcctgcactactttcaggcagagatggagatggtttaccccactatccatttctcctcttcccttactgatagaacccctccatttttagctaggcacacggccgctgaataaatactgtattttcagcctttctcttacagctaaaagtgatcatggcacgacacaggggcaatgagctctaactagaagtcttccgtggcaatttctccaaaataaaagcaagtcctcactcaacattgcagattagttcttggaaaccaagactttaagcaaaacgacctacagcaagtcctcaaataacactgttttgttatattgataacataattagttttgttacacatcctatatgtttcgcttgaagtcgcagtttccaagaacctatcaaggatgttaaagacttaccatatccttttattacagctagtgcatgcccctttgctcttgcgatttcccacccccaaccctgccccttgcattcctgctctcaggaacgtggagctcaagcaaacacatcagaagatgagaaaatctccaaggatggcagaccaactagcccaaagtagccaggacctgcaacaccgtggaaccaacatacaagctgtgaatcatctatctggattcctttcatggaagagaacttttattttgtctaagccaccggtgtgtgggtgtgggcaggtgggcgtgtgtgtttatgtatttatgtatcctaacaaggttcactgcctccaatctcacctctccaaaaccacaatctatctctagatttcctacttccagaatgatttccagactgatttcctaaaccctaaatgtggagaatcaatccattatttttttaaaaaattaataaaatacacacttacagcatgctttagcatggcacgtaagaccattcataacctagtccctgcccacctgaagtcttctagttcattgctccctcttgacaccagctgctctgaccaagccatggtctgcacaacaccacagctttatatgtgcttctgccactgtcaaaacatctttcttcccagcacccgttctaaattatcttcaaaaactctgctcagatctcagatgtcacctcttccaagaagccttctctccatcctgactgaggtacaaattcacagcctcccaaagcctctgttcttacctctactgtagcaggtatcatcctgtgtcagaatcatgttattacttgcctgtttctccaaccagacttcacagtcaggctgtaggcttcatatttctacctctagcccagcaactacaggtattcactgaatgcgtgttgaaaaagtaaatacttccaggaatgtactgaaggaagtttttagcatctggtacttgacatactaataaacaaaaaactaggcctcttgattctttgcccaggcctgttcccagtacatcagcatttctccaactgtgttccaataacatccattcagaaaatgtgaataatgtgtgggtttccagctatgcaacacagcttccagttccaccaacctgtcaaacttccaccaccctcaaagcctctcaccccacctttttggtcttctacgtggagggagggcactgtacctgtaccgtgcccctttccctggttcccaccattcagtcgtcattcataagtgccagttcagacccggggaagactatctggtcttgcaatatttttaataatcctctaaagcttggctaaagaccgccctgaaactcaccaggctctacaatttccttaattctcctttctacagattaaggttttgcctcttggattcttttttttaagcactagtccctatcttcatgattttcaaagaatatctagagtggatatataatttacctgcaaatatgctcagtttcttaggatattatgcctcagagtttaaattcatacaaaaggagccaggtgatctcttccggggcttcagcttcttctagcagtgtttgttctaccctttcaaacaagctgactgtactccttgatagagaaacgccagccaggaaggagtttcgtatctctgctttatctcagaaatctcttagcattacctcacacacccttagaaaggagccccacctttcctttttctctttctttttcacacaccacacagttattgcccctgacccgtgagaacaggattgctcaagcagccatccaaggactacctgaatcgggatcatccgagagctcattcaatactagatttctgagtcaaacagaatcagaattactggagtgaggttcaagaatctgaatttttaacaagcatggaaagcatccaaggtggaaacagatcgttggcttgcaaggtggggcggggcaggactggggcggccaggatccccagaaactgtcacctgcagcccaagaccactgctttccttcacttccctgcgcaatacaaagagtgtaattttctatgtgcgccatttgtagggacatggatgaaattggaaatcatcattctcagtaaactatcgcaataataaaaaaccaaacaccgcatattctcactcatagatgggaattgaacaatgagatcacatggacacaggaaggggaacatcacactctggggactgtggtggggtggggggaggggggagggatagcattgggagatatacctaatgctagatgacgagttagtgggtgcagcgcaccagcacggcacatgtatacatgtgtaactaacctgcacaatgtgcacatgtaccctaaaacttaaagtataataaaaaaataaataaattaaaaaaaaaaaaaacaatcacaaaaaaaaaaaagtttcatggagtttctagaatttcctagagaactactaaattagtatttctagggcaggttcacaatgatcatttccaaaacttctacaggacaatctaatgtgccctgatgcttaggaaccatcgctttaaaacagcaattctcaactctttaagggcaaaaataccttttcgtaacattttgcaatgccttctttattatcctacagtgaaatccatcaacaatataactgcctaaatataaaattcaaaataatccatataatgccctaaatatcacaaaggggaaataaaattaaaatgattttcattacataaatgctcaggttagtcagacacttgcttgtacctaaaggagaatcatgctgaaagcaaggttcgagtgtggacagatacagcggtattgaaatggtgatgcgggagcatgagcgctgctttcttggatgtgatactttgaaatagtaaacaacttttagtaaatttgcaaacaaaacaaagtataatcttctctcgatttacatggtagttacagtcctagaaaactcactgatacttaaaaccatttaagtaaaaaaccttttattgacatatcctaaggccggatcattagaaacatatttttctcctacatgaatgtccaacaggacattcgaggccatacagaatgtagaatagttcttcctggtgtggtactatcccagggactaaaacttgtctagcatgcctcatcaccacctattaaaggctagtagccacctagccctccatccccaatcactgtgataactaaaaatatacccaaccattcaacctccccaaacaatatgaatagaggtacctgtgtcaggctatagtattattttcccttgtgacactatcatacatgatagtgactccagaatctctgcgtgattctacctatacttataatattttcaaaagcaaatatttacataaattctaccataacagaaattgctggtgaaattctacatgaatggaatgacagtttcacagatatgagaaaccttcttcagaaatccttgaaaaaacaaatgtaaactactttttttaacaatcaaattgcattttcctgttgacatatttcaatttcagaattatcttctcactattagtattcaattggcagtggttcctaagcagttcagctctgcatgtcagtaaaatatatcaaactacagtttaaatgtattaaatgattccaaaatgcatccttttagtgttaaaatggtttataaacatctcaagtaaattatcttttaaaacacaatggttctcgagcctgtatgtgcatgacaacaaacactaggggagatgcttaaaatgtagagatgcttgggtcatcccttgcccacagattctaactgcataggcatgggttaagtagagcctaggaagctttattatttcttaaaaggtctacaggagatcctcatgctggcagaggcagatctagttttgtgggtcctgaaacctacacacaactgggcaggtggtcacggggagtctctttaagaaaaagaacaaaaaaatggcaggtttctgggagccttgggaatgcttcctgcattggcttcatagaaaatccatctctggatgctacttggggttgcaaagtgtgacataatgaaactcacaactggaacacatgggcaaaagtataaagtcatacactatgtatgcagaggccataagcccagtgttcacgggcttcaggagataatataaatgagtaaggcaggcaaggtatgagaacacaggagggagtggtgaccaagtacctgtgctctgaaggcaccagcactatttcatgtcaatgccaaggcacactcagtgttggcattcctcaaattcagcaacagaagcttcaagtctggatttttacatgaaatctcccagtttttaaaagttagctcaatattttaataaaacattggttagaccaaataaatcataagttaaaaatgccagtatgtcacttctgctttatagaagggaaaagatatttcctacctaaaaataaaactgaagagtagatagtttattcaaggatccatgaagggagactgctaaaaacatactttgtgagtcagttcatacacctgacaatgaaaaaacggtttgttcagggattctgcaacatctcaaggacctaaagtttactctaacacgtcctaacggaacccaaagagttctgtaagtcaataaaaggcaagctctccaatataaaactcgtgaacaggaaaatctttcaaaatgaatcataaatggctaataagcacatgaaaaaagtttgacctcaattacatctggtgcagcaagtctgtggagattaaagttctcagttctaattatgacattctgagaacacaggaataaactaaacggaagtgcttttcctattctctcactcaacctacacagaagacttctgtgaccaaatgttttccccacaaaccgagcaagcaatcaattctgcaggatacaccacctgggtgtcctgtaattcaattcaactgcaatactatctaactcgagacagtattagatcccacgggttggggactcagtctccaagactgccccttcccttcagatgcccatctaaagccgtaggttgtttcacctgcgcttctgactggctataaatcaggattctcacagccccctccttgggttcgattaatctgctaaatcagctcacagaacacagggaaccacttatgtttaccaacttctgataaaggctgttacaaaggatacagataaagggatgcatggggcaaggcatgtgggagggggcagagagttccatgccctctctggacacaccgccgtcctggaacctccatgtgttcgtctttcagggagctctgcaaaccctgtccttttgggtttttatggaggcctcattagtaagcatgattcactcaatcattggctattggtgatttccttaaacttcacccctctcccctccccagaggttaggggatgggactgaaagtctcaaccctctaatccaggggtgtccaatctcttggcttccctgggccacactggaagaactgtcttgggccacagataaaatacactaacactaccaacagctgatgagctttgaaaaaaaaacctcataatgttttaagaaagtttaaaaatttgtgttgtgccacattcaaagctgtcctgggctgcatgtggcccatgggctgtgggttgcataagcttgctctaagcttggacaaggtagccccattctaaagccacataagggttgccaggcatcagttaattcattagcatacaaaaagacataccactttgaaaatcctagaaattttaagaggaaactcagagggaagaccaaatatagtcatgtgccacataatgacatctggctcaccaatgaccacatataggacgctgatccataagattataatgccatattttcactgtaccttttctatgtttagacatacaaagaccactgtgttacaattgcccacagtattcaatacagtaatatgctgtgtaggttcgtggcctagaaaaaacaggctaagccatagagcctaggtgtgcagtaggtatactatctaggtttgcgtaagtacattttatgatgtttgcacaaagatgaaatcgctttatgacacatttctcagaatgtgtccctttctttagatgacacatggctgtatatacttcacagtgttagatgtgatgtccactgctgttccaaagctgatttgatcctactctcaaaaaagtcaaatcctgctcctcagcttttcaacagctactttaaatatatatatatacatatatgtgtgtgttttatatatatatacatatattaaacaccaatctaaaaaaatagatcttgtagacaaaaacactgaacagacagtagaaatatgcttttcagtatgctctcctggttgatttctgcaacacttcttagttatcttagtatataaaacaccaagtaattccaaagaagtagttaaggctaccagcatacagcccattctacagatacgtgggccagtgtggaataaggtggaacctctaacttactataccaaaaaccctagccaaagagaaagttatagtcacttcctggcccactttgtcaagccaaaacagaccattggaaactactgcgtatcaagcagaggctgtggtacagctaaaataatggagaacatatggtcagtttaataacggccaaggaatagtgagcaagtctaacacatacttgttattatactgtaaaatcatttttctgctttccataatgggtgggaaggaggctggagagtggaaagaaaggagcaaaataaataaaaatggccaaacatagaagattttctaaaggactagccacaaaattataaaccaacttctatccgtggtgaaaacaagaaaataaatcaacagaaaacctgagaattagcagatttgtcatttcttcctttgtttatttgtggtattctatcccagcccacatttttcctaaagcaataactcgtaggtttcctgggtcctgcagccagatgcaaagatctgaataggcatgagtaggggctgagctgccatgctacttttttcttgtcttgctctccaggaattccgtgtgtatggtgaggcgtctacctaaagcagacgctcaacattcacccaacacattctatctgttattcagaattattcagcttcttctttgcactaaaaagaaaaaataactaactcaaaatgggccacagacataaaggtaagagttacaactataaaacatggaaggaaatacaggactaagttttcttcacttaggcaatggtttctaagacatgacatgggaagtacaagcaacaaaataagagatatagataactggacttcaccaaaattaaaaccttttgtactataaatgatgactatgaagaaagtgaaaacataacgaatacaatagaagacagtatccagagtcatacaattaagaaggggcttgtatacagattatagaaagagtgctttcaactcaatcataaacagacaaataagccaattaaaaaacacagctgggccctgtggccaggagtttgagacctgccggggcagcacagccaaaccccatctctacaaaacatttaaaaatacaaaagtcagccgggcatggtggcgtacacctgtggtttcagctactcaagaggctgaggtgggaggctcacttgagcccaggagttcaaggctgcagtgagctatgctatgattgtgctaccacacttccaggcaactatctctaaaagtatatatatatatatatacacacacacacatatacatataataaaaattctctaattttttggaaaaatgttaaaaaatgggcaaagaatctgaatagacatttctctaaagatatacaggttgagcatccctaaccaaaaatctaaaattcaaaatgctccaaaatctgaaacgttggagtgccaacgtaacacaagcggatgatgacattaattaacactgcaaaaaagtgcccatagacaacatgatgaaaatgtgtgatgggtttattcaaggactacagcagggtacattcataatagaacaagaaatcatgccagtttataaaattcgagagagaagtcgaagtcaaaaactactgttaacgaggaagatgactggaggacgcatttaaaaagccatccagcagaaagcctcctcatccttagaggactcacttccaggtccctcaactgctactggtgtttctgctcaactcaaaaaacaaaaccacgtacagtgaattcttatctttttaaaaaaattttctttcttttctataacctcattttagaaatgatagagtttttaatcaaaacacagcatggcagaggaagacggaaagcctaccgttgtttgttcctgccactgtccaggaactaacataggtattctggtgatgctactgtactgcttagctatcctgaacacatttattttttcaccatattaatggtatgttgttttttttttttactgttaaatatgtatgtgtgaatcagtgttagaaaatgatcgcttcttagaagaatatacattcagaggcaggaatgagggtgatgccacacaaccacagactgtccacatgggtggctgagatagtgacctctgcattctgatgattcagcatacatgaactttctttcatgcacaaaattatttataatttataattatataattataatcataattataaaacaaatgaatttcatgtttagacttgggtgtcatcctcaagatatctcattatgtatatgaaaatattccaaaattcaacaaaacccaaaaaatccaaaatctgaactccttctggtcctaagcatgatgggatatttaagctgtacaataaaccataagcacaggaaaagatgctcaatgtcattagtcattacaaaaatgcaacacaaaaccacaatgagatactacttcatatctcctaggataattataatttaaaaagaaagacagagaataacaagtgttggcaagagtgtggagaaactggaaccctgtaagtaagaaaaaacacacagataagcaatttttcctctgatctcacaccacaaggtgtggagattttctccacacatgaagcaagcaatcagtcctacagaggataccagctagttgtcctctaatgcaattcatttccaacactatctacccggatatggcatcagatcctacaggttgagggcttggtccctctaccccacccctaaccccatgccctaaccccacctcacccctgccactttagatgccagtttcaagccccaggttgttttatttgtgcttctgaaagggtctagatcaaggatcccacaaccctttccctgggctcagttaattagctagagtgcctcacagaactcagggaaacatttacttacatttactggcttattataaagggtattacaaaggacgctgaagagatgcatatggtatgtatgggaaaaggggcacggaacttccaagccctccccaggcacgccaccttccagaacctccatgtgttcagctacccaaaacctctcaaacgctgtcctttcgggtttttttgttttgttttttctgagacagagtgtcactctgttgcccaggctggggtgcaagggcgcaaccttggctcattgcaacctctgcctccagggttcaagcaattctcctgcctcagcctcccgagtagctgggattacaggttcacgccaccatgcctggctaatttttgcattcttaggagagacagggtttcatcacgttggtcaagttggtctcgagctcctgacctcgtgatccaccctcctcagcctcccaaagtactgggaagacagggatgaaccaccacgcccacccctttggtgtttttatggaggcttcatcacacaggaaggaatgactaaatcattggccaacttaaccttcagcccttcgctcctcccaggaggctgctcactgctgctgtgtagccactgacccgggggctctgggctgctgccatgctacttagtttccctgaacacacgtaggagaaagtccgaaccctccaatcccgctgtgtccttctggtgcccagccccgtcctgaagctacctaggggctgacagccatcagtcaacatatgagcacacaagaagacatcattgcggacattctaaggattttaggaggtgtatgccaggaaatggggacaaaaaccaaatacatatttcacaatatcacaccctcatacactactggtgggaatataaaattgtacaactgttgtggaaaacaatttagaagttcctcaaaaggtttaatgtagaattgccattcaactcggcaattctacttctagctgtatacccaaaagaaatgaaaacctacatccactcaaaaacttgtacaacagttctcctaacagcattactcacacaagccaaaaaggaaaagcaacccaaatgtatggtttggctgtgtctccacccaaatctcacctggaattgtaataatccccacgtgtcaagggcggcgccaggtggagataatggaatcatgcgggcagtttcccccatactgttctcatgatagcaaataagtctcatgagatctgatggttttataaatgggaatttctctgcacaagctccctcttgccagctgccatgtaagacatccctttgctcttccttcgtcttccaccatgattgtgaggcctctccagccatgtggaactgtgagtccattaaacctctttcctttataaattacccagtctcaggtgtgtctttattagcagcgtgagaacagactaatgtattaaatttccctcaaatggtgaacagataaaatgtgtaccatccatataatcgactattattccacacaaaaaagtagtggtaaattttacagcaaaactagtcataacaatgattccatttatatgaagtgtccagaataagaaaatctctagagataaaaagcaaattagtggttgcctagaatgacagtcagtgggtgttctctctctctttcttccttccttcctttttttctttttatctttctctttttctttccttccttccttgtttctttctttctttccttccttccttgtttctttctttgtttccttccttccttctttctctttctctctctctctcccttcctctcctctcttctgccttttatcctttcctctcctttcctcttcctcttgctcaagacaaggtctcactatgttgcccagactggacttgaactcctgggctcaaacagtcctcccacctccagcctcccaagcagctggaactacaggaaggagccaccaacaagtcttttgtttttaagatgatgaaaatgttctaaagtggcctgtggtgatggatgatgcacaattctatgaacgtactaaaaatccactgaattttacacattaaatggatgaattgtatggtttacaaattgtatctcaataaagttattttttaaagtattcagccttctgggtcactatggcagacaaggatacagatttgtttaatcttctctaagtcatatgaaaatggcaacaaccaatttcaaaagaaaataaattcacaacagtgctaaaaaaaaaaagagtataaccatagacaaaataaccatagacagaagtcacaaccccaaacaagcccagagggccacagttatcctaacagtagagccacagagaagctagaaacccagagttggcaggtctccagatctggaatgggaagcagaacatatgtcaccatgattaactgaaaaatcatctgcagaacagcttcccatcctagccccctcccaccctgttccccaacccagaggcttgcctgcagcaaggcagttagcatgggtctaatcccacctgcacttgtgccagtccatacaccccacctcgtagaaacccattccagccctcttctatatgaagggaagaggcctgctaaggacacacactccacacagccagagcaactccacctgtctatatctgggaacccaaactttcattcatgcatatgaatgaaaaaaacaaactccaacagacatttgaggactaacggtggctttcaaaagaagttctaagatttaatgaaacaactgaccctcgatgaagcaaaaatccaggaaacagaagataatctcagggggaaaaaaaatctaattgtttatttagagagattcaaaataatgcatccataaaaaagcagactgcaatgaaaattgagtgaccagagaatgggaaagaactcttgaaactataaataaaactataaaaatgttgttagaaagagtggaagatcgtactttaaaataggaaagaaaaattaaaagacatagaagattgatctaatccaggagaaccaacacctatctaataggaactgcagaagtaaaaaccatttttaaaaagtagagaggacaaatattttcagagctaaggaaagacatgactgaaagggctccacaggcaccatacagcaagaacacaagactcacacttccagaaacgtgagtgggtaggggtcaagagagccctgaaagctgtccatagagatagagccaattacccacaggtgagatctcaaaggtcttttcatttaagagactccagtgcatactgcatactaaatcaaagccaattaaggcaaaagaagggattaaatattttgaaacgcacactgcaaagtctaccacttgtgttattcattcctcattcagttacctaattcctaatctgcttaatttcccaaacagtgaaaccggaggacaggccatgaactttcacgtacaagtctttacattggcatacgcttgggtatcctgggtaagtatcaagaaatggaatggcctagtggtacagaacgtatatctttaacttcttaactaactttttcaatttttttttttttttttttgagatggagtctcgctctgttgccaggctagagtacagtggtgcgatctcagctcactgcaacccccacctcccggcttcaaccgattctcctgcctcagcttcctgagtagctgcgatgacaggcatgtgcaaccacacctagctattttttttatttttagtagagacggggtttcaccatgttggccaggatggtctccatctcttgatctcgtgatctgcccgacttggcctcccaaagtgctgggattacaggcatgagccactgcgcctggccttcaactgtttttaaataattggaccttttacattcctgccaccagtgtgtacgagctcagtagctccactttcttaccaatcacaatatggccagtctttttaattttagcctttctagtagattttattagtatctcattgtggttttcatttccatttccctaataactaataatgttgagcatcttttcatgtgcttacctgccatccatatatcttctttggtgaagtatctgttacaatcttttgcccatttttttttcccttaggggattttccttcttgtcattgagatgtaagagctctctatgtattctacatacaagtcttttgttggatgtccaacacacaatgtcaatagtcaaactgttgcgaaaccctgatctagttaattttgctgaaaagaaccacattatactgcaaggagtcatgtatctacatatgattcactttacctttaaaaaaaaaacaggtaatttttaaaaaactgacatgagacacttcttaaaatcatatgctacagcatccattcacatctaagtccagcaagcaccttagttattcatacttatgaccataaatcatcataaagagaaaatttgcttagacaatacaagttagaatgagctccaactaaaagaaaattaacattttaacaaaattttggtatgtctttcagaggcttccaagcaactaagctctcactacacaatcactctagaaccttaaaattataacacatttcctatggcttccccactagtgccacccgactcttttcttttaatgatgggctctgaacagttcaggtgacggcagcagggaggcaatgtgaaaacagttctcctccttcctccgttagtcatcaggtaccttctccaacagaagagtccccgaaggcctccctcagagcctgtttactctgatagtggttgcctttctaacacagcacatttatagcatatttcaagggagtggggtgatgtgacttttacgtctttccaatctgagagttggttttcctacaggaacagatgatgtcacatttcacacatgattcagagcagaggagcctggatcatggtctcaaacctaccaatgagtttgggcaaattaattcattctcttgagtcctcagtttccacatctataaaaggcaaaggtgacttctactatttcttccaacataaagattctgctactttaatacataagcggtttcctaacagctaaacactgattgggtaccacgtgccaaaccctgagctgtgtatttacaatctcattcgatttccagtacaactctatgaagaagttactaccattttccctattttacagatgaagaaactgaggaggctcagtgttgtccacaggcacctgtcgtaggctgggacccaggctctgctgcagctgccatcagcactttgcattcagtaaagtgggaggaacaagatacagctttatgccagcccacagacagctgtgagaagtaattacagtcagagagtttcaaaaacacacacaaactctaaaaagcaagtttaggacaatttatgaagttctacaattctccacgcaactgaataacccatgaagatacctatcttacctcattacatcaaataacttccaattactggcatgctgtgcctactaagaggactgcactaaagctgagacttctcatgggctatgagagagactggatttttaatcggattctaaatcatctcagctatgtgcctttagtcatgttctttaatacctctgaagctcattttcctcacctacttatttttaaaagtctgtaaactcttcaacttgccttaggaggccctacatgatatggcccttttctaaatggtaatctttctgaacttatctctcagtgatgatgtctgcagactaaccaggctagtcttccccagttcgtcaaacaatttctatttcctgctcataccatttctgcaatttgaaatgctctccccacaaaactctaatattcagaattctagtcatccttcaagaccaagttcaacttccacctcctccatgaagttatcaccagacaaactaaatgtgatcattcttccttgctagtcacttggagacatattgtttcttcttagctaaagaataagaaacttatgagtaagaaccatgtcttccacgtctttgcaccttcaatgtgcccaacgcaagtaacctgcacaaaggtgctcattaaatgtatttgttcaacaacgcatgcatcctgtcacacctacagcataacatcacaccaggagcaactactaccaaccatttttaccaaggcaaataagaaacaaaaggtttaaggtgtcattttggtttgcctcggctatgatatatctgagctgctgatacagggaaaactactcaaaacccacgagtaaggaagaaccaaactcactcaccaaataaggcagagaactatgtagacatttggtattatctctatatagttaaggaaaaatcagttttattatagccaaaaaaaaaaagcttaattagcaaaaaaatcacagtgtcacattcaaagttatgtctatgccaaggagttttattttttaaattttttgtttattttttgagacagagtctcactcagtcatccaggctgaagtgcagtggcatgatctcggctcactgcaacttctgcctcctgggctcaaacgattctcgtgcctcagcctcccgagtagctagaattacaggcacatgtcaccatggccagctaatttttatatttttagtagagacaggctttcaccatgttggccaggctggtctcaaactcctgacctctggtgatccatccgcctctgcctcccaaagtgttgggattagaggtgtgagcaactacgccaggccaatgccaaagagttttcaaaagtctggggataactataatcagtaccctgtcagggaaagagtaaacagatgattaggtacctcaaacttcaagcccagaatagttaggtacttatgatgcatgacaaacagcataaatggctacaatacatgttaagtataagagatatactacgaaacacattctcctctaaattaggacactgtgataaaagccaaatgatttttaaaaataatttagctgttttttttactgtatctaagagtccccaactattaagatatctaataaatattcactttttaagctaaaagaagttattatatggctgtgtatacactgccttcttggtatcctcaaatattctggagttattaaataatcccatctaacatgtgagtcaaaaatgtgtagttcatacctgggtttcttcagctgagcaacagctgtatgtattaagtcagattcttggtcttcccaaaacaaaaataagtatcagataataataaagctgaaaaattaaggattgcacttataatatcggcctcaaaggtcagggatatgatgatgatggtgatggttatcacaataattaacagcagccaacacttttatagcacttattacataccaagcatgactctaagatcctttttttttgagacggagtctcgctctatcgcccaggctggagtgcagtggcgtgatctcggctcactgcaagctctgcctctcgggttcatgccattctcctgcctcagcctcccgagtagctgtgactacaggcacctgccaccgcgcccggctaattttttttttagtagagatgggacatgactctaagatctttataaatgtcaacttatttcattctcaaaataattctaagacataagtcactataatcccattttacagatgagaaaactgagccgcaaataagttggatagctttgcaaggtcacacagtttataagttcaaggccaggttcaaactcaagaagtctagatccagaactcagagaatattaaccacatgcaatagccttttccaatctaattctcaagatatgctaatatcccctttatcatcggttttccataaaattacacgttttgaaattcaatacaaagctatttgcatttttatcttgtacctccttctaggaaaatgccttcaaaaaagtattgcattaacaggatgagctctgcggtcaggcaaacttgccttatactcctggctctgctgtgtgagtgattgtgactgggagaagattacttcagatccctcatctggaaaatggggataacggtaccaacttataaggtgattgtgatgattagcatagtgcctcaccacacagtaagtaatctagtaggttaattattactgtaattagcactagtaatagttctatttgttctaaatttacctgtttcaaagtgaaaaatgttgcttctagttccagaagactaaatttgataactagattaggccaatactaaaaagtattaaaaataaacaagagctacaataacctccaaagtaaagactgcagtggctgaaaatcattgtggaaatgtttcctaataatatattttgttagtgaaaaacaagcaccaagggctgggcacagtggctcacatctgtaaactcagtgttttgtggggccgaggcaggaggatggcttgaggccaggagtttgagaccagcctaggtagcatagccagaccctgtctcttaaaaaaaaaaaaaaaagaaaaaaagtatttttttaattagtcaggtgtggtggcatatgcctgtagtcccagctagttgggaggctgaggcagaaggatcatttgagcctggaggtcaaggctgcagtaagctaggatgatgccactgcatgccagcttggatgacagagcaagactttgtctcaaaaaaaaaaaaaccaccaaaaatacattagtcaatatatataacaatggtaactatggaaaactcttatgaaaactggttaattcttggaatttcaaatatcagaagctgagaattcttcaaaccaagaacatgacttgaaattaccaagaataggccacaagaattacatgaaatatttgcggattctacatcttgggaagattgttttgatgaataattagggaaagcaggtttcacagagggaagaagaaagtaatgcaggtggagaaaaatcactttgaaatcacagctcttcatatagtttacctgggagagggatatgaggaaatacttactagtatctggagctttcccttcagatctgccaaataaaaattcatatttggccttggcaacactctgggaatgtgcagatgcattgttcacccaaacaaatgtctctgcctgcaaaataagaacaaaacaaagacacatttaaaatacatcattaaaaaacacatcataaaacaaattatccaacatgagattggtaaaataattatgacatatgtactcaaagctatctaaccattcaaaatgaaacatgaaaagtgtaacatgaaaagaatcagaatacaaactatcactgcatgattatagctatataaaaaatgtatacatataaacatctatagggaagtcagaggaaaataaaaaggatggcttgattgggaggctgaattatggtcggtttttaaaaaattaacttaatgtaacttttctgcaattagaaaactatattttggctggacgcggtagctcacacctgtaatctcagcactttgggaggccaaagcaggtggatcacgatgtcaggagttcgagaccagcctgacctacatggtgaaaccccatctctactacaaatacaaaaattagccaggtgtggtggttcctgtaatctcagctactctggaggctgaggcaagagaatcacttgaaccagggaggcagaggctgcagtgagccaagatcgtgccactgcactccagcctgggtgacagagctagactccatctcaaaaaaaaaaaaaagaaaactgtattttgtttttaaacacatcattttccaactgattatcatcacccacagtccataacaagaatatttctttgtgtggcttctgttaaagtacaccaacaaaaaaaccagtctttccccaaaatagatcacatttttatataatcaggaacaccattcagccgaacagggcatggaacagaactgccaggcatcccatttatactgattgtcctacatttcaacatctgtcccagggtcctgtgtaactcctaaattcccttatttgaaacaagaactacaaaggtgatggtgaaagtggtacatcctaactctgaactcctaagacctccttcctcgctgttttaggcaactgtcaaaaatcaggagtgtctctgttctccggctgaggactaattaaaaacaagtagcaaggaaaaaaatttcaagacacaaagaaatttgacctagcacagtcagggacgccttcttttgcctctttactatgaacctaaacattaaccaggatacagatatcaccggtactggtttctacccactggttatgagacatcatcttttctcatgtctgaacagtgactgaccattcactttgggggagagaagcgtgaagggttttaacagcaacgaagtaactatttcaaagagggaaatgttagtatttctattctatgctttggagtagaaatgactgacaatactaggaagacccaatcacacctccatcaccccactggagacaggttcagggggcagaccccactttgttctttaataccaagagctagcgtgcacaacattcagacagcaatttcttaaaagagctccacaatcacttaatgttcataacgcgtcaaatgtatcggtctgaaaaaaggtgcatactcctcttggtgttacgtgtttgataatcacaggttgttaattatccttttccccaatagagaggaaatattaattttttgaagtgtttggggagcttcaggctagtaaaagaggaactcggccaaggggctgccacgtaaggtgccctaatttgggcaggtggttagggaaagctctctgagaaactaacgcctgcagagatgagaaatatgacaggctggggaaggtcagcgacatattggcgggaaggccatacgcatggccttaaggaatggaaggatggatgaggctactcagataactaagagaaagccaaagtggccacagaagagcaagtgagtgggcaagtttagagatttgcaggatgaagagtgtagctcaaggaaaggacggagcattttgatgggtttgatgggaagccactgaagcgttttatgggatacagtgattcatttgcattttaaaagattattcatttacacttttaaaagatcatatgggtgttatatggaaaatgaattggagtgagacaagaagcagcagagatatcagctagaaatccaaacgagaacagggaagtttggaggaataggcaaaagtggatgaattaaaatatattttgtaggaagaattacacagttttctgataaactggatttaaagaatgagggaaaggggccaggcacagtggctcatgcctttaatcttagcactctgggaggctggggtgggcgcaccacttgaggtcaggagttcgagaccagcctggccaacatggcaaaaccccgtctctactaaaaaatacaaaaattggccaggcgtggagccatgcacctgtgatcccagctactcaggaagctaaggcaggagaatcgcttgaacctgggacgtggaggttgcagtgaaccgcgatggcgctattgcactccagcctaggcgacaaaagcgaaaatccgtctcaaacaaaaaaaaaaaaaaaaaagagggaaaggggagattaaggttaattagaatagatactaaccacttactctgtgccaggcactgttctaatgtaatacatggaatatctcatttaatgctcagaacaatcctatgaggtgggggctactgtcatccccatcttataggtggaaaaaagaaggcaatgagaggctaaataacttttccaaagatatatagatcctagattcacacccgagcagtccaaatctagaactcgtggcattgcggatgactcccaggaatctggcttgaacaaccaggtgcatgtattgagaatggggagactagagaagaaacagtatcaagagcctacactggggcttccaagtgatgccccaaggactcactaaaacatcagaaagaacatttttaaaaaggaatccattacaggggtgctagaaaataagaaaagatgccatctatacagcaaaagtttcaagaaattccaagaagataaatttttgcttagaatctcaactttaaggccgagaactgttctctaaagcaaggttccccttgagcaaggattcttaacctcaggtccgtggggaagcaattgccaatcaagagaattctggaagttcatgaagctggggagggggtgatttacatatttatttgcatttacctttagatgaaatttagcatgttttcaaatacaaatgtaagcaacaaaccagagtattggtagcaataaccataacttgtcatcaatagaaattcatcattttcatatcatctaacagttactacagatatttggaaatatgtatactcgtccctagtttgaaatgataatagttactagactcaccattaaatcttgttatcaataaagaaacatagctttttttttttttttagagatgggatctagatatgttgctctgactggactcaaactcttgacctcaagcaatcctcttgcctaagcctcctgagaagttgggatacatatattatcataccacaaatgtaatattttggtagccaatcaaattggtttcttttgcaactctatctacattattgtatgcatttaaaatgcactattctgacaaaagatctagaattttatcagactatcaagaggagcctgctcaagactattgtttctcaaattgcaacttatgacccattagtggcttgtaaaatcactttagtggatcatgaccacatttttatatcaataagtttatacacacatatctatttaatagaatataagtaaaaataccagagcagaaaacacactgtaagataagcattgtttcatggaacgtctaagtcacacgtgcatgtgagtgtgtgtgctgagtcatgattaaaagtgtatttctcaaggttgctcatgacctaaactgttggaaacatactaccctagagtggttctcaaaatttatcatgaattagcattacctacagcaccaagtaaaacacgtactgctggggtccatcccagagtttctgatgccgtaggtctgtggggcctgcgaatctgcattttctaacaatttttcaggtgatgctgatgttgctggtacaggagccatcttctttgtgaaccactgctctcgaccaatggtcttcgtactctgttgtatatacgaatcacctggaatcttcttaaaacagaaactgagcaggttaaggtggggcctgggactccgcattcctaaaagttccctggtgaccatgatccacagaccagctttgaggagcaaggcttgaaggcgctaaagcttccgaatgaagccgtgttcaaagtacgctcagactatcacaaaagtgaaacattttttaaaagggactgctcgacctagaagtaaaattcactaaagggctctgcttaataaagtgctccattaacatactccaccttgctaaataatataaaattcattctgcttgcatttgtgtggaggctaaagtaactctatcttggaaactaacatgccatgttgacttctgattaaccccagttctgggaatgcctctgagatttccaatttatctactgtttcttgagtaatggcacatacttacagtaaatcctgcccttacatcaaattcctacctattccctccgaagcatgtgtgccccttccctagatataatccctgggtctggggtataatggcatggagatctatccgtcttgcagttgccaaaaaccacgcttctgtctgtcagttccccaataaaacaccctataacaacagtctggacctgtctgccttctcctttggtttctcagctccacctgcactggggggttattcttaccaaacaattagttattcttgaagctgtgagcccctattgatacatcctcttcccatagcaaggcttataaatttttactgatctctccaataattaatgcaggtctttgaaaactgtattgttaaaacaatcagattaatgacagacccacagaattcagactactatttcctttggcattactaactgaataaaatatattcttttgcttcatcacagttgtttttacgaacataaatctccttaagaagtatggaacatgaaacattagcagctggactgatggtcaggtgatcagacttaaatctcggctcgatagtaccacgcagtctcacacaaatgcttcaagtttgggcttcagcttccctattgataaaaagtgttactcaaatttatctctcagctctccttgaattctgaagcacaatgattcttcacacttctgaaccagcttcacagacacttcactacgggagcagtaacatcttttccttgtgataaaattacaatggcatgatccccaaaacacaccctgtatttaaagatgcaagcccaccattaaatggatgggacaaacaaaatctcaaccttacatttgatatgacttttcacatttacaaagaattacattcacgttatccaactcgcaacattaccgattataattaccaattttagacacaagataagcactactgatgtagaatgacttttttttttttttttttttttgagatgacagattctcactctgtcacccaggctggagtgcaatggtacaatcttggctcactgcaacctccgcctcccgggttcaagtgattctcctgcctcagcctccagagtagctgggattacaagcacgcatcaccatgcctggctaatttttgtatttttagtagagacagggtttcaccatgctggccaggctagtctcaaactcctgacctcaggtgatccgcccgcctcggcctcccaaagtgctgggattacaacaggtgtgagctgccacacccagcctagaatgattcttttaattaattgtttagctgtaaaaaaatcaaaaagacgaagcagaaagctacaggcaaattttagaagtaaaagtggttttcagttgatttgggaagggaatgatggggctagaggagtgaggagggagaaaaaggttaagagtagagtttgagaaaggtggcatgctccttcatttccttaattatttcaacttcagtatgattttcagagaatctgaaagcctccaagtcagccagtgagtattataaagaaaaaattaaacactaaattaaagactataaaataatatttcatgactcactcaaaactaacacttggttccaacagtcacactctgcacttgatcctgctcaatcctatctgctcccattgcccagcagaagccaggcccatggaagcagggagccacgcacaacttaagtgcagacagggacaagaagctcaaggctaatgctgcaaaaggcaacagttaggcgttatgggctgaattgtgtccccccaagatttatatgttgaagtcctaacccccagtacctcaaatgtaactgtatttggagataaggtctttaaagagataattaggttaaaatgaaatcagtagagtgtgtcctaacttaacatgactaatgtcttcatatgaaaagatgacgacaggcacacactgagaaaagaccatgtgaagacacagggagaaggtggccatctgcaagacaaagagagaggcctcagaagaaagcaacccttccaactttgatctcgaatttctactctctagaactgtaagaaaattaatttctgttgtttcagtgccctgtttatggtactttattacagcagcctagttaactattactttaggaaaggctacagattagagggcaaaaggaaaattctccaggatgacaggtaacaagcccctgctattcccttttaataagcaaaagggtctggatgagaaggtatatccttgcaccagcccacacaggaggaatgtgggtttgaagacatgcaaagttgtaaaaggaggtgaatctttcactctagccaaaaacagcgatgtataatactctaatccagtggttttcccagctgtgtacatgagaatcctaagattcaaagaagctgcctgggtatagagacagggtggctgcaaagatcaacaaaggaggcatggtgaaaaagactcttgttcactcaaccccacaccacttttgcaaccacagtagttccatttctgttttaaagattcaagttctataacaggtttatggggaagggagacgtccagtgtaaaaaggaaaaagaaaaagttttaaaaaatcactgttgtttatttctgggtaagatggcaaaataaatatacacatttgcatttgccctcatccaaagctactaaaagcacagtaaagagattcttcttataaaagcacaaacccacaggaaatagaataagaaaaatgacatttttgaagcaaatgatctagtgataactgacacaggagaccacaggaaaacctggagaaggaaaagaacaattcaatgcaccccacaagacatccaaaggacaagggaatgagggagcctggtaaactcttgaagtgaaggaaaagggagtggcttagataacagaggactattcacaaggaatggttatcaagcacttaagtcctcagatccctgcctccactacactgggagacagcccctcccctactcaggtaaaacaatagttttattaactagagagatttttcaaagagcactctggcctaggggacaccacacactactgaagttaaagataccatagcggaaactgggatttgtatgctggatgttaagatgcttagatttcttcactcaccaagctaatgaaattatggcaccctatacttcaccatgcaagcaggagaccggaagagttttcactgaggaatgcagctagaccaagaaggaaaacctacaaaattaagtcacgactctattagtaaataacttaaccagatcctcctacagtgaagcttagagcttccacgtggctattaccaccccactactatatcacattatactccttaactttcatgactatgatggttttgaaagtttcaggccagttattttacagaatgttcttcaacttgggcttatcttcatgtttcatgaggctgttcttctctttgcaccctatcagtggcacatgctttcactttgtccaattacagatcacattcactttgatctgccaggtttcaccactgagaaacctttttaagttgacttaaaaagtttaagccagccaggcatggtggctcacgcctgcaatcccagcactttgggaggccaaggcgggcagatgaccggaggtcaggagtttgagaccagcctggccaacatggtgaaacccccatctctaataaaaatacaaaaattagccaggtgttgtggtgcatgcctgtaatcccagctacttgggaggctgagcgaggagaatcacttgaacccaggaggtggaggctgcagtgagccaagattgagccactgcactccagcctgggcgacagagtgagactccatctcaaaataaataaataaataaataaataaataaataaataaataaataaataaagtttaagtcagcttaaactttttctcttagtaacgaattattacgctgtggaaaggcacttaggaactatgtaaatatcttgtttcacaccaaactttcaatttataattttatttatttttatcagaacaggctgaatttattgcttttttatttcagtgctcaaattgcccagttgggactgacagaagcctcttcaagttggcttctgtgtcttttgacctgtccccattattctctgagcatttatttactttctcacgccacagaatgttccatgcttctcttatattttccatctgccctagaatgagccattttattttaaaacaaaactggttcctttcgatgaaaaatattctttagatctaagacctcaacactagctgtgcttactgttattggagagtagctgcttataggtcagctagggaatttcagacagacacacacacacacacatacgtacacacacacattcacactcactgtggtagactaaataaaggtcctcccccacaaaatgtctacattctaatctctggaacctgtgaatgtcaccttacatggcatagcctttgaaaatgtgattaaattaaatttctgggcatgggagggctatcttggattagccaagtgaaccctaaatgacatcacatgtatccttataagagggaagaaaagaaagattatgaggcagaagagaagaaagtcatgagacagaagcatagaaaagtagagccagagataagatactacaacactggctttgaagatggaggaaggggctgtgagccaaggaatgcaagaaatgtagctctagagtctagaaatggcaaagaaacagattatcctctggcaccttgattttagcccctaagactcctttccgacttctagtctccaaaacttgaagagaataaatctctgttgctttaagccaccaagtttgtgatactttcttccagcagctataggaaaccaatacagataaacagaaatatacacaaatacacactttatatctacattatctctacatctaccttatctaataaaaaaccataagtcagctgggcgtggtggctcacacctgtaatcccagcactttgggaggcccaggtgggcggattacttgaggtcaggagtttgagaccagcctggtcaacatggtgaaaccccatctctacaaaaatacaaaaattagccaggtgcagtggtgcacacttgtaatcccagctctcaggaggctgagacaggagaatcgcttgaacccgggaagtggaggctgccgtgagccgagatcgcgccatgcactccagcctgggcgaaagagtgagactccatctccaaaaaaaattaataaataagttcacattcatatttttccataaatgtatttatgctgctttcaagtacaaatgagtcattaatgagataatcacaagactaacatgtaacttgttactccacctgtactgttcctttttagcacagatcatccaaatacactttgctctccctctataattaagactttccactataattaaaaattttttattgctgaaaaacaaagaaaactatccattccctcagtttatctggcaataaagaggaagattcaagtcctagcatgtgtagcatttttttcctttaaaaatatatttgaggccaggtgcggtggctcatgctgtaatctcaatggtttgggaggtcaaactgagaggattgcctgaggccaggagttggagactagcctgtgcaatacagccagacccctgtccaaaaaaataaaaaataaaaaaatcagccaggcagagtgtcatgcacccatagtccctactactcaggagcgtgagggaggagaatcacttgagtccagaaggttgaggctgtagtgagctatgattgtgccactgcactccagcctgggcatggaacaacaccttgtttcaacaaataataacattaaataataaaataaataaaattttccaggcacggtggctcacgcctgtaatcctagcattttgggaggccgaggtgggtggatcacctgaggtcaggagttcaagacaagcctgaccaatatggtgaaaccccatctctactaaaaaaaaaatacaaaagttagctaggtgctggggggagtgccggtaatcccagatacttgggaggttgggacaggagaattgcttgaacctgggagacgaaggttgcagtgagctgagattgtgccactgcactccagcctgcgcaacagagcaagactccatctcaaaaaataaaaataaataaaataaaataaataaaatatattataaaataaaattaaataataaaatataaatatatatttgacatacacctgcacataaacaaatggggaagatgctcgtgcttgggccaaaggggatggctcacgtatgccctacaaccagtccctcgtcccctcacagactaactggatagatattccaaaagtcagtaacaacatcaagtaaaaaagtaaaactgggacagaatgcctctcaagagtagagagcttcacggacaaaacagccaggaaacaaaccaggtagctgaaaggccccatctttaatttgtgaaggttagaaacagcatggaaaccaaagggcaaagcaggaaatggaccaccagcttagggagaagacgtcggcaaaaagcaagcctcggtcctcacccagtcatcatgcagccccgctgccagcttgtttttaattgtgtgagcacaagaccaataactgaattcatggccttgttaaaagcccctggaggtccattctcattttcccaccagctgctctcttcactctgtccatttccagtgtgaaagacgctcccctgggacaaggggaagccggggttctgctgctcctccaggcaaggggtcagggagcggcggccatatggggtggcggggggcccagagcagagccgcagtggcacgagctggcttccatcgacacacatgtgaaggcagaggaaaggacaagaaagcatgcctttaacaggttcaaatgaatcttcctttggtaaccttcatgttggacccattttcgttgtcttttaaccagatgggaagattctatcccccttctaggaaccgtgcctggcctgggcaaggttctgaattcataatacccgagggcttcttaccaatggtggtagctgctttattttttttgaagtgtgacatagaaagctgggagctagaaagctaggacggtacacattcatttgtaataaagcctcccataaaactaaagtaggatagagggatcaagtcttcttcacaactccttcactaacacagcagtaactaaagagctggagaccttcaatgaaagaatttgaagaaaattaacaaccgactattatgagttcacagcatatcctccgcctttgccaccatctcataatcagtaatgacagactgagaagacgggcggacttggacagcaaacaataaacctagtgattcaagacttcatctcgccttttcccctacctattcctgaccttttttgccttcctcaggttctggacctgtgtgcttctgataatgtttaaaattcacaaatgaagcagatagtataaatatttgcatttaaaaaataaaaacattgttaaacctttgaacacatcttactggctacagactctggattcttaacaggaggatggagctctccacgttgggagagcacttggggatttaagtcgggtcacatgaggaaaagctgaaaactacacagaactttaaaagtcagcccagcataatcaggatccctatgaggaaatcaaccagactgaataaataacattcataaatgctcctctacttctttctcaaaaaaatggaggtgggtcaggtactgagaacaatcaaaacaagtactatgcaaagcagagactacaggctcacacgaagtgttcaataaatatttttcctgaatccttataaactaggaaacctcaaaaaagccttgaaaccttggaaaaggttaggaagaagtcctacaaagaaattgcataagcatcagccttagtcacctaaatctgctttgcaaatatcatggtatctttggtcatttcagaagttccaataacttctgaaacaaagtgaaatccactctatatttttaaaaaacataatttgtcactttgacaaagagaaaaacaggtgctaaatgtgattttaaggtgggaatcatgagaagtaagtgtcttctcaccttagtttgctatatctctagttcccttaacttaaaagtgacctcttggtggcaactgtgtatttaagtgaaacatgtaatacctagaactgcaccttacaaataagacaggcaaaagattgctcttgattaagataagaatatagttatacacggtgaaaccccgtctctactaaaaatacaaaaaattagccgggcgtggtggcgggcccctgtagtcccagctactcgggaggctgaggcaggagaatggcgtgaacccaggagacagagcttgcagtgagccgagattgtgccactgcactccagcctgggctacagatcgagactctgtctcaaaaaaaaaaaaaaaaaaaaaaaatatatatatatatatatatatatatatatatatttatagttttcttctcttccaaggagttaaaccagtgatcaaacaaattaaatcaatgttattttctacttacacagtattaatcatttacccaacctacatgcatgcagaaaaaaaataatctcctaggcaaatataaacattctgaaactcatgaaatccatgttgtgatttacactaaaataacacacgaaatatttaaaataatataatcattgcattaatttctgtaagaaatacatgtcccacttaaatttcattaaaggtaaatatctccaagcaaatgatcatgagcttcatatcacaaagaaaatctgaagtcaggtcactcagtggaaagcttttggttctgtgtataggacataaatcgtgaccagatcataccaagcatttcatccctggctgttaataaatgaatattatgaagaactgtccataaactgagctcagagcatctacaaaacacatgtctgtaaggacaaggtaaagaggggcaccaaagagagcataaggtcctgaaaatataaatttagcaaaaaatttcacatcagttctcagacgaataacactatctctcgtcttgataaattttttcatcatattttaaattttaatttaaaatgatatagaaaagtaaaatacattatatgggtgcttaatactcctgtcaattaccagtaaagtcattcttcaaaatgtcatgacaagacaagatgcatcaactgcctgactttccactgcgaaattcttacatcccagcttcagggaggttctgagggcagtcaataggtgcccaatagcacctatttaaactatagctttgtcacgatactcatactacctgcaatatgaaaaagttcccattatacctttttaacttttataaagaaacaaactatttatttgtaatgaatattcaaagacacaaactattcgttgaaagccaaaaggaataaacttctcagaaaggaattgtttacagaagcatattaaaagtggttattttattagtttttttgaggaactctgttacttttcccttaacacatccatcacctcaaatactttttgtattttgtggtagcaacatttgaaatttactctcagtgattttgaaatgtataatacaccattattaaaattatattcaaggtgctctgcaatagagctcaaaaaagaaacaaacaagcaaaaagaaacaacgtattcctcttgtccaactgaggctttgcaccctctggccatcatctcccgatttcccctaccccagcctctggtaaccactattccgctttctgtttctatcagttcaactgttttagagcccacatacaagtgagaacatgcagtatttgcccttttatgcccagcttatttccttttcacttcataacatcactttgtaccccataaatatatacaactataacttatcaatttataattcatatatttatatatacataatataaaattccacgacccatttggtcactgacctctcggggaacatcaggttgttccctggtgccttgacaagagtttatcggcctcacccacacacgcaagtgatccaagaactgtcctgtgtcatgcacttgagaaagccaacacaggagacacagtatttctgttgctctagggccgagctgcaatgggttacctggggtgcttgtggataaactgctgattgctagattgaatcagattcttaggaatggagctgcagaacctgcattttgacttgactcctccatgtgattcttaggcatgctgatgtttgaggaatattcattctggaactatatgagtatacaacagagccctcaaaaagaaaagggcatggtggctcatacctacgatcccagcactttgggaggccgtggtgggaaggttgcttgagcccaggagttcaagaccagcctgggcaacatagtgagacaccatctccacaaaaaatttaaaaaatagccaggtgtggtggcacatgcctgtaacctgtagtccctgctactcagggggctgagcagggagaatcgcttgagtccatgaattaaaggctacagtgaggtatgatcacaccaccgcacttcagcctgggtgacagagcaagaccctgtctcaagaaaacaaaaaacaaaccaaaaaggaccacggaacagcagggcagtggaaagcaaggaacaaaacccaatcctctagggccacagccaccattcctacaacacaaaccacaaccacaaagtacctggaaaaatgcactgacaagttaggatttctggcttcttgagggtattttacaactgatgttaacattgttagttgcttttatcaatggcttcaaatttgtgcaattagtgaaaataattagccatgaagttgcttttggacccaaacaatcaaggaatataatactgggaaatgggccaggcacagtggctcacacctgtaatcccagcactttgggaggccgaggcaggtggatcacctgaggtcaggagttcgagaccaacctgccaaacatggtgaaacccctcctccactaaaaatacaaaaaattagctggtgtggtggtgggtgcctgtaatcctgaggcagaagaatcatttgaacctgggaagcggaggttgcagtgagcccagatcacaccagtgcaccccagcctgggcaacaagagcaaaactctgtctcaaaaaagaaaaacaaacaaacaaacaaacaaaaaactgggaaatgttccttgctacataagactgattcagtctcacaaatactgcattttcaacagacaatgcatgaactaaagaataatgggtggatgccagtcacctttgttcttaaatacagaacactggagaataaatgattcaccaagaggtgtcctcaatttcatagttttaaagacgtctacatcctactcctcccctacccacatgcctactccacggtcaatgatctccagaacttctgaagattataggcttattctttctatctttacatccataattggaacataaaaataatgtgataaactgttaactttaagaatgcttgtttgagcttgccagagacctaaaaacggacttgtttctggggaaaaataacagagctccaaataattaaattttaagtaaacttttgggattcacatgtgaaagtcagagatcacctatacattttattgatacacatgatagtaaaatctggttcaacgcggttaacagcttacatcaatttacaaagactactgatgtgactctgattacaaatccctaattgtgctgtgagagactgataacaaatcatcttgtgaacaagaacaaatgaattaaatatacaaattataggactgttagaataacagttccattatttagagcacaataatccagcaaacatatttggaatatagaaagcagattttcagagtggccaaagcatacatgtttacaagtccatgcaattaaatacactttattcaggagagcccttcgaagctcttacatatggacaatttggagacatttagttatttttctaattcttgtaagaatccaaacaacttattgaggagacgaggtgatggccagcaggtactacataaaatcgagaatgaccaccacaggtctgacagtaaaaacaaatgataaaagacaacataagcaaagataaaagacatgtatcaactgtgagtaaacatctgcaacatatatttaaatatctaatatataacaaactccaacacatcaataacccagcagaaaaacaggcagaagataaaaacagaccatttaagaaacagaaatacaaatggcgaatacacattaaatgatcttcaaccttcctaatgatcagtgaaacacaggttaaaacaaagtcaccagtttttacccacaatagtggcaatgatcaaaaagactgacaatcaattttgaaaggctatgaggaaactgataaactcctggttggggtataaattaatggtgacgcggcatgttcatatatatctgtctctctccatatgtgtgtgtatgttgtgtgtgtgtgtgtgtatgtacatacatatggtttacaaacatttgaacagatactcaaggcaacacatataaatatatcaatggcagcactgtttgtaatagcaaaagctagaaacaatctgtccatcaatatacaaatggctaaataggccgggtgtggtggctcacgcctgtaatcccagcactttgggaggccaaggtgggtggattaccagaggtcaggagttcaagaccagcctggccaacatgttaaaaccccatctctactaaaattacaaaaattagctgggcgtggtggcaggcatctgtaatcccagctactcgggaggctgaggcaggagaattgcttgaacccacgaggcagaggctgcagagagttgagatggcaccactgcactccagcctgggtgacagcaagactccatctcaaaaaagaaaagaaaagaaaagaaatggctaaataaacgataggatggaatacagtggagcaattttttaacatgaggtaaactcgcatatactgacatggatgtatgccaacatatataaaaaacaaactgaaaaaaatatgtgtagtatgacacttaagacacacatatatacatatatatgtatacactcctcacacacatacatagtacaagtacaaactgcagggttgatactcaagatatcaaacagtgacacagggctctgagcaatttcagcagatgcttgctcagtgagaatggataccagctgtattggtacaggccatttaatgtatacacttgctcctcaacttatgatgtggctacatccccatcataagttgaaaaatatcttaagtcgaaccatcttaaggaccatctgtattagccataaatattaacacggcacataaacatgcatagaaaaaaatctggaaaaaataaaaaaccaagatacctgtggcacagtggatatgaggggcccaagatttggggaggggttcaatgctgaatttgacctcatcagtaatgctttaaatttctatgagaatgtactcatgaattaattatgtaactaaaatttaatttttataagaaaaaaaaagagtagtatggaaaaagtatatcagttgaggtactcattcattttacttgtcaagtgttatgtagttcttgaatcaaatctggctaaaattttctcataaagatgaccaatgtttagttccctaatctagaagcaatcaaccatccatccatccatccatccatccatcacaaaaaagagttctggtcggagaagaataccaagggacactgtctatcatattccaatttcagtggtggaggggatgcacaaagtaacatcctgatgtagtatttgtctagcttcaagtccagtgtttcctaaacttgggtatatctgagaattccttgaaacctcaccccaaatattctgttttcgcaggcctgcagtgggggctcaagattctgtatccctgccaaaccccacaggattctgatacagacggttcaaggaccacacactgagaaacactgctctaatccaagggaattacaacattaatctttccaccctcatcccaagttcaatgaactgcatcaactttgtaagtgacgtcacgttaggatggacagacgccaaaaaaagagataacatcaaggtgcaggcagacaacgagggagtcaaataagcagagtacacaatgtgctagtcagctttcactagattagttgtggcagtagcaaatcaccttcaaatgttagtggcttaaagtgaaggtttatttcttgctcagatgttgtggctgcttgagggccaactgtggctctgctccaggtgtgggtaggctgaagaagattcccccggcatctccttcattctggaatctatctgaaggggcagcaccacactagacacctgatatacatgacgtctcttttgtgtttttagagacagggtctcactctgtcacccaggctggaatgcagtggcacgatcatagttcactgcagccttgaactccaggactcaagggatcctccctcctcagcctcctgagtagctgggactataggcacaccacagggcctgtctttgtctattttaataatataattgttaatgttgatatattttcattttggttacatatatattactttcttggctatataaaagtttatgcataacaattattcatttatcaattttttactattatagtgttgcaacaatcaaccttctacacatttctttacattcttttctgattattcgtttatgaaaatctcctagaggagacaacattgagatcaaaggaaatgcatattcaatactcttgatacacgttgctgagctgtcctccagagaggctgtcccaggagtggacagggactgtgttttcagtcatgtctgaatctcaagccaaatcatcgttcttagcatattttatttatttatttatttattttatttttaagacggagtctcattctgttgcccaggctggagtgtagtggtgcgaacttggctcacttcaacctccgcctcccgggttcaagtgattctccagcctcagcatcccaagttgctaggactacaggcacatgacactgcctcggctaatttttgtattttcagtagacaatgagtttcaccatgttggccaggctagtctcgaacccctgacctcaggtgatccacctgcctcagcctcccaaagtgctgggattacagaagtgagccaccatgcccggcctatattttagacccctaatcaactgaatgaatggaaggaagaaggaagctgaaagaaaaagacttttctgaggaagctgtatgatttaaggaaaggcagatcactggagaagtgtaaaacacgcttagaaaatgagagctaggcccgttcagcagattgtatcacatgaaggaaggctgaggagaatgaagtataagagatcagggcttctcaaactggggtgggcatgcacaacactggtatcccgctaaaactctggttctgatccagcaggtctggggtggggcctgacagtctgcatttctaacaagatcccaggtgatggtgatgctgctggtccatgaacttcactgcaaatcataagaaagtagatgattacactggagaggcagattctctctaaaaagtttccaatgtcaggctcaagagtttagagtatatttagttggtagtcaatttaaggaaaggggtgtgatgaaggtttctgagcaagggagacctaatcaccttaaaagaatcagattaataaaaatctttatatacattaccaaccgagtcttgcttagaggaccacttattttgttttgtttttgtcactttaatattttctcagttttggtaaatatagcacacaaccttgaggctattttagcaaagtttcagtgctttacatatatccctctctagcttaaaaatgattgttaataacagaagggacaattaacaaaggatccatggtttggcttttcctggcctccctacccctaatctcctctgacctcatcagctgaggccacaccccaaggctcctgggtgttgctttctcactgtttctggtggcaaccaggactccagttggggatcctgtttataaaaataacatagggataaccaagagttacatgcccccatcacttctcctctcccaagatgaaatcttaactacttattcagtaagcagtgactgccaattcttggggcatctatcacctcaacacacctggatttaagagtaaacaatcggctgggcatggtggctttcacctctaattccaacactctgggaggccaaggtgggcggatcacaaggtcaaagagattgagaccatcctggccaacacagtgaaaccccatctctaccaaaaatacaaaaattagctgggcatggtggcgcgcgcctgtagtcccagctactcgggaggctgaggcaggagaatcacttgaaccagggaggcggaggttatggtgagcggagatcacgtcactgcactctagcctggtaacagaacaagactccgtctcaaaaaaaaaaaaaaagaataaacaaccacacaggaaacaacagtgactgtacaatgtgagcaatgacttcaactcaggcaaacagtgaaaggtaagaacaccctagacagaatccacgggcccaacagctaattccacatctcatccatctctgttccctccagtcactagcattggaatgctgacagaagatggccagcatttgctacaattctttcacctattccattacagcctagacagggagggctgtaaaaaaagactcaggaataaggtaggcagaacggcctcagtaccttatgtctgggcattttgccaacatcctctcagatcctgctcatctagaacacagcagtttccgaggttcttatgaggctctctagcaggaagccactgcttgccaaagctcatgagatcaccaagttaataatgaatgcacttgtgggtggggtgaagtgtggtgcagctagcatgactgagacttcaaatgacctgggctgtgggaaatgagtcttggccagaacacttcagatatttgccacagcacgctcatacactgttagagtgtaaggaggtataacctttttcgaagataattaagctattgctaccacaatttgaaacacatatgcccttttatccagcaactcaactcttaataatttattccacagacacataccaaagaggaaggtacaatgatgttcatttcagcaaaatatgagaacttaaatgtcatcaagggcctggctaatatacaaaaatataataaaatataaggtagatattaaaaaagaatgagaaaaaccttgtgtgctacactgaaactaccgccaagatatactgttacatatataataatgtatgcatataatgtatcatctacataattatgtatgcacacaaacacacaggctaccctctgttaacagagattgtcttaggggaactgggtttctgaggttagagaaaggcctttgttttatagctcctgcccttttgttttatttatttatcatacacatgtattactatttcccttttttgtttactttcttttgggggaatatctatttatttacttttgggttcccaggacatagattctttctgagcactcaaggaattacagaaaacatttacaatgaaaaatgcaggtcaagctagcaagattaaatgcaaaaatcttaagatattagcaaagttaattcaacatcaaaaagataatctatcatgaccaacttggctttatcctaagaatgccaagctgttttaattttagaactcaatcaatataatttaccacactgatagatgaaaaagaaaaacccatatggttagcagaatacatgcataaaattatatgcaataaatgtgaatgtcaatttattattttaaaaataaccttagcaaactaggtatacaaagaacttctacaaatctgcttaaagcactattttaaaaaatccagaataaacatcatacttaatggtgaaattttgttccaataagtcctatatacaaacaggatacagaggagttaagtggtgttttttttttttttcttttgagacggagtcttgttctgttgcccagggtggagtgcaacggtgtgatcttggctcactgcaacctgcacctcttgggttcaagtgattcttctgcctcagcctcccaagtatctgggactacaggcacacatcatcacgctcagctaatttttgtatttttagtagagacggcatttcaccacgttggccaggctggtctcaaactcctgacctcaagtgacccgcccgactcggcctcccaaagtgctgggattacgggcgtgagccaccacgtccagcttaagtggaggttcttaatccctttctgaaagacgatccctttaatatatcttacatatcatttcagggtgtttcatatccatctcccttccgaacatccaaagccagaagatgcatgaattccaactgaaaaagccctggggaatccattctccagcactactggattcatactaccaaaataacccgctgtacactttacagcattttaaaaccttcagcgggtcctcagcctacaaaataaagctcacactctagctctgcacatctgactccagtctcctattccaactttctctctcattgctcacgacactaagcaacggtgctcatctccttggtgttcatgtcctcggtatttaatgcctatgactccacccaccttgcctttctgcccacactcacattccactaagagaactgggaatcaagacattacttttattactgataaaagctgactagggaaaatggctaaagatcagtgacaagaattagccagacctccccagccagtcactggcacagctagacaaactcaagccacgccagcaaggccaggtctgttaacacaaggcagaaaaggctgtagtacagaaccagctctgaacagagaggccctgcagtgccgagctgaggatctccttcttacaaattcaccaatcagataagccactctttttcccattgtggtccctcaggctggaaacatgaggccagggaaatgtcacctccttcactaatattcaatccttgttttcaaagcacagtacaagtcccactccaacctgaaaaatcattccatccccagaaaaattacccattatcgattccttggaattcctagggaacctaatgcctgggcactgttttgattcaacatctacaataatgtctcgtatactgatagcagtttctctatcaagaaaaaccgagtccctgtctagctctctgaattctcatcatttagatgcatgctcagaacaaagacgatgctcaactatatgaattttgaaaaattatgaatgtcagaatgcagagtgtggtctttaataggtaagaaggaatcttaagaaagagaacgcatgaccaaagaagtgtcttctgaagatgagtaatcgatggcatgtctgattagaatacaagacacagacacaagacaagagaaatggcaataaagaaaactattatttagatgtgatttagaaaagggtcctcaatatcagagtaataaagcagaaaccataaaataatagaaagctgtccaacaaaaaactgaataaaaacaaatcaagaaaagaaattaggaaatgcgtaaatgtactaagggtcacaatagatcaccagctgacagtaaactgctgcttagtgacattgttcacacaacagggctgttacagatgggaagtagtaagtcatttttacactttctatgtataaccaacagatcccaattagatcctaactgaaaagaataacgaagacaatttaaagagctgaaaatgaggcttctagaaggaggaaaacagcaatttatttatttatttatttaattctgagggggtaatcatactcttaaagacaggctgggcacagtggctaatatcggtaatcccaggactttaagaggccaagggggcagatcacttgagcacaggagtttgagatcagcctgggcaacgtggtaaaactccatctctacaaaaaaatacaaaaactaggctgttgtggcactgagcacctgtattcccagctactcaggaggctgaggtgggaggatctacatgaacccagggaggtcgatgctgcagtgagccgtgagtaacagagtcactgccctccagcctgggtgacagagtgagaccctgtctccaaaaaaacaaacaaacaaaaagactactggtgaaagaaaaagtgcaactagacagtttactactctactgaaaaacagagacattcagtaacagagaaattttacctaaatctgaagaactcttaatagaatcattgttaataaagtgatggtggaaacaacactcttttttactttgacaactcaatacttacgagtccacagttactaacacaatgacacagcaatatagtacacaaagaaggttactagtcaagctacttaagacaaggaggacaaaaataacagaagagccataaaaataaatatatgcaggctgggcgcggtggctcacgcctataatcccagcactttgggaggccaaggcgggcggatcatctaaggtcaggagttcaagaccagcctggccaacatgatgaaaccccatctctactaaaaaatagaaaaattagctgggcatggtggcacatgcttgtaatcccagctactcgcgaggctgaggcaggcagaattgcttcaacccaggaggcggaggttgcagcgagccgagatcacgctactgcactccagcctgggtgacagagcgagactctgcctcaaataaataaatgcagaaggtatttgtagatataaatattcctctaaagaggtatttaagattaccataaagatattttatttgtcctgagtcaagaacatgataaatcagatataccgcctaacaaaactattcctaaatcctggccaaaagtatgtgtgcttcctccactacatagcactcactccctccagcccataaaggacatcattaattgatggcttgctttcctgcgaaaaccatgtaaaatctatgacatcggctttcactttgcaaaaattttatatttaaaaataatgaatcccagcactttgggagaccgaggcatgcggatcacttgaggtcaggtgtttgtgaccagcctggccaacatggtaaaatcccatctcaactaaaaatacaaaaattagccgggcctggtggcgggcacctgtaatcccagctacttgggaggctgaggcaggagaatctctcgaatctgggaggcggaggttgcagtgagccaagatggtgccactgcactacagcatgggtgacaagagcgagactccatctccaaaaaaaaaagaaagataggtccattgcaattcttaaaatcttgttgtagactaaagttatcaacagagaagaaaaggaaaataattgatgaaataaatttaatagcttgttgtaaataccacgaattgcctttaaaaatttcctcaacattaaaaaacttagaaatctttggctttcattaaagttgggaatatatgacaacacacacacacagcaaaaggtatttttggtgggaggaggagataatattttggaaaaaaaatggcaaactatattgctaatgcagctccagtgaaatgcctttttttacaaagtaaaaagatcagtgttaggttgagaatgggttagagttattccaattcactatcaagctctaattccctccacagcatcctgcccagaagtttaaatacctcctcccactgtgaagaattaactctgcctagagagcttttgttgttttaaatcttttttcttaaaaaaagaaagtcatgcatgactatatactatgagccaggcaatgggctaacaactttatcttgccacactaatctttacaaccacctgaagatctaggttctcttgtcactcctatcttgcagataaggagacacagaaaggttaaaggtcacgtcaggccattggtggaaccaagatatgccatggtccttggaagagttctttcagcctacacaacatatgtattagtccgttttcacgctgctgataaagacatacctgagactggggataaaaagaggtttaattggacttaaagttccacatggctggggaggtctcagaatcatggtgggaggcgaaaggcacttcttacatggcagcggcaagagaaaatgaggaagatgcaaaagtggaaacccctgataaaaccatcaggtcttgtgagacttattcactactatgacaacagtatgggggaaccgcccccatgattcaatgatctcccaccaggtccctcctacaacacatgggaattatgggcatacaattcaagatgagatttgggtggggacacagagccaaaccatatcaccatatatatttccatttactaaaaaccacagaatttgacttcctgaatttgtgtttctaaactaaaaatttccttcaaaacttttctcatgcaaataccagagcctctgacgtttctgtggactatggattcccactcaagaatcttagcattttctctttttttcttattttatacatactcgactcgccaactaaattgcaaagcatcaacaagacaaatccaattttcttctctcaaaccgattcagaggggtaagcagagaccaccacagtgtttaaaaattagaatcactgattagttccttacatttgtcttgcacaagaatttctgctatacaacgctagctgggagaaaataagaaatggggggagagaatgaatggccaacagcaatgtttcaggtataaataatttattaacagtactccaaatttaatgaaatagcaatattttaagactttgttcatagttaaaatatagacaccacattatcgaaacatgaagcaaatatgtcattgaaaagagtgagaggtataatgcttgcccaaacagatcagatgggtcatttaccctacatattctatgcttatcttgcttacttactgtctctctgtgaatgatggtgtttgtttcaggtaatttagccccagtaggcaggctttcttcacgaagagaagaaataatgtcttagtaagaagacagcgcacacatgcatagtttctacatatacttgcctatatttataggcaaaatacctcaattaaagtaagagttacaagaaacaccattctctaaatctaatgaataactcgggttttttttgtttgtttgtttctgtttttgagagtgttgctctgtaaccaagtctagagcacaatggtgtgatcatggctcaatgcagcctggagttcccagactcatgtgacctcccacctcagccatcccagtagctgggactacatgtgccaccatgcctggctaattgttttaacttttttttgtagaggtggagtctcactatgttgcccaaactggtctcaaactcatgggctcgagtgatcctcccacctaggcctcccaaagtgctgggattacaggtgtgagctacattgcctggccattaataactcttgttacacaaaactaataaccttaatgacttttttttgcacaaaactaatgctttactccttaaaacctggagcattttttttttttacttcaaagattgtgttgcctcagaaccaattcacaagagaggcaatgattatctccttaaagtgtggtctcatgaacaaccagctactcttgacttctttatggagaggccttccttgatctccaaagctgctggaatgtcctgagtggttccgaactgcctaattttccccagagaggcacaaaagatcctgcgtctaccactgctctcaactcgctcaaagccagtggcctcctttttacatccaagccacccttttacttattttgaaactcaaaggaagtagattataaacaaggtggcatagatttgttcacagggctatatttcaggaactataattatttgtgtggccttcaggtcagactttttgcttttacagctctaaaatgttatttgtttaaatcccagccctaaaatatttaatataaactattaaaacaccatttgcatgaccaacttattcttcactgaatctcggctcataaaaaggttcattcatgttaaaaagctatttttaaatgcggctaactcattgcttagaatatgctaacaattaagcattatacttcactggaatttttatagtttaaaattatatttctcccatctcatttcctcccccaccaattctgccatcccaaatagcaacattattttaaactttgctgttttctatgacaataacctcattcactggtcattcagaaataatgtccttctgaagatgctggcaactgactttcacactcagttatatgtcaggttttggctacctaaagatgtatgagcacatcatgccaaggcccaagagaagttcctccagctgaaatcaagggaataggttgcgcccttgaggaaccagcgtcccctctatggagccattcacaggctgtgctggtaaggccttgttctctcatcccattaccccgttcggcgggggtgacagtgacagcaagcatcacacacgctagtgagaaaggacccatgcccggttgccactgtgaccatttactactcaagtagagcacaaggtttaaacaatgctctcaaaaattacagcctagagttattgaaaaagctgagtccccacagatagactcgaagctgcaaaatgcagtaagtggtgtacataaaaagtgtccaatccaacaagctgtaggtcaagcttgcaagattctggagatggatggcaagtgaaaacatgtgaagccaacaggcccactcttgattttgacacgtggatattttcacacccatgagatggatctgaagcttaatacagaattgtaatgcgaaaagcaacacgtgaacaaaataaatggacacataacagcagcgtaaatgccaggcctgagttaagctcctggtaatataacacccggggtttgggcttttccgtgcccatttcctcttgtgagtttaaggcacattactaaaatgatctcattaatcctcacaacacctgatgaggggagtaggcaacaaatattttaatctcccatataagatggaaaaaacaaatcaccaatgtgctgtataacttttcccaggattacagctagcactcagtcagagaaaacagtcgacttgaatctcagtaaagagttgactataccaggctatttgaaagaaaatgctgctcactaagatggatttcttaattaagcagctgtataccacatacattccaggtggactgccattccacttctcacagagtttccacacctatactaggctgtcaaacagagtcatttttcaggccaggtgcggtggctcaggcctgtaattccagcactttgggaggccgaggcaggtgaatcacttgaggtcagcagttcaagaacagcctggccaacactgcgaaatccccatctctactaaaaatacaaaaattagctgggtgtggtggtgcacgcctgtaatcccaactactcgcaaggctgaggtaggagaattacttgaacctgggaggtggaggttgcagtgagctgagattgcaccactgaactccggcctgggcaacagagagagactgtcttaaaaaaaaaaaaaaaaaccaaaaaacacaaatagagtcatttttaaaaatacttccctagacctcctggcttccagttatgccctacaactgttcttctcaaacaggggactcctcagatccccagggtcacaaaccagtgtgccccaggaggacgcaacgtttccggaccaacgggcacatcttcttggggctcaatttgaatagatggtcatttaaaatctgattttgatatttaaatatatttttaaatgaaatgcaaaattggcataaaattttcaaattagtcttaaaataaatgatacctaaaagcatgctgctttaggagatactcacaagcaaggcttgggtagggggagaagggatggtaggtgcactttgctattaagtgtagttcagggaaaacatgtccaaaaacagaacaaagcaacttaagaggaaaaacaattccaatctgcttgcctggtccaaaccattccaggcagacaggaacatttcctgccataaaagcttttacttggctttcttttcacgtgggctgtaagacctatcagcatggaatcccacttaggattttcttttttctttatttattttttttttttgagacggagtttcactctcgttgcccaggctggagtgcaatggcatgatcttggctcacggcaacccctgcctcccaggttcaagtgattctcccgcttctgcctcccgaatagctgggattacaggtgtgcaccaccatgcccggctaattttgtatttttagtagagacggggcttctccatgctggtcaggctggtctcaaactcccgatctaaggtgatccactcccaaagtgctgggattacaggcgtgagccaccgcgcctggccaggattttctattaaaaaatcttaagattactagtagtaaaatgctatttccatattaaacctgacaacatcaaagctacctattgactcacttaactatttccagaaagcccagcagataccagacttgccctgctgaaggcctttatgagctggtccacaaaacatcttagaacctttgaccatcagggtagggttctctttactatttcaaccagaaaattagaaaatcaaggaaaggcaaatgacctcagatgttggtaggaggaattcctttatatttactaaaaatatctactagctgccaaaagagtcacatgataaagttggtaaccagaaatggaggcatgtgaaagatacacacaggttatcaggaaaatcaggtgacggaagatacaggcttctcccaacacagactttttccaagtgctcagaattagaattgggtatcgagggcccattcacatattcctgggagctgcgaggagaattgcttccaatatccaagttctacaaaaggctagcaaaagatccaaacctaaaccaccaaaaccagactggtaactgctttgaggaactcactgagcactctgaccacagcagacattcatctcaagctcctcacggtggctccagatttataaacagaaatttatgtccacatttctatagttcctgaaattgccagagaaggaaattctgcacacgcacacaaaactgtgcaccacttcagggcagccactggcttcaattaagaaaaccttatgtttctacccaacatctgagattctccaactcagaaaacctccctgcaagtccaattctgactcatcaggattctctgacactgaggcaaagtttacaggagaccataaacttttcaagaagactttaaactttattttaaaagcagaatgtgtatatctaaatcaattgtcctcgttcaaatggtcaccttagaaaaccacacacgttatttcaaggaatcctgagcaaatcatttggaattcctattctgaaagaaccttcgacgccagttttcacatcacacgatgcacgcttctttatagacatctcaagactaaagaaaaactatttcccagcttgctgtcacctagcttgcagagcatactttaaaatgttgtggcctgggccaggtgtggtggctcacgcctgtaatcccagcactttgggagaccgaggcaggcagatcacgaggtcaggagtttgagaccagcctgaccaacatggtgaaaccccgtctctaataaaaatacaaaaaattagctgggtgtggtggcatgtgcctgtaatcccagctactcaggaggctgaggcagaagaatcgcttgaacccaggaggtggaggttgcagtgagccgagatcgcgccactgcactgcagcctgcgtgacagagcaaaaaaaaaatgtctccaaaaaaaaaaaaaaaaaaaaaaactccacccacaaaaatataaaggcccaacaccactggggatacgtttttaaaatgcagtgggggatatgaagacaattccaaagaaaaaagatttagtagcatgtattgagttattataacatcacagaaataagtatatagccttccaaagtgtctactatgaaaaggaaaatattcttttaaatctttaaattacaacataaaacatattaacttaataaacatttcttgaggggaaggaggtaatattcagaaatgccttccagaatgacttaccttactggaatctactttaataacagctgtaaagtgcgaagcagtcacatcataaccatacattctcttaaaaatccctctcccacaaatattcgttgacaaagtgtcctacaaagcacatattgtcttaattcaaacctgaaaataagacatctaaatttcgatgcaacagcagccagcaataaaatgactataacattagcttcacgttcaattgcatagaaatcaacggtacaccataaatttgtgttaataaccagaaaagttctgggtgacaggggactctgtaatgacagacaatgtatgcatgttttaggccttgttaaaaaaattatgttataccaacaactttttattagtggccatttctaaagagaggtcatataccttctttgtttagcaaaataatttaagactacattaatgaaatgcccttgatcttttgaatgttcatctttaggtaaattcagtattcaaattactatatgggatgtttcataactattagccttggctatcttactccacagacctgaattcctgtaaacatacctgtaagttaaagtaaacccaaggatctttcaaagtccaaaaattctagtcacgaggagcaaatatttaggaggaaataatagttccatcattatgggtctgtagacacaacagatacatgttctccatataaatatttaaaaaaaaatctccccacaagggattttttaaaacagtgcgcaaaatacctatagctttaagaattttaaaagtttatgtatattcctgcttgcacagtaaaattaataaacactatctagttttttgaagaaagaaagaaacgctaggtaaaaggaaaaacaagaaacaacctcggccaggtgcgggctcacacctgtaatcccagcactttgggaggccaagttgggcggatcacgaggtcaggagatcgagaccatcctggctaacacggtgaaaccccatctctactaaaaatacaaaaaattagccgggcgtggtggcgggcacctgtagtcccagctactcaggaggctgaggcaggagaatggcatgaacccgggaggcggagcttgcagtgagccgagatcgcaccactgcactccagcctgggcgacagagcaagactctgcctcaaaaaaaaaaaaaaaaaaaaaaaacaaagaaaagaaaagaaacaacctcatttcccccaatatatctaattaccggcaaaccaacattccttattttcttttatttgcaattcgatgaattccctaaaggtctggaaaaacttcagcatttctaattagactgtaatttttctaccagacaatcagacatagtttcacctttatacaacttcccatgtcctaaatgccaacatcctggcatgctccccgtccatcttccttctcttaacagcacctgttttgaaaaggtgaaaacatttagtctttcctagaattgtcctctgaaaatcaatcagttaaagatgagaggtctggatgcggtggttcgtgcctataatcccagcactttgggaggtgaaggtgggaggaacatatgaggttaggacttcgagaccagcctgaccaacatggtgaaaccctgtctctactaaaaatacagaaattagctgggcgtggcggtgtgcacctgtagtaccaactacttgggaggctgtagtcccaactacttgggaggctgagacaggagaatcactagaacccaggaggcggaggttacagtgagccgagatcacaccactgcactccaccctaagtaaaagagcgagactctgtctcaagaaaaaaaaaaaaagacaaaaaattcctaactgccacataaatagcaattatccaccccagggaatgcattccttaatgagaccatgcagacctcacatgtgcttaggcaggaatgaaaaaaccccagaatcctaggccacaagtttaaaacagtcaaataaggaccttcctatgtagattacaaattaaaaacaaaatggactcaagttagtttaggtagaaaaggtgtgtgtttactggcaaggtttggggaagctccctgtctctgggagggccggacacccaggctcaggcgggaacaagcagggcaaagctcagccaaggtcctgccacaccacaggctgaccgagtcactgcagccaccacggcctcccctcagtggacagtcccctcccatgcgcctgggctctggaccctgaatactgtcatgaggacaataccccatcaactggcctagctggccccaagagtcttcacaaacagaaccactctcctgagaaaataccagaatgggtggggctgattgtgctcagatcacaggcccaatctgatggccagaggtaggggaatgaggctgcagcccccgggcttcagcacaaggagtttgagtcccgcctcacatctgcctttgagtccctcaaaaaggaaggggacctggcacataaaaagataattctgccatggagggatgtggaaaataggattcggagggtcccttcctgttctaaaatactataaacaggccaggtgcagtggctcacacctgtaatctcagcactttgggaggccaaggcaggtggatcacttgaggtcaggagttcaagatcggcctggccaacacagtgaaaccccgcctctactaaaaatataaaaattagctgggcatggtggcgggtgcctataatcccagctcctcaggaggctgaggtaggagaatcgcttgagcctgggaggcagaggttgcagtgagccgagatcacgccacagcacaccagcctggacaacacagcaagactgtcaaaaaaaataaaaataaacaaaatactataaagagtcagatgaagatttaatgcctatcatcctaaacagaaaagaaaggtatgactcttactaattcaaataataaggaatgaatagcctatttcctcaatctattttcatagagtatgatctgatgaaagctattcattaaaacaaaccaaatagagtgtccttctgtcaactaggctcctactttatttatgtacttccagatccatttgtctaatttccacttgtgaaaagcaaatggaattgattttctgcaatgatactaaatacaacgctgttataatgttcagaacaggtaacaggaggggagcagggagtctgtaagagactgccaggtgcaggaataacaaacagacagatgtgatcaaagagcagcagttatcacagggtcagattttgactcaacatagctaattcctgggaacatttgaaggaatccaaccccggaacaagtttcacaacaaaacagtacctccaccaatggaggcagccactgctaggaagagagcaatgtgctgaatgtgttccccccaaattcatacattaaaaccctaatcccagtatgatggtatctggaggtagggtcttcataaggtaattaggtcataagggtggagccctcatcaatgggatcagtgccttcataaaaataggccagaaaactaggtaactctgtttacaccatgtaaggacacatgtaaaccagaaagaggacactcaccaaggattctaatctcaaacttccagcctccaggactgtgagacacaaatgtttgttgtttaagctacgctgtgtatgataatttgctacagcagctcaaactaagacacacagcatggaaagcatcactgggcaagtaggtaggctggctgggccacccttcaaaggtcctgtccaacgaggttttaaaaaaatgattttctagattctgaaacaaataaaagctgaaattaacaagacaaaacttcgaatttggacaaaaataacagacccaatataggataatgtagacctgagtcttgggggtttattcgatggactacctcacacaatctgcgattccactgtaagggcagtgtccggcacccaaaatgcttggaccatctgggggttctgagttcatctccaggtttcccattttgaaaagaacactgacacgtgaaagtattgagacaagggtgacaatgatgaagaggcaactgaaaaccccctcaagatggggatgatgacataagaaaagaaaagggatctagatttgtctgcttaggctgctataacaagacagaagactgagtggcttaagcaacagacatttttctcaaagttctgaaggctggaagtccaagagcatggtgccatctgggttggattctggtggcggccctcttactggcttggagacagccaccttcttgctcttgtcctcagatggtctttcctgtgtgtatacactctggtgtctcttcctcttcttggaagaacaccagtcctactggattaggggcccatccttatgaccccatttaaccttaactacctcctcaaatgccctacctccaaatacagtcagcacactatgggttagaacttgaacatgtgaattttagggagatacaagtcagttcataacaggactcaatcctaagtatatgaaaggccatatctgaaaaggataccaattggatctctattgctctagatggcagaattagacatgaagtgggagtattagagttggactagatgaagtttaagcttctttcattctgctgttattattaaactatagaatatgagttactaaggacttactatgaaccaaactttgtgctgatcaaatctttctgtccattctgaggtcgatactgctattatgaccatttactgttctttacaaatggaggcctgctcttgcacagtgtcacattgctgttaagtagcaggacaggatcccagaccatcacactccaaagccacccaatctagcttttaaccattgagtagcctacaatacaaatgataaaataactccatttaccaatagaaaatcacacagaagaaaacgaaaatactaataaccatattaccaccatcatttatttttctatgtaccagttctctccatagattgtcagagttaatcttcacttcaagccaaggtaggcattattatgcccatgttacagataaagaaaaaggctcaaaaagccttcctcaaactcagacagtgactaaaaacatgtggggaacaggattcaaaccaacctctgagttatttcaaatgcaaatcttttatgtcaattacaatgcactccaactaggctctgacttggctcaggccctgggatctgatagacttcaaaatcctctgaaactgacatttcccagggagggccacatagaatgcagacactgcctttaagagagaaaaagacgcaaggagagcaaattctatgaaatgaaatcaggctttccactaccaaatcctgtgccattcggcaagaactcagggagccccactacgcgctagtcccagggaacacacagagcaacaagcaaaaggaaaccccactcccctggaccctacattctagtgcagggagactgaaggaaccaacctccaatataacacatcaagtcaaaaaaaaaaaacaaaaaacagtgaaggggcaggggaacaggggtggagggttgagtgctgtttcagaatcaatgatcaggctgggcttgggtttaaactgctgcaaaggagcacagaagacctgctagctatacatccagcaggtcctgcagtcttgactacagcctggtatttccttgcttttcactggaggaaagggtggaccgcagtgctaattacaaacaggtcaaagggaaaaaaaaatacaaaatctttttccttgaccagaagggaagcagttaccatgcactgttgccatggcattggagaaagagaaaaagcgacattctaagtaccagagtatgaaaagaaacacaacagtgaggaaaggacaagaggctggcagaggtttcactccctgcagtgctgaggcctgctgggtggcaggtgggaagcaaagctttcaaaagggacaagggttggaagggtggggaagaggaaaagctcagagctattaaggaaaaggtctctgcctagtccccccgttttctacatccctaatatatcagggtacttaataaaatagttgcagaaaaataaaaataaaagaacaccaagtttctgaaatgcacagaataattctagataaacattttctgaaattttttttttttttttttttgccaatatgtaccataggcttcagccagctaacttactactgatgtgattctgtatggctcaggagtagaaggctataattggtgggatggaaggcatatgctaaaagtcacgcagaagagcgtttgtagccgatttctgccatttacaactatggaactagagataagtcacttggcttacccaagtccctcattctttatccataagattaaaatagaaagagtaaaagagataacaagtataaaggttgacttatgatagtaaattaataaacattcattcctttcctgcaacagttccagtatcttttgctctaataccatcagtgttgggaaggttcattccactgttagataactgattttacaaaattttaaaaattgcacatatagtcaaaatccttcttaaggcatgaacaggcaattcacaaaggaagaaatactaactgcaaataaacatatggaaaatgtctcaatgctaactcataaaaaaaaatacacattggccaagagttttaaaaataatattatgtaatatcattggttattgagaaataggcaccctgacataccctgatggtcaacctacttttatcattcttctagagagacagaaaatacgaatcaatgccttaaaaatgtatattcccttccatccaccatttacacttctaagaaatttccagagaaaataataaatggatgctcttgacagcattgtaatgaaaaactgtaagcaacaaaagtcccaccattcacataaactataatatcaccataaaatgtaaaatacagtcattaaaatgcttatactagaaagacatttgcaatgcataggagaattcaaaatctaatttctttattttacagagagcttataaaaattattaaaaataaaactatccaataaaaccacgaagacagttcacaaaaaaagaaatacaaatgcccaataaagatacattgtataaccttattattaaataaattacaaattacattgaaatactatttttcaccaattaaaaattgtagcatctgtgatacccaggactagaaaggtacagtgacacaggcaatttcatacccttgtggtaggagtatatgtggacattactaatgtttaccaataccaaggctttctccatctctgacccccttgaagctgggaatatgtagttagcagtagccaagttccaaaagggtccaaatcacagatttcacttactacatgacacaagaactatttaacctcattatgtcttaatgtcttcaaaggtaaaacagggataataacaataatctacctcatagggatattttgagaattcaagcatagtgcatggcacgcagtattactaataataatataaatcacagatcgtactatgtagcaggcactgttctatgcatttatccatagtagctgattttatcactcaataaacagtaccattagtatgacaatattgccgcattgcttgtaattgcaaatatctgaaaacaatcaaattgtccatcaatagttaaggggacagttaaaccaaagtatacaaaggacgtatatgtggctgttatagagaatgaggtagttctgtacatgctgatagagaaagattttttaaaaaatagagaaagactattgtttgactttgtttttaaagtctaacggtatgagtgtggttaagaaatggtgggtggatcatctgaggtcaggagttggagaccaggctggccaacatggtgaaaccccatttctactaaaaatacaaaaattagccaggtgtgctggtacatgcctgtaatcccagctacttgggaggctgaggcaggagaatcgcttgaacacagaaggcggaggttgcagtgagctgagactgcaccactgcactctagcctgggcaacagaacaacaccctatctcaaaaaaaaaaaaaaaaaaaaattgggttcttgagccagactatctgagctcatttcctactagctgtatggctttgggaattaaacacttagcctcagtatcctcatctgtaaaacaggattaataatagcaactacttctgatggcttttgtggggattaaaggagctaacagataaaacagtccccctggcatatagtcagcagccaactaatgttatttgctttattactaatcattttaacatgtcacatggactgagagataatgggcctttttattttctttatgcttatctgtatttaaaaagatagagagatttgtcttttgaaaatacaaaattgtattctgatatgagagatgtatagaacatgtcatatgagaaatgttagtaaaaaacagtatatacagcccaaagtcatttttattaaaatatatttaatgttatgtaaataagtgtacattaaaaatttagacatgcactaaaatattaccagtggtctctctgggagatggattataaattatttatattttcttctttttacttatccctattttctgattttcctaaaatcaacacacattacttatgcaataagattttaactgtcgtaatttatttccaagcatagaagtcacaaaggaagaggttaaactgagaggcttccaatgatgtaaccagagatggacttttgagcaaaaacaagtgaacaatacatgatttactgagaacccatacgttcgatatcatgacgctagcaaggaaaacagcaattgatcatcagtacctaagactgccattctccattgggccaggctcccacctgactttagggaggaatttgaaagccagaatctcgccccaggtaaatgcaataggagccaaagcaggtaacacagctcagagctgaagtttgctgaaaaggccagagggcactgcctgcaaggctaaaagcaacactgcacgtccacacgctgggtttcaacacttttttcacagcagcaaatccataacggactctgagtgaactgggaaagaataactaaaacattcaaaatacttccagaaaatcattttgcatgatgacttctcttactatgtccagctctgagtaagcaaggaaggtcacaggattttgttcagatttggaagtagaaagggaaacgtgaggttatactcaggaaatccttttgctaagattcaaaaaatctgaaaattaacaaattctaaaacatgcacctttcaatttgcccctcctctccttaacatctctccataacctgagatggctacatctatggttggactggactagaggcaataaacacagacacagtaacctcaacatggggtttacagcgcaggaatgaggaggagccagtggcaggtatagaatgttcccacacctcaaccactgccaggctccgcagctcactgatgcagcagacactgcttcagagcactgctttattggtaccacttctgagaagcagcaaagcagacatacgtctttctctatcatcttctctgtctctcaatccctctcaatgacaatgactcattctctctttcaacctctctcccttcctctctcctaccctctaccctcattcccacccccttatcactacactaaggccagcaagaagccacaaccacagaagagcttccaggcagcagtgaagcagttcagtctcaaagaaagccagacaggagtccagatgcctgtgttccttctggagttcgctatatgacctcactataatccctttaccactgtgggcttattttctcatctggaggacgaatgggtaagaagagacttctgaggtctttttcctgctttaaaattctgtgatttcacaataactgaatacagtcactaaacgggaaaccaccaagacactggggggcggccagcacatagccatctttgttgtatttttcattgcaggcttccaaaatgtctgttgccaagaagtatatccaactagaccctcggcccatgttttaatttttatacactgtaattaaaagcagaatgacttgctttcactttggattatgtaatttctttctattcataatgagcagctcttacatgatgccaagtgagttttctcttagggagcacattcttactcaaccagagaactgttggcatttggattaatagaatcaatagtatctttcattccaaaaccagaaattgctgttttgatatggtctgcccacagttcttccaaggaaaatatttttattattttactactaatatctccttacagcttatacatgagtgaagcatttatttttatattaaataaatcatgctctttaaaataaaaatgaatatattcttcttgttagagctcggagttgaggccagtgactggccaatgaactcacaagtgtagacagggtgttacgcaagggacaagtttttcactaacaccacaagagtctctggcccaatgagaggagtttaatagaaattcttgctacaactaaaagaaagaaaagaacaaataaaagaatatactctcctactgtaaaatctacttaagaaaaagtaggttatcaggtctttattgcagaaagtggtttttatttcttctctgctgtggaaacaaacctccaaatcattgaaaggtggaacagtatccttctacagaaatcagatttaatcttgacagaattaaataagaatcactcattatacactgatctatgttttggcaattatacactgatctatgttttagcagatattatggaaaactcaaaggtgtaacaggttctctgccctgcaaagagtttacaatctcatatggaaatcaaatgtacacacatgataaatgctacttaaagacctactgtctgccaaacactatggaaggcacgaggtatgtgagtgagactccacctctgccaaaaagttcctcacaagctggtgagaaagccagacctgagtaacccagacagtgctaatctcccaggatcacctccgctgcacttagagtgggaagtccagtggctttcctaagaatgtggtggcttccagggtagacagacagggaaggagatggaggtagcttatcttatggtcacctcttgtcatttctcatctcctggaggtattccctctctgtcaagtgaaagtagcacctagttgggttggttggttggttcgttggttggttggttggttgggttttatcagtctgacaatcttttatcttttaattggtacatttagaacatacacatttaatataattacaaatacattagggtttacatctaccatcttatttgtgctattcatctcatctattttatccttctctcctttcttgcctctttttgacttagttttgtttttatttttccctctctccctccacacacgctcaagtttagatgctatatgctgcttttgggctttcattatcctagaaattacaataaacatatccaactgatcaaagtgtaaagttaatcagttatttgacgcttctgcctgatcttaaaacacctgaatactatttacacccttcaccatccccactcctaattcggaacactgagtgcttccgccacagtgaacctctttcagttccctgaactcttttcacagcttctgatcgctggtcttcgcacttagctactcccccaactggaataccaccctcttctcctcacaccctcttcccaacctggctaaatcttttacacctctcaggtcctagtttcagagttatttgcaccctggctcccctgtccctgctcccctcccccgtgagtttccctttgttatgtctgtcttccctcctagacattaagttaaaacagtcaatgactgctgggcacctaggctgtaacataagggtccaccaggacactgctagccctcagcaccacataatggatactcaataaatatttgttgaatgaacagatgaatgaaatatagtggtttcaagacatgtaaaaatcaggaaagacgcaagaaaagtcacaggtcaccccccaacacacatacaaaaaaagtccactcattattgaagcagaaagactactatggtgatttaaagagtgcaggctccagtgccagactaaatgaattgaagcccagattctatcacttactagtgggtgaccttggataaggtactcaacatccctgtgtctttggaaaatagagataaccataaaacaaactcatcaggttgttataaggaacaagtaagctagcacttgaaaagtatttagaagacttcctgttaagattctgtatatacaggcatactctggagattgtgtgggttcaattccagaccacaacaatacagtgaatatcacaataaagcaaacatcacaataaagtgaatcactccagtgattcactgtgaatataaaagttgttgacactatactgcagtctattaactgtggaagagcattctgtctaaaaagaaaacaatgtcaatgtacacatcttgattaaaaaatactttattgctaaaaaaaatactgacaatcatctgaggcttcagtaagttgtaatctttttgctgatggaaggtctttcctcattactgatggctgctgactgatcagggtggtagctgctgaaggctgaggtggctgtggcaacttaaaaaataagacaaaaatgaagtttgtcacatcaatggtctcttaagacaaaagatttctctgtagcatacaatgttgtttgacagcatcttacccacagtagagcttctttcaaatctgaagtcaatcctctcaaaccctacactactttatcaactaagtttatggaatattctaaatcctttgttatcatctgaacaatgttcacagcatcttcaccaggagtaaatcccatctcaagaaaccactttgtttgttcattcataagaagctactcctcatccactaatggtgcatcctggaattgtagtaattcagtcatatcatcaggctccatttttaattctagttctcttgctatttccatcaaatctgtagctactttctccactgcagtcttgaactcacccctaaagttatccatgagggttggaatcaacttcttctaaactcctgttcatgttagtattttgatgtcctccaatgaatcacaaatgttcttaatggcatctagaatggtgaattcttttcagaaggctttcaattgactttgcccacatccatcagataaattactatctatagcagctacagacttatgaaatatatttcttaaataataagactcaaaagtcaaaattactccttgagtcattggttgcagaatgaatgctgagttaacaggcatgaaaacaacatacatctccttgtagatttacataagcgctcttgggtgactaggtgcatggctgaagagcagtgatattctgaaataaatattcttctaagcagcaggcctcaacagttggcttcaaatattcagtaaaccatgctgctaatagacgtcctgtcatacaggcttggtagttacatttatagagcacaagtagagtagatctagcataattctgaagggccctaggatttttagaatggtaaatgagcaatggcttcaacttcaagtcaccagctgcattagcccctaacaagagtcagcctgtcttttgaagctttgaagccaggcattgacttctctgtagctatgtaagttccagacggcatcttttcccaatagaaggctgttttgtctacattgaaactgtgatgtttagcatagcctcagtcatcaatggtcttagctagatcttctgaataacttgatgcagcttctacatgagcaattgctgcttcacctttatgttataaagatggcctccttccttaaaccttatgaaccaatgtctgctagcttccaatttttcttctgcagcttccttacctctacctctctcagccaagaattggaggcttgctctgaattaggttttgttttacgtgaatgttgtagtgatttgatcttccattcagatgactcagatttgctccatatcagcaataaggcttctgctttcttatctttcacatattcactgaagaagcactttgaatttccttccagaacttttcttttatatccacaacttggctaactgttggtgcaagagacctagcttttggcctggcttcaacacgcccttctcactaagcttaatcatttatttgatttcaagtgaaaaacatgcaactgttccttccacgtgaacacttagaggccattatatagttatgaattggattaatttcatattgttgtgtctcagggaatagcgggacaggggaaggaccagtcgtggagcagccaaaacatacgacaatttttaagttctccatcttacatggacacagttcttggtgtcccaaagcaattacaagagtaacatcaaaaatcactgactggtgcagtggctcatgcctgtaatcctaccattttgggacgctgaggcaagaggattgcttgagtccaggagctggagactagccagggcaacatagccagacgccgtctctacaaaaaaaaaaatgttttaaccggctggatatggtggcatgtgctgtagtcccagctactaaggaggctgagacaggaggatcatctgagcccaaaaaagttcaagattgcagtgaaatatgattgtgctaccatactccagcctgggcaacaaagtgagacactatctcattatttaaaaaaaaaaaaaaaaaatcactgatcgcagatcataacaataggtataataataataatgagaaagtttaaaatatcgcaagaattacaaaaaggtgacagagagacacaaagtgagcacagtgggaaaatgatgctgaaagacttgctccacacaaagttgccacaacccttcaattaaaataataataataataataataataatatctacaaagcacaataaaacaagctatgcctacatgtttacaatagagctgactctctagttgttaaaccacataactgaactacacaattctcaacagatccttacttaaagcccaggtattcatacattaaaatgatcctaacataatgtctttacattatggtacaaatttatagcccatgaagacaacatcactgcattaaaatatttgaaaacaatcaaccagaattattttaaaaagttaaacagtattaagtgcatacattaaaaataccaaaaaaatggggcagtaatacattttttaaagaatgctctcaaaaaatgttatcaaagaaactatttgagcatttgaaggaacaactttcagtttttaaaatgaggccacaatataattttgtgaattttgtagtcttaccaaattgtattataattccttaattgtagctacaaaaatgttgaggtttttaaattttttcacatttgaaattttccaaataataaaagtaaatattcactattatcccataagacagacaaaaaagatcatacttctgccaacctgactgtggggtagtacggccaagctgcagtgcacaaggcaaagaccttggaggctgtgaaggcagccagtttcccctcatagatccaccaacttaaccagctcaatgtcaccaggaaatggtcctaaccctgacccatcacgcttcgcttttttgttttggcggtggggggacagagtctcactctgttgcccaggctggagtacggtagcgtcatcttggatcactacaacctctgccctccaggttcaagcgattctcgtgtctcagtctccggagtagctgggattgcaggtgcccgccaccacacccggctaatttttatatttttagtggagatggggtttcgccatgttggccaggttggtctcgaattcctgagctcaaatgatctgcccgccttgacctcccaaagtgctgggattacaggcgtgagtcaccgcgcccggtcatcctttgcttttatagagtggagggctgccctgtctttacctggttctggaactgaaacactatacctcctgtaaaattatgagcctttggagtctcattaaaatgaacaaacacaagcacagaggtctgcatatagaatatctggggccctaaattccctaatacttaagaatacaatcactgtcctattgtgtttcttgcttatttatcctaataggaaggcaccaggaattccctagttaagagatgatataaaacatattttgaatgaaagctgcaataaagctacaaactatgatttggggtctttgcttaagtctgagatacttggggactttatcatgaaacattagtttacttgtcttttgtcaagagtaattgcctaaacttgaatagaaatatgagctttttcagttaaacatactcctaaaaatagcattttcttctgggatttgactactaaaagcaggcatttcaatgaagtcaatggcacttatcagtaaaaaatcattttttaagttgtaatgagatcttttctttctaaatattaaaatattagaatgatgtatttcattttcctagaagccaaataaatatttcctatttagtttggacattcatggatactttttttaatggatactttctaactctaaattaatagtattatattataattacattttattattatagtttgctgtcaatatcctacctcactttgttactcaaagttctatttaaagaccaagattacagttgtatctaaaattcctaggtcacaaaatgtagggtagcacagcagtagaaccttaaaatacacattggataatgatgtaacaaaacctcattaacttagattaattgtgcaaggtcaaaatgaatttaggagttttatcttaaaaagaaaataattttgatgctttcacatacagagaataactgaaattggattaacagtagaggtccctggagaaactgcattaatgaatagatataaatgactgtcattagaacttcagttatcaagttttcaaaggcacataaattgttttcgccccttggtgttaagtttttcacttgtttttgttagtgcttttattttgcctttactgtcaaatactgggtacctcatatgagttgcactgtgtttctgatttaattcccagaacacgcttgcaaggttggtattattaccccattttgtatccgaaagatacactcaaggatcagggaattcagtaaggtctctctggctttttctgcttcactacacattctcaggaagtccataagctctttcttgagataaaatggtctcagcaaaaaaaaaaaaaaagttcaatgtttgaaaaaaaaaatctcacaagcattttattaatggtgctgtatttccttatccggtcagcagatatattactatggctctttttgaagagttagacacttcacttatcgctgaatgcccctaaagtattctttaaacccaacgggctaacgtagccatttgcaaactgggtacaaaagagagtactccattaagggaagaccaagatgaggcagaacaaagagccagcagtgggcagataaggaacttcttcccacgcctaatccatgaggacttgaggaaaaaaatcaactcacttttctggacctcacacaccgtgggcctactttaacccatttatgcttagtgttccattaatggaacgctaagcttgtgggagttatgtatatcctactgctcaaggtcatcgccaaggtctgatcttttcacaaaaaaaatttgcaacctccggcacaaatgggttaatggtgccgtcacagggaggcgaacaacatactatgcataatagtgctttgcaaactatacctaataatttggtaaaacattttcactccacccttttgtttttaaaagatatacaacactcacggtattatttattatgttttagaagaaaattttttgaggtttagcttaaattttaaaactaccaggaaataaatgagatttattttagagaaatttattttcttttttatttttttttttatatatatttttttaagacggagtctcgcactttcgcccaggctagagtgcagtggcgcaatctcggctcactgcaagctctgccttccaggctcacgccattctcctgcctcagcctcccaagtagctggaactacaggcacccgccaccacgcctggctaattttttgtatttttagtagagatggggtttcactgtgttagccaagatggtcttgatctcctgacctcgtgatccacccgcctcggcctcccaaaaatctctgcctgtaatcccagtactttgaaaggacaaggcagaggatcatttgaagccaggagttcaagaccaccctgggcaacacagtgaaaccccatctctacagataatttttaaaagtcagccaggtgtggtggcacgtgctatagtcctagctacataggaggctgaggtgagagaatcacctgagcccaagaggcagcagtgagccgtgactgcatcactgcactccggcctaggcaacagagcaagaccctgtctcaaaaaaaaagaaaaagaaagaaaataataaatccgttttgcaaaatgagctgcaattacataatctaaatctgagtgtacacaaaaaatacaaaacaagggcctaggctttaagtttttcattctttcaacaaatatttacatagtacctaccataagccaagcaccatgctagcaatggggcaataacaccgaacaaaacaaagcccttaattgctagatatacttgaatcccttgcatttaatagtgcttggcacaaagtaagcaccaatgaatgttagaaaaaataaataaataaatacatatatatatatacacatgaataagttaggtgtataaaggagaccagaaagcagcctgtcactagaaaagctgcttgaattgaattctgaatacataaaacatgtgagtcctttgcaaagatttgactaaaagtgccctgataaatctgctccactagaatcgtgtagtaaagggaatgaaaggaaaagcacgaaagccctattcccaaactgcgaataagacactcctgcctctctgttatcttggaaataaaactgtaacagatgaaaatgagacaaacaaatctctaatttaaaaaataaataagcccgcaagtggaaaacctgcttttcatcaatcaaataaatcagggaaggcggcatttctaggccattgcccttgggtctaccacagcacttaggaaatggttttcctaattagtctaatcatcacttctgttctacatggttgtagctgactaattacccaactcaaaaatgctcacccaacccccaatgccaagctcctccagagctctatttccaatcacactacttaagccattgttcacaagaacattaatgacactatcacatgtttaaaaagtgttgatttgaaggtgtggaagagagtccccaaacttggggacttttttaccttagaaacttttaaggaacagaaatatgcaaataagagcagggaaaataactttggtttctgaaattctcttaaccattgttttacaagtctacagcaatggaaaaatgacatggaataaaaagcgtgtgtttgtccgggaatgtaagcgcttgccattttgccatgggggcttcaaagctgactgcaagccagggccgagcccaccatgtgactgtcactgtgttctaataaacagcagcctgcatggtcgggactccaggtaaagataaattgggttccgtaggtattcttttttcagacggcctctattcaattcctccagttttaaaattctcttatgaagaaataaatagcatgccagagatgacaaaggccatgaatgtaaaaacacaaggtagcggggctgagtctcaataaccagtgagcacctcctgtgcactggagctagacactgcacaatgttctagaagccattttttgttctaggacaatttttgaagtggtttcatttgccttattacctcagataggtgttgctgagtgactggacagatttcttctgctttcagtctcttttcatgggtccttcagaatgagttttggaaaggagaaaaacaaaaagagaccagaaggaactgagaagctcaaagcatcaaaggtgaataaatttggtatttggttttatttttaacatgtagaagagcatcaaagaaaaaagaaacacagattttagtcaggaaacaaaaattactcaaaatagcaagtataggttagatgatttaatgagaatactagggattagagaatgtcccagctctattaataaattatcttgggcaaatctccttagttctgaggtctgattacattttctatgctcatagtaccttcttcttacataacttgcatcatctcaaacaaatctaaaaaccaacaacaataaatatcctaacaaatggcactttttattcctttaagctgcctctcaagagccaccctgcaagtggggtttggatcaacttcccacctgacatatgcccaaccaagtggctattctaatgcctcagcactgtgctagaatcaatggtgaagaaagatgaaatgctgccttatctttgatctaagaagcttatagtctaggtggaaggatgtaacacaaagcaatatccaacaagagtgctacatctcaataaatggcaactccaagaatccccattaattgaggcagaaatctatgtcattcttcctttccttacaccccatcaatcatcaggttctgttgatctacacaaaatgtggctcatttatctttccacttgtctgtatcacagctgccaccatccctgtccaagaaatcttcatctctcacctacaaaagctcactgattaatccctctgcttcctttcttgccctcttcaatccgttcttcacagggcatccagagtgatttttttaaaaggctaaactgcttaaacctcttcagtgaccttccatgttcacaggataaaatccaggtaccctcctttagccgtaaggccctgcatggtctggccctagcttatctttgcaatcccatgccttcattcctaccgctccacccactcttcctcacttggctccgccgcctggccttctctcagttcttcatatgcgacgctcttttctgcccatggccattgtgcttgatattcctctgtacggcatatgcttcctctggccagcgccatttcatctgccagggacatctgctgttcctgcctggccagcaatccttctcctggtaacagaacaccttttttcttcttgaagtcacctttccctcattctcactccatgtggtttggcttaaactggcaacttctcctcatccccacccgggcaatctacaattaccaggatatttctggtaataaggaaacaaattttaattgaaattttttaaaacagaatattttaaagtaattacacaatcagaaaaggttgcctgtgcctatgaataccttctccagaggcctgtcctccacctacctttccatgatctgtaattcccctgatgatcacattcacgaacagatcaaccaagctgcagtgttacactaacagtcatgcagtgatctcagttttgccaaagtgctttcaaataactgaggagtgggggaagcaaaatcctgcctccaaagacagttaaaaggaccagatgatcctcttactctctcctattaacccagataaatttatcagctcagctagctgatacttcagccccaggaaagtgaaatacataactggggtagaagaagctgccggccagagcccaaggaaaatggggcaccagaaacacgggttttacatgggcccaattcagttttacatagggtctctccctcatcccgcgtggagattagcaagtcaaatttaatacttttgaccacacactggtttagatgcagtattgaactaagtcagactgaatttcagtggtaaaaatacacaaacaaaaaattactacagaagtgaacttggctacagagtcataaggtgatgtgtttactctctcggacaataatcttgggcaacagaaaacacacacacacacatacacacacacacacacacatacacacacacacacacacacacacacactcctgaaactccctggggaggtttcacagtacaccacttccctgggtgtcctgtggctagggtcaactgtgacctacaggcagggccttctctgactgcttttattgatagctgaaccaccagaattggtccaaaattggtaatacctgtggaatgagggagggagcatttgtcaatttgggacaccaccaaaacagccagtgacacttaaaaagactaattcatatacatgcaaaacaaacagtgttaattaagttagaggtgtcattttaatgcttgtttcaatgtcaggacctttagacaaaggcattaaagacattttgtctgagctctaaagtaaaaataaattaagggtctgaattagcaccctcaatctagcttcaaaacaacttttatccatgtttaaaatccccttgactaaattatcaaaataatggctgtgcttttattgaatatttacaatgcgccagacatggggctgagcatttcacaatcacgatttcccttaaatcattcaaccctcaaaaacactcctacgtaacaagttttaccctcattgtactaatgaagaaactgaggctcagaaaaactaatacgtttgcccaaaattgaatcatcagtgaaaatgtccatcaaacctaggtcggtcaaattccatcatgaattcataatggtttccaaaccagtctatggtagaacatttttaacaggtttataccctgtttttatgaaaaagtttcaggctttattgtgaattcagttatataactaataaggatcagacctcaaactgcagttaatcccaattgtgtgctgagatcaaaaggtatgtctcattaaatcaaggcaagtgggactatagcttgctgaaactcccagggaatccttttaatttgttagtgatacttaaaaaaaaaaaaaatcttctaatcttctgttcaaaacaatttgatggtttctcatctcacagtaaaagctaatgaccctacagttgtgcttggaagtgtctggcacacacctcaataaatacttgttgaatgaatggataaattcagagagccactatatcctttcttatcctttcaataaaaagatgcacaagtttccagggaaataaaacactaacaataaaagaagttgacgaactgaaagcttttctttaggaaaatcactgaactccaagttcagataagataaccaaaaaggactcaagtgtgccctaattagaacaaatgaacttcaggctacttcattttgttaactctgaagaagattcaacaggacctttaaaaatgtactagaaatgattcagtcttcttcatccatacattagaaaccataattttttttaagtagtggacttgaagtcaacacctgagtacttgtccaactttgtccttaattcattttctttctgtttcctcatttgcaaaatgacatgagactccaagatttctaaggtccgtctgagctctgatattgtattattaatcacaatctccaacttaattgacaaaacaactcaataattatttctatcataaaaataatctgattaaaggacgcaatttattacaaaatcagaaatagacacctcatccaaaggtcaattcctaatttcttgtataatccaaatcttccaaatgcaataatttaatccagaatatctagggagtgacatagcctctgtcccattaaaattggattaaaatccaaaataagaaaatcttgtaaatgtcttttctgtagtcctcagagaaagacagagtgagtgtactccttttgccagagtcagttttctctttagatcatattctttattccaaacacttactggtaactattacgtccactaagtcttctctccttaggttaaagatcacagttctatgacctctcctgacatcacatgattttttcaccactcacatacctgttcactgttaatgtccccctttaaatgtgacacccagaatccaataaaataattctcagagtctcattgtttcagagtatagtggcactgtttctggcacttatttattgatgaagataaaaccaacttgacagcattgctttaacagttaaataagataatgagtgtaaagtcttaacacaaggtttggcagatagtaacctctcaataaatggctactgctgctgtgattgctagtaacaataaattgtaatactatttcatgagtattagagcttatccccccaattcagttgtatgctttagctctcaataacactgaaagtttgccttatacattattagctgtttttccccacatcagggataggtagaaaaaatgctgaggctcaatttaaatcgaagatcaatcagaaaccaagataaagtaactctgaaattaagacttaaattaatggcaaacagggtatgatttatttaaggagttaatttatcctctgttttccagaacaatttgattatatcaaacaatttgattatatcaatataatttgattatatcaatcacttttttcagctaaagagcactatccctcaatcataccatttaaaagatgaagcaaatgtatgtatcactgacatgtgctgagaaggcagtctggcacagagttgaagggagtgagctctggaaccggactgactagagttccgtatcctagatctaccacttacccactgtgtgatctaaggcaaattacttaacctctctggtctcaggcttcacatctataaaatgtgagtcatgacaggacctatctaccttatgaggggcagtaaattatcctaaacaacattgctaaaaatgtattatctggaagtctcagacattttcaatttttataggtcctcatctctgttagccattgctgaagtcaatcaacatgtttgtattctctgcatatttataattatctattttctgaaacatccatttgtttttacggtagattttaagattactgtaaaaaaatccatctttattttaatacttaactaaccatatatgcctcactacagcaaatcatgtgttggtattaacagagaattatgagataaagaaacaaataaaactgtgcttgtcatacctgcagctgctctgcatatacacctgtgctgtctaatacgacagtcacatggggccatttagcacctgaaatatggcagatgtgctgtgagtgtaaaatataggccagatttctaagtacaagcaaagaatataaattatcactaagcttttgtcaaaatgacaatatttcggacacagtaggttaaataaaatatattacctacattacttccattgatttctttttacttttttttaatgtggctactagaaaatttaaacttacttgtgaaattctcatcatatttctattgaatagcacccatacagaagatcctaaaaagtatgcctcattaaaatcaggacaagatctatggtctaaagtatagcagaaactaaatgtagaatttacaggaattttcagagttcagataattaatttcaaactcttctccaacccccaccgagacatatccttttataggtactttttaagtaccgcgtccagtctagagccatctaagaagctttcattagccagtggtgactttcaaaggtttattctattttccacaagctgacaaaatttatttataacaaagccaaaggactgctttccagcaagggagctgtttactgaagagatttggccttagcaagtaggaatccagagaatttaaaagctgacaactgaactggcaaattggccccagtactgggactttgcctatagctccaaagcatgtactcagaggtctaggacaaatatggccttgggatgtgaatgagacccagaagtctggccttccctacataatgcaaatgaaacttggcctagtctcttcagctatctaattactaaacaaaactcccagacgccagtagcttttttgcaaagatcaataaaaatgcagagtggaaagcggagatactgaaatgctatcaacaaatgctacaacaatatattgttgttctgagtctgaaagttccagctggaaaaggcccaatgtggcaataatagagaagtagaggaagagcagaagcaaaatctaaggaggaaaaataaaccaggaagtattaccctaagatctctttctactcaaaatgaggtgcaccagtgtattagtctgttctcaggctgctattaaagacatgcccgggactcagtaatttctaaaggaaagaggtttaattgatgcacagctcagcttgactaggaaggcctcacaaccatggaggaaagcaaacggccaaaggcacatcttacatagtggcaggcaagagagcatgtgcaggggaactgccttttataaaaccatcagatctcgtgagacttattcaccatcaatagaaacagcagggaaaaacccacccccatgattcaattacctcccaccaggtccctcccatgacacgtggggattatgggagctacaactcaagaccagatttgggtggggacacagccaaaccatatcagccagcatccgtagcatcacctagtagcttgttaaacatgcagatctcaggccccactccagaactaaagaatcagaatcttcacttcaacaatgtccccaggtgatttccacagtaatgtctgggaaacaactggtcatccacacaagatccaaggacaccggtttctttaaattcttactcttattacccatctgttgccctgtggttgctacctggaaacatggggccttttgtgtttaatgcatgcaatgaacatttagttgactgaataaattcttggaaaatgtgatcttatacatgcttaatggacggtggggaatctgtgcctcagatgagagctaaagaagtcatcagttactgaaaacatgtggacagagtgtacctcagatccatgcatattgcataactattaacagaactagggactccctgaggttgaacaagatgagcagacacaattcatacccaaaagacatttatttaacggctcagacaaaagaaacagttttgatttttgatggagatgggaagataaggactttatgttgaaaaaaatcaacagcattaacaaaaattagtgtttacaacagtaagctagatgatttgggctgttttaaattacaccaaaggtcctttgggaattatgctactacatgaagcatcatatttttttcctctttactgtctttcccattggtattcgaacatgctgttacttcctgcatttttaaaacatctcttgacctcatttctccctgcagctacatttctcacattctctttacagcaaaaatctttgcaatatttttctacatttgatgtttccgtttctctacttctgcgctctcttacatacccactgatcaacatttggtccccactactacactataatcccagttggttatcaacctcagcaatgacatctccattgctaaatccctgggtcaaatctcatttgcccctcattttactttacttcccgggagaatctgactcatcttgcttgaagtggttttttcacatggctggcaagacctcgcactctcgattcccctcattcgctgctttccttcattctcctttattggtgccttctcatctcttcaatctcagtgtggaagcagcccaggttttggccctcaacttcttttcctttctattgacattcgctccctgtggatttcatccagtttgtatattctgacaactctcaaatgttcacctctaacccagccccttcctctgtaatccagataaatatatccacctgcctaccagacagctccctgactgagctcctgatcctttccaaaatcagcttctccctatctcagttaatgcacctccatccttcaagatgcacaggccagtattttgcaagtcacccatgctttctcccactcacatcccacattcagacaatgagaatatccttcccactcaaccttcaaaacataccatggtggtccaagccaccaccctcactcacctaggttacaacagcctcccaactggttttcctacttccactcttccccgcttcagtctattctcatgagacacagcagcagcatgtcctccaagaacatcagccagatcatgtcccatctttatttgaaactctctaacaggcttctctgctcactctcagtccaaaccgaagcccttgcaatagcaacaaggccccacaggacctggcgacggtgtccggtccgaccccactgctcactgtgctccagtcacactggtgtccctgttcctggaaggcaggaagtatggctctgcctcagggctctgcacctgctgtgccctcttcccggtgcacttaccttccttcttcaggtctttcctcatgcgtcacctcaacaaggtcatccttgaccacccatttgtaactgcaactccaccccctcccaaactccctcctctgccttatttttccctgaagggcttcacactgtcaacatactacacacacgcacatgcagacacaactcatacactgtctgtcttaccttgtaagaacaaggatttttttcttttttaatttttattttacttatttttttgtctgttttgttgaccactgtatccctggaacctaaaataatgcctgcctcataggagacactcaaacaccatctgttgaatgaatgtatgaatgaaggaaaagtgactgtgacacagaactgcatatgacctattacagtacgccctgtagccttttaaaagagttgtattttaaataagtcacttggtatgcacatatattcagataccgtggaaaagacaaagctgcgccaatttgataattaaattaaccacatacaaaatctggcccattgtaaagaaaaagctctcttaactgagagatgccctgaaacactccaagggtgctaggctttctcaaaaccctggaccttgcttcaccagagctcatttaaaagatgggtcctgggccgggtgcggtggctcacgcctgtaatcccagcactttgggaggccgaggcgggtggatcacaaggtcgggagattgagaccatcctggctaacacggtgaaaccccgtctctactaaaaatacgaaaaattagctgggtgtggtggcatgcacctgtagtcccagctactcaggaggctgaggcagaagaatcgcttgaacgcgggaggcggaggttgcagtgagccaagatcttgccactgcactccagcccgagcaacagagcgagattccatctccacaaaaacaaaaaacaaaaaaatgggtcccaaaaggtccaccctttctgcaagcaggtgaatgtagccaggctaatataatggactttgatttctttagatgaaagagaaattatgatgcaaagtacaaagcactttatagttatgatacataaattccaggtgtaacccattttcagtgaacttctggactcaagtacaagacagaaaaaaacgtttttgttatactttagtaactcactcactctgtagatggacatggtgggtcccatttttataaaccacatttcttaaaaacctaaaattatcttccaggtgaaaggaaagcaaaataatctcagcaaacattttagatgtagaaataaattattcaggagggaagcagctttgtacacaacataagtgatgtgaggcagacaaatgccaaaagtgattttagaacaaaatggaaagaatgtcctaatgtctctaccttataataacccttttcattccttagaccataacaggtttgcttttgtttctgaagttatgtatacagcagaaattcttaaccaccctccaattaaccaactccaggatgtctcacaaggtgacacaagttacccgggaagacatgctggctgatgcccattcatacctgctgctcacagctggtgacagataaagaaacagaatgaaaaaatcagtacctggcgctcaggctgtggtcttaagactacagcaagctcatgaaattctgcccacatgactgaggtggcgattaccaagaatcagttgtgtttgcacctgaatggatttgtcctggttgtacttgctaccaaaattatgtaacttaaatattatgtaaaacaaacataagcataatgagagagagaggtgtattgctaaatggaatgctttagaaagaagccattaaatggccacaagagaattctactgacaaattttttattttaaaattattttttactaaacagaggcaaaataaaactttacaaaatatttataaaatacaaatattcatgaaggaaatacctctgtatactaactacaccacccaagttttttaaaaaatggaattaccattatctttctaactcccctctgaatcttactgaacttccctctgaatcattacttaatgattttataaatgataatattttctcactgactaatcacagatacatttgttttagtaacgcttctaaaatttcggctttaattcctctaggcctgtcaagttcttttaaatctataaactatattatctttacataagctccagttttagaatatgatattgtattttattagactttctttcccaagcaggacacagcaatatgagaggccaacaactgatatacaagccacaccgagaaggtaggaagaattgcacccaaaatgaaaaaatatgacttggcacagtgactcacacctgtaatcccagcactttgggaggccaaggtgagaggatcacttcaagccagtggtttgagaccagcctgggcaagatggtgggaccccatccctacaaaaagttaaaatacaaaaattagccaggcatgttagtgtgtgcctgtggtcccagctacttgggaggctgaggtgggaggataacttgagcccaggagttcgaggctgcagtgagctagaatcatgcccctgcattccggccttgctgacagagcaaggctctgtctgaaaaaaaaaaaagagagagaaaaaaaacctgatacaatcaaaagaatgaatgaaacagatctctgagactgctacatcacacccggtgaacacagcctaagcctttatctacttctatcagaagtctctgccagaagggaaagagctgggtgaggaaatccatagtaacacattactcttatcttttatgtcctagattgccatttgcaagagagctattaatgaaagtcacacacctgaagctctaaaagcagcccagggaatggggaaaattccctgtctccaaaacaggagatgaagccactgtgaagccaatagcaaaaaagtgatcaggccagaaatcctgctgactcaggaaattctattctgccgttagacgaagctaaatatcagagcacctactctgccgtatattcttaatagggttcctgtacttagctatgtaacagcctatggggtttaactcattcgctaaagaaacatattgaatgaggaccctgggccaaagcaccacatatagtcgtccatcggtaaagtggggcataagtggggattggtcatagatttggggattcaaaggtgctcaaatctcttatacaaagtgatgtaatgagtaagaaggaactaagcgcacacattctctgagcacctgccacgcgcaaacacagtgctaaatgcttccacatgtattatctttttaaaatgacttttttttttagataagatcttgctctgtcacccagactggaatgcagtgatgtgatcacaactcactgcagccttgacctcctaggctcaagcaatcctccctcctcagtcttccaggtagctgggactacaggctcgcaccatcacatctggctaaattttttcttttttgtagaggtggggtctcactatgttgcccaggcccgtagactttatttattagagtagttctaggttcacagtaaaattaagctgaaggtgaggaaattttcgatacacctcctgcccccaacacatgcacagtttcccccattattatcaacccccaccagagcggtacatttgttgcagtcaatgcacctacactgacacactgatcttatttagaccttagttccagcgtctctggaagagtggcagttttctcattggctgaccctattgcctggtctcgctgctcggtgcaaaggcctttagaaattctctgctttgactgactggctaacaagtggagatttgtacccgaagcatcgaatctgtataggaatcaagcacatggaaaaatctttgattcctccagtgtcttggatctcaaggaaagctccagcctcagccttggtggaggcagcagccccgggctcagagaaggaaggtattcagatgacaggattcagacatctcaggatgaccaaagagtatccaaccattcaccaaggagcagaagcttccctatcactgacagacagtacttcctgcggtgtccccagcatcccccagaaactgtggacaaggcacaagaagaagtctgaatatgtgaaagccagcaacagcgcctttgaggccgactaacggtgaccctccccgggtaccctgcactggctgaggttgactagacaaggggagaagggccaggactggagctgagccacactcatttctgctagcagcttggtgcaaacatatcatcctctctcactaactgatcaccctgccttaggacacagaaaaggaacatcccttgaaggcaaaatgaaactgttccttcttagaactgctaaagctgttggccagaaagtgactttgagaggtcataaagtttatatctctatcttcaagcaaaatcacacctacatggaactttcccagcctaaagacctccaaggaaggaaggcgacaactcccccgtcttccttgtgagttgctggtgttctagggtgtgtaactttctggtcttactgtaagagcttgaccctgaggcacttataaacacatggttcttaccgttcctattatcgcatttatttcaccttgatgaggtatactttttaaggaacaagcatatatcaacttagtagttctagtatctactgaagagtaccatcaagattgattgtgatggtcatttggcatgactgcatgaattctttattcttttatgtgcagtttttctatagaaaaacactgaaagttaaaagttgaaaaaaataaaaccatgtagcatttgcacataacatatttacatcttcccatatactttaagtcatctctaggtttcgtataatacctaatacaatgtaaatgctatgtaaatagttgttatactacatgaataaataatgacaagaaacagatgtccatacatgttcagacacaacattcttccacatattttgatctgaggttgattgaatgcatgatgcagaacccatagaaacagagagctaagtgtattagaatttttctcctggcttccataaagcacacctgtaggcaatcacagtctagggtacaagaaagtccagttttgccgtttaataggtgtgtgactttaagaagggcaataataattccagttcccactcagctaagtataacctaccatccaggtcacatttactgcctacttactgtctttccaaaactgtctaagccccttctaaccactaaatgttggtgaggtattccatgaggtaatgatgcagtgaggcacagagatgttaaaataacttgcccaaggtgacacagatagaagcaaatcagactatccaattcaagggcacactccaaccactatgctgcactgcctctggtaacacagaatatcctttaagagaagaacagggccaagtacaatggcacccctgtagttccagctatttgggaggctgagggaggaggattgtttgaggccaggagttgaaggctgcagtgagctatgatggcgcctgggagtagtcactacactccagcctgggcaactgagcaagaccccgtctttaaaaaacaaaaataaagaggtcaggtaagtgagtctccccctcccaacttcacacttctcactctcctgaaattcttcaggagatcctaatcaaccacataaaacaagcaaagtgtagagattatgtaaaatgtttatttttctttccatgcccttttctccccattgagtttcatggagatctgtgtgactatgggaggcctccagagattcagcaatggtaagaaaatatgagcacattttaaaagaggagggaagaaggagggaggattcctcccaagagagtggtggcaactttacaacttgaaaatgtctgtgagcctggcttaaatttttatgacacatctctaccacactggcagggggtggggggttggggacttgggttgtcttggatcaagacccagtgctgaggtaagcaatgtagccagactggcttgatcagctccttgtaatctccctggcgagggatgtttgtcaactggagaccacacccactaaagagaactaattaggttctaggggcaaccactaaggtcatcattattaccaggtgagatcagtttcccaaacattccgatcttaagacttgcatggggtgattaggaagactgctccttcagaaccactgtaccagaatcttcaggcagccctagaaatctgaaaccaggtaattcttgacagacaagtttgggaaacactatttagatcatgacattacagtatctaaaaagatcaagaagggtcttctaggtagggtgtcctcctttcaagcaattctctgtctaatccaggaggagaagactattttctatacataaaagtctccagagaactggcttccaaaatttcctttcagtatacataagagtctcaagtctgcagagctttgtggtccctctcaaatagctcaggcaaaggttaaatctccatccttcttccaaccagatatttaaaaaacaatatttgttacacaagtcatcatactgaaagttttgttaactcactttggaaaatacgtgagggcctagaactgtgctaagccctctggtgctctgtttaagataaagaacttcacttatttcaaaggtcaggaagaagaaacagaaaagacaacccacagaatgagagaagctatttgcaaagcatatatctgataggagacttcaacccagaatataaaaacaatgcttaaaatgtaagagtaaatagacaaataatataatttaaaaacggtcaaaggatctgaatagacacttctccaaagaaaatatacagatggccaatgatatggtttggctttgtccccacccaaaactcatcttgaatcggaactcccacaattcccatgtgtcgtgtgaggaagccggtggaaggtaattgaattaccggggtgagtctttccaatgctgttctcttgattgtaataagtctcaagagatctgatggctttaaaaatgggagtttgcccacacaagctgtctctttgcctgctgccatacatgtaagacatgacttgatccttcttgccttccaccatgattgtgaggcctccccagccatgtggaactgtaattccattaaacctctttcttttgcaaattgcccagtctcaggaacgtctttatcagcagtgtgaaaatggacgaatacgagccaataagcacgtgaaaatatattcatcatcattagtcattagagaaacgaaaagcaaaaccacaatgagataccacctcacacccactagaatggctacaaaacttgtatgcttgtgttcagaatggcattattcctaactgtcaaaagtggaaacaacccatcaactgatgaacggataaataaaatgtgacccatctagtcaatggcatactattcagcaataacaaggaatgaagtactaacacatgctacttcatggatgagcactgaaaacatgaggaaaaagccagctacaaaaggccacattttgtattgtttcatttacatgatatgtgcagaacagcaaaatccagactcagaaaatagattagtggttgcctgtgatgagggataggagcaatggggagaggtggcaactcatgggtctggaatttttggggtttttttgttttcttttgagacagggtctcattctgtcactcagactagagcacagcgatgcaatcacgacacactgcatgcagcctcaacctcctgggctcaagcaatcctcctgcctcagcctcctgagtggctgcgattacaggcacacatcaccatgctcagctaatttttaaatttttttgctattaaaggggtctcactctatgttgcccagactggtctcaaactcctgagctcaagagatcctcctaccttggcttcccaaagtgctgagattacaggtgtgagccactgtgcctggcctgggctgtttttgaagtgatgaatatgctctaaaattgactatggtgatgggtgcacaactccatgaacatactaaaaatcaatgagtgtacactttaaatgggtgaatcgtatagtatgtgaatatctcaataaagttgtttaaaaaaaggatcccatttaatctccatgagcctcaatttcaccctctgaaaatggagacaccacctacctttcaatactataaaggatatataggccaggtgcggtggctcccagcactctgggaggccgaggcaggcgaatcatgacgtcaagagattcagatcatcctgggccaaaatggtgaaacccgtctctattaaaaatacaaaaattagctgggtgtggtggcacgtgcctgtaatctcagctactcgggaggtggagggaggagaatcacttgaacccgggaggcgggggttgcagtgagccgagatcacgccattgcacccccggcctgggtgacaagagcgaaactccatctcaaaaaaaaaaaaaaaaaaagaatatataaatacatacagatgcatgcatgtacacactcacacatactatgtttcacatagtacctagcccataataaatactaaatagatgtcattctttctcctcttcctatccccacgcttttgtattgttatgccttgatactgtggttccaccacaaattacaaaactcaaaattaaaatgtatttcaacagaggtctaaccatgagaatttcacactgctatcctcaagactactcctacatggctaactctgaagaaatcctggagcctgcgaatgtgactgtctaccttccagacttgtcactacagagtatttggggataaagagtaagacctttttcctctgttccactgccttattagaatgttccttatttctaaccactggacacgggcaccttcacttacctatctttaaaactcagcacaatccttgccaatacagatgctattcagacatttttcctgtcaatttcatctacaatgaaaatcaactgggcctccaagacagctctgcaggtgtccccaaaacaccttagctttgatatatagcactgcccacctgattattcactgtgatactaggcagattcaaagagggctagaaattagggaaccacctacagcttgcaacaaaaagtcaactgcagccagctgggcccagtggctcacacctgtaatcccagcaatttgggaggctgagggggacagatcacctgaggtcaggagtttgagaccagcctggctaacatggcgaaaccccgtatctactaaaaatacgaaacagccaggcatgattggtgcacacctgcagtcccagctcctctggaggctgaggcaggagaatcgcttgagcccgaggcagaggttgcagtgagccgagatcttgccactgcactccagccttggcgacagagtgagaccctgtctcaaaaaaaataaatagagagagagtgagaaatgacagcccaggacagataatgccatctattaaaaaagcacttttgctgtaaagttgccctaatatagtagttactagcggcctgaagctatttaaattatcgaaattaaataaaatttaaaattcagttcttaaatctcactagccacatttcacatgcttagcagccacatgtagctactgactatcttattggacagggcaaatatgggacatttccatcatagtaaaagctctattgaacaatgctgattcaggcagtaactgcatcgattctataaagttcacaagttctgagttcttaggtactgtagtttcagtatttgctgattgtgaagtttgactcgcactagtacgatccaagtgaggtttgcctaggtcagtggacaaggttttttggagtgtacactgagctcagcacgaggtaagcacttaatatttgctgaatgcttaaatcaacagcataataatatctgtacttcagactctgccttgatactttcagatattagctcatggaaagcaatggttaatttttcttcaagggagattttttatttttatttttatttttatttttgagagggagtctcgctctgttgcctggctggagtgcaatggcacaatctctgctcactgcaacctccgcctcctgggttcaagtgattctcctgcctcagcttcccaagtagctgggattacaggcacctgccaccatgcccagctaatttttgtatttttagtaaaaacaaggcttcaccatgacagccaggctggtctcaactccgctgacctcaggcgatccacccgcctcgggctcccaaagtgctgggattacaggcgtgagccatggcgcccggccaagggagatttttatagggagatataagcatcagcgggtggggaaggtggctgacagaccttttgtagccactagaaatgaatcggcgaaacataaaaatctgcccaaaagtaactttgctattcaaacaaagtttcagatgcaagaaatatcttgcctcttcaaacactcactacttgcaccttgtagggacatgaaggcagagtcagaggagacactctggaagatcacaaagcctgctgtcaatttccaagcatttttccaatataacttcgccagaaaataacacagtcacgaagacagcagccatctaatggcatcgtctgtgccatcactcttatacctaaatttccactctcctagtgtcctatgactcaatcaaaactgtgcctatcaaataacttcttgaaagtacaagtttttgaaaatctacattcaaaaaagcatgtaagtttccatatacagagaaaagcagttccactggcccttaaccagtaatctcctagaggccaaacaaaagaagctacagctgcttctattaaaattttctacttctcttgtccacagaccaaacaggcataagaaaaccaagctgctcgatttctataattcactttttcttagcaaaggtctgagaacagaaggccagggaaacagggagcagctgccgcctggtcttatgaatgccctcggctcattccccatcctcctcctcattgtttcaagctccttttcttaacaatctctaagccccagctcatgggaagaaataacaaggaaaagcagccttcactgtgtcaacaccctctgtggttgaagcatctagatcacttctctgaggtgatgcaattagaaattaaattagaaattaaaaagaaattaaaatacattccattttaatttgttaatctgctttattgtgaattccaattaatgacacataactacgtggaactccttacatgtggtcctacagagatccttttagacaccccaggggttttgttgttgttgtttaattacaccatttctatctcttgagccaaacaacaaatctggtcccactattaagccaacaaatgtataatggtcggtgatgaattagtcatccaatattcagattccaagactcgaataatctaaatattagagccaaagagctcagtttctgcaacacgcaatgctaactttgagacataaaaacagaatggtggttaagaaaattggatgacctgagtttaaagtctcagctctgccacttactcactgtgggatcttgagcaggttccttaacctctcctgacttcagaatggaaataatgacactactgacctcatgggttgtcatggggaataagggagacaacccaagtaagaactcaataaacattagctgtgattgtaaaaacgccccatgccaggaaaatatcactcgaaataagcgttttccaaaagttaggacttggccgggcctggtggctcatgcctgtaattccagcactttgggaggccaaggaaggcagatcacctgagctcaggagtttgagaccagcctgggcaacacgatgaaaccccgtctatactaaaaatacaaaaattaagctgggcgcagtggcgtgtacctgtggtcccagccactcgggaggctgagacaggagaattgcttgagtctgagaggcaggggttgcagtgagctgagatcgcaccattgcactccagcctgggtgacagagtgagatcttgtgtcaacaacaacaacagaaaaatcaggacttaacaagaaacttagaaaatgctgctttctcagaagacccgtgtgaaaataccatgtaagaaaagaacaccagcttaggtcaaaatgttaattttcccagttatcctaaatccctaactccaataataatcttttaaaaatatccttcaacatgtataaattattctgattcatctcactgatgtacactcagaggaaagggaatttcaaaccagatggctcaggagtgagtggtcctcaagtaagcctcaaggagtgagtggtctgccatggccgcagcctgacatgcaggaaggggagaagagcgggcggatccctcacaccaccggtgtcaccaagagagaaaatgctctgccacctctgtgccctgatgtgtcaacaaagtccctccccactaggcaccaactgggcccaagtttgttgaccttctgggcgcagtgaaaaacctttcttttggtagagcaaacaagcactgcagggacatgcactgtttttatataaataagatagcacacgcaaagattcattattaatgttgagttatgccttattttcaaatgaggcatggacatttggtaatttggatttaagaataacttgttaactatatgctgcaaattatcctttttctccattgtaaattgcaacagccactacaacactacttaatttggagcttgtgaaaaatgtccttgaaagatggtcaacgtaactcagaaacactctttgaaaaaataatgccaccacttaaattctttccagcaaatccctgagtctgcatacaatatcacaaacaacacaagctgtcaagatatgggcactccgaacaaatgctctggagaatttcacatggatcctgtactctcctaaatgaaagccaggctggtttaactgtaaaagaactaggaagaactgagaggcaatattcaaagtgaaaacacttccactcttagcaaagggaagccaaggacctctgtgcttggcccagacggtccgggaagaacccctaaatggtgagaatcacaacagcagtaattcaaggtcacactagatccccagcctcctataagcctgattcacatactaaactccacagactttggtcaccagattattttttacagtctgacccaacttcaatcatgtctgaattcctttccaaaaattggaaacgatcactatccataactcacctcccaatccaacccaaacccaaagacactcttttcataatgtccaaatgacattaccccatgtaaacctcaaacaaaccagtctttaagccaaagcagatacacattttaatattcacatggttttgcctcagcatctcttaaccaagactgcaattaacctatcaccacactggtgtcttagtttatgaataatgcatgacaaatcacacctgaatttctataaaagaaaaaaaatcacctccaaaagtagtagtaccatggacatgttttttcaatgtaatgccacgctaaattccactcaaataattttccatcagggctggcaaacaaatatgtaaatatcaaggttttagaaagagggcagagccattgactgaaagtacctttaaatttttctttttcaatgagctacttccatcttactttatttttttatttccaaattcccaagatttactagcctgtaagaatttccaaggttactcaattttttaaattactagtatctgattaaaagcagaattgaattgcttaagtgcaatgtacataataaggtatatgttattctttggtcacaaatgaacagtgtcaacaaaactttctttaaagaaaacacacattaagattggcaaatcaagcttcttatgctcgcatttaaaaaaaaaaaaacaacaacaacattcaaccacggaatttggccgtaataaggttattttagctttgtagctctaatcactctcccacattcaatggtcaggataagagtgctgatccattcacagaacacacaaacagatatttagaatgtgaaattaagagtacatcactgaataagtaatgcataaaacgtgtctaggcatggaaatatcaaatggtagggctagaaggctctgaaagagcatctacctaatcccctcaccctaccaggaaactgtagcgacagaagttaaataatttgcccaagacggtggcaaaaactcacccagtcagtggcaaagcctctaagctaggtgtcctacctacagatccaagtccctttcttgataccactctactccttttagtacaaaaagcttctattaatgaaatatcttacaagacaaatcacttgtggatggatataaaaaggttgtggaaggacatccagccagccactaaaaactggttgaaaaggtgctaatttattttgcatttgcttaactggtgatgttgagcatgttgcacttttaactgctgaagaggaatttcatgactttttgaaaagaaaacctcttggtttgtaaatactctcagaaaagaaaggatcatttcttggaaaagggtagaaagtgaattccctttcctttagcaggggacatcctttccctcacatctcacaaaaatccaatcaacccctccctttcaaggtccagcataactgccagctcctctctgagaacttccaagcccggaggccagaagcttcctctgagatcctccatggtagcctacgcataagtctctcccaggcaagctctcaagcacgcttcttgaaagcagaaatcctatcctacttacctagctaccgggctttgcaaaatcctttgcacatactcaattacaacgaacgcattgaggcatttgttgccagaatcccacttacagtaattttccagatctccgtcttccctacaccaacacctggacccactcaagagttattctggagcggaaatcctggatcccgctatcgggagaaccagtgtctagaaaatgaaatcgtggtgcccattccatcctctgcctagtgggcgtttaacatcctttgacatcgaggggaatggcaaaacgaaacatttattatttaggtcaccaacaacattctaaacccacgtcctctaatcggtgttaatgtgtttaaaaaaaaaattcagaacatcattcgccagaacggaaagctgaaaacggcggataaagttaaatgcatgtaaaacagaatgacttaaacatctgtaaaagctcctgggaattgcaccgaataatcttcccttgtccgtttgctcgctcaattcaagtttgtttagtttagtctttttttctttctttctgacagaaacgtgatagtccctaaatacaagctgaccgggcaaagaaagatcggcatacgaggtcctctttcatgttgccttcttttgatagcttttctccaaagtctgaggttttcaaagccgaggtatgaactaaaacccctaaaccttaacaccacaaagttgaccctgctgggctcctaaaaaacacaaagcaagcaagcgcgaagagaaaaatcgcaccctgcacctatccagacagcacaaacccaggtggccccgggatcctgggggacagagcggcgacaaagcaacacaaaccccacgtcgaacagcggcgccgcgtgcgcaccccgcgcccgcgccccggccccggagctcaccgctgcgctccttccttccatcttccatcgccagcccggccgcgcgccgaaaccgccgccgggcgctccggggccgcagcctcagggcgcgagtgccggcggccagcgccgcgtgctctttgtt

SEQ ID NO: 748 - DNA, 629678 bp, Homo sapiens
catttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcaggtagggcagctttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaagagaccgtgtttacagtcaccagcaggctgcgtaaagaagtggcccagtgagacagggaaagtgacccagaaaatttagttttgttcagaatgaaagctgctgtatttcatttttgtttcttaatttgacggagtaggaacgttattttccttctctgtcattgagaccagtagcatttctatgttacaaactgaagatatttggggtctcgtcggcttgggattatcaatgcttgggaggtgagttctgatcaatacctttaacaaccccaaagaaaaacgcaaaaataatcaagtttaggtaaaacttccactggactttctttccagggagggtgagagatggaagaactgggcttgtaagtatcaaaatggagttagagaatgagctacaagtttgtgtgtgtatggtctgtcaaaaagtgttaagactgaaaggaaactgttaggtttagttaaatgtgttgacaacacggctcttacatatcaattttcataggcaaataggtaattacatagagtgggaactgggactatggtgggaaactttctgtaagatgtatattctttattcttaatttatcactttttcaatgggtgggactactctgtgaaggaaagtagagggctgagggacatttggtgagactcttgagagagaaacctttgcaagccaaatctcgcatgctatagatgataaattctaagttctttgatattgtaccactcttaagctaaattgtcctgtaaatatgatctcatgcaccataaactatatatatgtagagagagtctattcccaataactcatcctttcctgaaagagtctgcaagttctataaatgtcagctgttgggaggtattgtgatgaaggagagaggccaccagtgtttccttttatatatttattctggcagatcttaactttacttctgattttctttaaggaatttcagttaacattcactgaatttatattgctgagagtttcagtaaaacaagactagattttctttgaagcaataaattcatcttatcaagtgaaacattatgacaatgcttttgtggcagaaatgtttatttaaatgagtccattttaattatttatttatttttgacttgcagaataagatctgcaacatagatgtttttgaagtaagtagacgtttcttgagaaagaaaaataaatttaggttactgtggacaatttgccagtaattttggatgtctctttgtctacagggacataattttgtgtgaaagtagaatcattccatttcttatgtctctcatcttctcccatgcattttatcccctgaactcctaagactttgccaggaattgctgaacattctgtttcgtgccaggggttaaatatcaggggatggaataaggagctgtgtgtcacataaacatttttcaaaaggatgctgtcagagatctcaataccgggattaatttttcctttagctttgcagttagcttgtcttaattggtattgctctgaacctaggaatgcatttaacctcttcattttcagtttccagctggaaggaatatatttaccaaatttcatcttctttgtaacatatggcatgatataaataattactatacacacactatcctgctgtaaggaaagaaatagaattacaaaatcaactttcgtgttgagtgatatggatataatatttcaaaaaacaattttaacttttcccctgattccaaaagtaatatttagctattgaaacagttcaggaaaatacaaagaaaaaaataaaggttatccataatctgctagggagagggagccactgttaacatatctttaactgtatattcttccaaatattattctagtcaattatttctacccagtccccctcccccacacatttttataaatataaaatatagcttggaaatataacttggaaatgtgttaaaggcttgggaatttactgcttgtttacagaatgattttgatcagatattagtttttactggtggtccttattttcaaaaagagtaggttctttctttttctgttctttgaaaacaagtgtttgcactttgggctggtaatgcttggggcttccttttgaatttagggattaaagcatcagaaaagaagtagaaaggtcattggccattgtgggtgggagacctgagttctggttgcagttactccaacttctcctgtggcctctgggcctctgtttccctaaagggcaaaaggtacttttagatttaactaattaagctaatgacgtatttattgctttgacatgagaatgatctttgaagagggcttattcaaacacagaaacacctgggggtcatcctgggagtctctgattgattctgtctgagatggggcccgagaaggtacatatctaacaagtccctggatgatgctgactgctggtttggtgacagtgaaaactagagggttaagtgtactagggttctcttagagggacagaactaataggatatatatatatatatatatatatatgtacatatatatcatatatacatatatgctatatatatgctatacatgatatatatacatatgatatatgtacatataccatatatctataaaggggagtttattaagtattaacttacatggtcccaaggtcccacaataggctggctgtaagctgaggagcaaggagagccagtccaagtctcaaaactaaagaaattggagtcagatgtttgagggcaggaagcatccagcatgggagaaagatgtagggtgggaggctaggctcatttctccttttcatgtttttctgcctcctttatattcgctggaagctgattaggttgtgcccaccagattaagggtggatctgccttccacagcccactgacacaaatgtttaatctcttttgggcaacacccacacggacacacccaggatcaatactctgtatctctcaatgcaatcaaggtgacactcagtattaaccatcaaaagcccaccccttgtcaacttgaacccatacatatctcctgagatcatacataatcttcaaataaagacaataatgaggtcaaaattgtgcataacataatacaactatcctttgtacaaccagaaatgcaccaatccccaatgcaaatactattacataaagttaacaatacttacatgctgttgtgaagtcaataaatcttatgtcacatgataaaggaaaaggaaatgaagatattttcttagtatgagtgtatatatacacaaacatgtttttaacaaaagaaggaggaaatactcttgacaattacagtctgtttctgcagctggtcacatggtcgtagctggtattgatgactaccttcttctacccattcagtattccttttgcctacagcaagcacctcagcaggttcttttccctggtggagtgacccaaacctttattcctgaaggatctggaccatttgtagtcccgcctggattgggctgttgtagtttcctgttgaccttaatcacagggcatggtaatactgagagatgccctaatggatttcctgtgttccatatgtagtcttccttacctctgctgtggagtagtagactgatttcctcttgatagtccaggtcaatcatgccagccaacacagtaattttcttcttagcctgttgactgaaagataggagtatcccaaactgtccaggtggcaatcttaacttccagtttaatggaatcgttgtgtttcctggtggcagtgttcctccctctggaactaagatctctaggccagcagaaggtaatgtcttgggaacaggaagcaaaaattttgctagtggatcagtaggggtgatggtgagtggtgccacttccacttccgccccttgattcctggacctgtgaatcctggctataggagaaacagtaccatatattggatgctgattcagagcatacacggccctctggagaactctgccccagccctgcaaagtattgtcacctagttggcattgtaattgtgacttcgaaaggccattccaccattctatcaatataactgcttcaggatgatggggagcatggtaagaccagtgaattccatgagcatgaacccactgccacacttctttggccataaagtgagtgccttggtcagagacaatgctgcatggaataccacgatggtggataaggcattccgtgagtccacagatggtagtcttggcagaagcattgtgtgcaggataggcaaacccatatccggagtaaatgtctattccagtgaggacaaacctctgccctttccatgatggaagaagtccagtataatcaacctgccaccaggtagctggctgatcaccctgagggatagtgccatatggaggggtcagtgttggtctctgctgctggcaatttgggcactcagcagtgatcatagccaggtcagccttggtgagtggaagtccgtgttgctgagcccatgcataacctccatccctgccaccatggccactttgttcatgggcccattgggtggtgacgggtggctggggaaagaggctgagtggtgtccacagaacaggtcatcctattcacctgattattaaactcctcctctgctgaggtcacccgttggtgagcacttacatgggatacagatagcttcacagtttttgaccactcagaaaggtccatccacataactttttcccaaatttctttgtcaccaatttttcaatcatgcttcttccaagtccctgaccatccagccaagccattggctacagcccatgaattgatatataatcgcatattgggccatttctccttccatgcaaagtgcacagctaggtgcactgcttgaagttctgcccactgggaagatttcccttcacctctgtccttcagagatgtcctagaaaaggcctgtagtgctgcagctgtccacttttgggtggtgcctgcatatcgtgcagaaccatctgtgaacaggccctagtcttctcctcctctgtcaactgatgatagggaactccccatgaggccgtgggtgcaggctaggggagagaaggcagggtggcaggagtggagaccatgggcacttgagccacttcctcatgtaacttacttgtgccttcaggacttgcctgagtcagatcacgtatataccacttccatttgatgatgggatgctgctgtgcacaacccactttatggctagatgggtcagaaagcacccagttcatgatagaaagttcaggttgcatggtgacttgatgacccagtcaaacgttcagtttccaccaaagcccagtaataggccaagagctgtctctcaaaaggagagtagttacctgcagaagatgacagggccttgctgcaaagtcctagagtactccactgtgattcacctatgggcgcctgccaaaggctccaaacagcatccctatctgccactgacaactcaagcaccattggatctgctggatcatatgtcccaagtggcagagcagcttgcatagcagcctggacctgttgcagaaccttctcctgttctggaccccactcaaaactggcagcctttcgggtcactcaataaatgggccggagtaacacacccaaatgaggaatgtgttgcctccaaaatccaaataggcccactaagtgttgtgcctctttcttggttgtaggaggggccaaatgcagcaacttatccttcaccttagaaggaatatctcaacaggccccacaccactggacccctagaaattttattggggtagaaggtccctgaattttagttggatttcttatcctctggcttgcaaatgtctcaccagtaagtccagtgtgtttgctacctcttgttctctggatccaatcagcataacgtcaatgtaatggaccagagtgatatcttgtggaagcaaaaagtgatcaaggtctctctgaataagattatgacacaaagccagagagttgatatacccctgaggtaggacagtaaaggtatattgctagccttgccagctgaaggcaaattgcttctagtgggccttatggacaggaatggagaaaaaggcatttgccaagtcaatggctgcataccaagtactaggagatgtgttaatttgctcaagcaatgaaaccacatctggtacagcagctgcaattggcatcaccacttggttaaacttatgataatccactatcattctccaagatgcatctgtcttctgcacaggccaaatgggagagtcaaatgggaatgtggtgggaatcaccatccctgcatctttcaagtccctgttggtggcactaatctcctcagtccctccaggcacatgatactgtttttgatttgctatttttctaggtagaggcatctctaatggcttccatttgggctttccccccataatagccgtcaccctactagtcagccaatgtgggggttctgccagctgctaagtatgcctatgccaattatgcattctggccctggggaaatgaccacaggataagtccagggacccactggacacactataagctggacctgagctaaaactccattaattatctgacttgcataagcccctagcttaaatggaggaccacaatgatgttttgggtcccctggaatcaatgtcagctcagagccagtgtccagtagtccccgaaatgtctgatcattttcctttcccgagtgcagttaccctggtaaaagaccagaggtctccttggggaaagatgagagaaagatctactgcataaattttcagtcatgtagtggagtccttccttaaggggacccagcctcccctttgtccaaagggttctgggtctgtaaactggctcaagtctggaaattgaatgaggagccgtgattctctgtttttataattcaaattagtcttttgtccattcaacctagaagttttctgtttgtgtaattgaagtaggaatgcagtaggcttcctatcaatttcacttttaggaacaccatgattaattagccaatgccagagctctacatgagtcagactattctgattgccactttgcctctgctgtccattatggtagttatgctcaccttgcctttgatggttgagtgctgccacttgacccctgccacctggtccctgccacctctggatccaattattcccattttgtagttgagtgactgtggttcccaccattagatctgacatacagagaatggcaattacagggctcttcaaagatgcaggtgctgccctcccaagtctattttgcaaggcattggtcaagggtatatcttctggaccctcccagctgggatgagtaggtctaaagggactaatccactccaccaccccaatctccctaagcctttggattccttcctgtacattaagccaagggagatcaggcatttccagctcactcacagtgggccgcctttaagagcttgtgtctatttttccacaatttcggctctttctctaggagataagactctcacttagtgtaatcttagcagatttgaggctcagtatctgcttctgaagctgggagacagaatccctgagttcatcattttctttcatcactttgtccgttgaacttaagagcagccaacctgcttcactgtgttccttggttctccacatatggtcaaatgtgctatgtacagagtcgctaaactccctgcctctcatgagcggtgaattaggagtgtcaaaggcatttattttgcataactctctaaacagtttctgccaaggactatcagtgttttctatactattagaagtagagtccttagcatttttgggtctaatcatattaagcagccaactccagaaaccccaaaaccaacgaaagaactccattcttaatattctgttcatctagaaccactcctggtaccaaaatctgtattaggtttctcttagagggatataactaataagatatatatgtcttagggagtttattaagtattcacttacacaatcacaaggtcccacaataggctatctgtaagctgaggagcaaggacagccagtccaagtcccaaaactgaagaacttggagtcagatgtttgagggcaggaagtatctagcatgggagaaagatgtaggctgggaggctaggctcctctctccttttcatgtttttctgcctgctttatattcgctggaagctgattagattgtgcccaccagattaagggtggatctgccttccccagcccaatgactcacatatttaatctcttttgggcaacacccacacagacacacccaggatcaatactccgtatccctcagtgcaatcaagttgacactcagtattaaccatcacagtaagctccttacaggccaaaatgcctgtttgacttttcacaggctttcacagtaagctccttacaggccaaaaagcctgtttgacttttctttgcagccatccatccagtgccccaaaatatacctgccaataggtgttcagtaagcattggttgaatcaatattagttttctcttatggaggaatatctttctggagtagtcaagacaaaagaataatcatccagaatttggaaacattaagcctgtaataagagttataatcattcatggaccacactacttcaaactgcaaagaaagcaaaaatgcttataagtaggcaattaaattgaacattaaacctaatgagttacattaaataataactaggaatacctgtttgagatgttacaaaccacaaagcctaccaaatacttcaccgttacctctctcaggtctggaagaggccatttattttctaccacatacacatatttcaaaaaatggaagtttcactattaattaccctaattaccaaggcagcagataaagcaagcaatctccttgctcccctctcctcatcccccatccctcccaccaagaaaaaaggctcattagaactctaccaccattctataagataggtcccaattttatgaatgaagaaatgtaaaactttagagaaagaaattaacctgcataaatccacaaagtgaagtagcagcatcagaagtaagatccaggcctcctgataccaaagggtgttgttctttaccacttccctctggtgacattgaatgtgtatatttgatagctgggagattctagctggctgaaataccccagttagaacttttgattatccttatgtggctaccttttatatagaaaatatatcttttccttctacttaggtgttagtaacatagggtggtaccaagaaccaccatttttatgtgtggtaacttcaaaaaaagtgtaaatatttggatatgaacaaaatagatcctcattcattaatagctcaggctatgcaaatgaattgtcttagaggctgtcttggcatttcacagtaatttggttaaactatcaaagagaaagccacctttaaatctgtccatggtagagttcactcattcactagtatctgcttgacccaagaacctattttcttgcacacatggaagcatgcattctacaaagccagctgaggtgaggtcccctgcatgaatgagagctggtggtggcactcccttggaaataccccaggcacctgtgttgctctcatgaagacctggctagtctggagctcagacagagaactgctattatttgttcttaaaggagcacaacaggcattttaaaatcctgttaattgtgtttctgaaccttagttttctcgtctgtgaaagaataatttaaaaaataccctttgagtatgtgtgaccatgagaatagaggaccctgtatgaagtatggggcatagaaagcacagacacgtaagaagatgggactgtcacagcacagttcctgttttctaataatttttagagtgagtctgttgagaaataagtgtttcaggataatggttcctctttattttctgttcctgaggcattgctgtgttagtcaagcatttgatggactcccaagtctctgagaatcctgctccatagttctcacattgggatttgaggaggcttgtagaaagcaagtggcccacacatctaagtgggagaaggcagcgtgggcaagatctctgtggtagccaaagatgcctctgtttcctggaggcgaaaggccattaatcaccagcaggaagagaagtgaaaaaggagactgctgctgcattgatagggcttatgccagacacacagagcaagcccatgttttttctctgcatccttgggatttcttacagtgcttggcacatagtaggagtttggtaaatgtttgctgagttattgagttgcagagtgacagctgtgggtggaggaggaaggatgggctagtattggtaggaattcatggactagtgggggtgcatggattggtatgagtgtggatgcaaggtgcacgtggttatagccttcattcttattgcttgcttgattttgcctggcaagatccacttcatatccatgatatagtgagactgtcatcctagtttcacattattgtgtgtctattccattgggctttggtcggtttggcttttttgttttgttttataatttatgtttgtaattttatctccacctctagcacaagaccaatacacatagtaaatgcttgataaaaattcgttgcctaaacaaaaacttgctcagcctacaaaactatgggtccgtcatatggttgtgggctgatcttacaaaataacaatcagcatttgttaagctttttgcaaatcaaagtcctttaagagatgttgggtggtattatgcccattttatagatgaggaaaccgagtggaaacgaggttcagtcacttgccctaagtcagatagtcattgaggagccaagatttaaactcagatcttttctgaccccaaagtccttgtgctgttttatatagcacaaggtggggaataaacagagaccctacccttgagatcatttcagttgtattggagagatgataggaataaatagaaaattagcaataaaagatgttaaatgatagtttaggaaaaaatgcaggggattttgtaagtcagatttggtagcaaatagatgatgaagacagtaagcacattatagtttagttcagagacagcattttatcatcagatctggaagagacaggcttcaggaaataggaataaactttaaaggtgcaaaaagggataatggcaaagttttcagatgaaaggtgttaataatacagtcacgtgtcacttaatgaccaggatacatttggagaaatgtatcattaggtgattttgttgttgtgtgaacaccctagagtgtacttacacaacctagatggtatagcctactgtacacctaggccatgtggtatagtgctcctaggctacaaactgtgcagcatgttactgtactgaatactgtaggcaattgtagcgcagtggtgttttgtacttaaatatatctaaacatggaaaagatacagtaacaatatggtgttataatctcatgggacccccttcatgtatgtggtccatcactgacttgtggtgcatgactgtaattggttattaaaacaattgtttgatttcagagtaagggctaatataaactccttatagttaaagccatctcagaccaccctagctaaaataataactcctgccccttctcattgctcttcattgtcttacttgccctatttttgatcacagctttatcaccatgacattgcattatatgtacttatatattgtctgtctccctctgctagaatatacattccataaaagcagggactcttttatttcctgttgtagattcagcatctgtcacagattctgattcatactaattgtttaagaactatttgtgaaatgaaggaagaaaatgcattttaaaaatgagttgcaaactcaaacactcaatagaccagttaggtaaaggaaatgagggaagcaagtgaggtttcttccacaatggtaacaagttgtaatttttacaaatcaaaagcatgttttgtttgtacattacacagatagaaagtttttactcccagaaatacatttatatctatttttcttgaaatatggggtcatctgactcattgtcaagagagacctggataccaaataagatttccttttttctagaagcagaacagccatccacgtgtgatgatgaatggcacctgaccttggatctcagggttggggttgcattagggacaggtggagaatgtgtttaagcgagaagtatgtgctgctcagaaagccctgttgttgccaaattttaattcatttaaaaattattaaccaatttcaattagaaaaatattatgtatatctacactgcccaatccaagagaaacaccttttgagctggctgtattttatggtgtgacctctgtagaaaaaaaagattaaataacatatgcaatatattttctccttaaacttctatggaaatgctacagtgtttagattccaaatcaagcaggaagatgccattatattattttgctgaccatacatcctaatacaaagactgattcagcagctggtcaaaatagaaaggacgcattcacaaagaataaatatattgattacattttagacttttttttaggtgaagggactttcattttcaggatagcaggtagtttagggcttggctgttggtttctgccgatagccaggggtatgtgacaggagacaaagtagctgaactctcttgatctgcattcttcccagttgcagaatagggctgagaaattgtgattgctttgagatggttactgaaagagagtgtgtacctggaaacaatctctggtttagtcaactattaatggggttgcgggggcgggatgttccgtaccccaggtcacagctggcctggggtctctgctgctcctccccactccttgtcctgctggtccgtgtcagacagtgcatctatcttcctaccaaggactcatttccagataatgattaattggatatggctcctgtgttcaagaaacttaaaattctgaagaaggaaaacaaatggagagacggaatgtggtaagcaaggcctatatatggaaagttagggagagatgacttcctgctgagggatttcactgaagaggctaagtagatgaattggactttggaggacctagaggtctggggcctgcagaaatggggccaggggacagagatggcaagaatgtacttggggcatttcaatgtaaacaaaattatacaggtgatcaaatgcaaggaatgtgcaaagaatatttaataccccccatacagagtgaggtccttaaaaacctttctggcaggaggagtccgtgttgatgaacttaaaactttaatgaaaacaaggataggggaaacctaggtttaagcaaaactgttcaataagtatttgtcatatttactgaaagtaaaatgagaaaacaaaagtagattatgagtgacattttactcaccttatgttggtaagagcagtgtgccacagtgaatttccagttacttcttgctgtttttcaggctgtcagccccccttacagtgaaatgcttacaggtagttttgctttattacagttagtgtacaattcttatgcacaagggcactcctccatgccaggctcactatacaaatgttcaatgcctttcagtcagagaggctgactgctgactcctgggtctccctgtggctaaagggtaaagtggatagatacatcttggggtaaactttatttaacttagttggcatgactgatcaggaagtcctcagatacctcacccccatgcctagggtatttagtgtcatgccaaagcatatgctgccaattccaggttttcattttttggtttcctttaagctttcaaaagcttctctgcaaaaatcacttccgctgcctgccatctgccttaaaaccccctcccccacttaaaaaaaatctgtttctaatcccaagagtcttttttgttgttgttttcgagacagggtctcactctgttgcccaggctggattgcagtggcgtggtgttggctccctgcagccttgacctcccagactcaagtgatcctcccacctcagcctcccaagtagctgggactacaggcgtgtgccaccactctgagctaattttgtgtttattgtagagacagggtttcatcatattgcctagactggtgcgagattcttatattttctaattattcttaaaatgaccaattgactatcaaaaatgtatttggaaataggtataagttgaactttgcttattgggaattcttggttgggggagttttctgtagttgagattaccatgttgttgggtatatgaagatgaacagtgacggataaaactagaagtgcaagttgaggccagtgtgcgaaggaacttgaatgccatataatagtgttgatagtgatggggatttagtcttctctctgatgcagactaaacaaaaaaataccaataacccaactgaactgaagcaaaatccaagtatctcgagcagaaataaatttatctgaccacataatctgagaattcaggcttagctggatccagggacttagatgatgtggtcagcactcttactcaacaccttgtcttcttgacttcctccttctatggcacgagagaagaagaagatggtcactaatatttctaccctcacatcttttcaacagtcacctcacaggggaggaatcttctttcttccagcgtccttatctcagtctcagggaaggactttggtcctgattagtcacatgtctacgatggttcgatctgtgtgtctgataatgaggcatactctggccaggacagtccacagtggtaacagacacaacctctggctccttcatcatccctgcaattataaccctgccatgatgtcattttttgcatcactgtatgtgagagggctgcaatgccaccttgagaacccaatatgctgcatccttcctccagatctgcatttatttgcactattctttttcaaacatacagttctactgaagtataacatatttacagaaaagtattcaaatcattgttcaataaattttcaagcagtaaacacatccatgttatctctctgagatcaagaaagagaatattaccgttcttccagaaaccacctcatgggccctcccagtaagtacatatttcttttttcccattggtaactgctaagctgatttcctttctctctctctctcttttttttttttttttttttttttttaaagagatgaggtctcactgtgttgcccaggatggccaggaactcctaggctcaagcagtcctcccacttcagcctctcaagtagctaccactaacctgatttctaacactgtaactttctcttttttgaaacaaatgaaataaatatgaaatcatacatatatgcctgtacactttctttctagatccttatgcacaacattgtttgtgaaattcatctatgttgcaatgtgtagcagtagactatttttattactatatagtattctactttgtgatattccacaaactattcatctactgttgagggacatttgggatatttctaggttagacatatgaatagtgctgctatgaatatttttgtatgtgttttgtgacacacatatgaatgtgtttctgtttgatatacacacctaagactggattgctgggccatggggtgtgcatatgttcagctttattcgatccttacaaagagttttcttaagtggctgcaccaatttatattcctatcatcagttcatgagtgtttcagtttctttatatcattggtaagacttgagattgttaaatgtttgaattttagccattctggtgggtgcgtagtgatgtcttattatggcttcaatttgcatttttctggtgactgatgatgatgtgcctttttaatttttttttgccacttttatttgtcttttgcagtgcctattcaagcttattgcctattttaaattagatttttaatctttttctcattgagttgtagaaatcttcttttaaaaacaaatttttaatacaaatacttttgcctgtcatatgtatttaaaatatcttttcccggctctagtggtttgcctttcactctcttttgatgaattggagatctcactttgaatataatctaacttatcagtctctttctttatggttattgtttcctgtgcctacttaagaaattgttgcctaccctaaggctatgaagctactctgttttaatttatagaagctctatttttttttttttttgccttttagccttttatctttaggttgtaaaaatctacctgtggatgattgttgtttgtggtgtgataaaggcatccgtatttgttttgttttacttatggatatccaataaacccagcaccacttattgaaaaatctcttcatttctactactctgaaatgtcacctttgttatcagtcacatttgtggtctgtctctgtgttttctagtccattccatttttctatttctctaatataatattgataacgcactgtcttaattacgtgagctttataggaggtcttgatattcagtagtgtgcaccctctagtttgttcttatttaagaataacttctaaagaacaaagctggaggcatcactctacctgacttcaaactatactacaaagtgacagtcaccagaacagcatggtattggtacaaaaaacagacacatagaccaatggaacagaatagagatctcagaaataagactgcacatctacaaccatctcatcttccacagacatgacaaaaacaagcaatggggaaaggatttaataaatggtgctgggagacatggctagctatatgcagcaaactgaaactggacctcttccttacaccttatccaaagattaactcaagatggattaaagatgtaaagtaaaaccaaaaactataaaaaccctagaagaaaatctaggcaataccattcaggacataggcacaggcaaagatttcatgacaaaaacatcaaaagcaattgcaacaaaagcaaaaattgagaaatgagatataattaaggagcttctgcatagcaaaagaaactatcatcagagcgaacaggcagcctacagaatgggagagaatttttgcaacctatccacctgacaaagatctaatatccagagtctacaaggaacttaaatttatgagcaaaaaacaacccaattaaaaagtgggcaaaggacttgaacagacacttgtcaaaagaagacatttatgtggccagcaaacatgaaagaaaagattaacatcactgatcattagagaaatgcaaatcaaaaccacagtgagataccatctcacaccagtcagaatggtgattattaaaaattcaagaaacaacatgctggcgaggctgaggagagagagaaatgcttttacattgttggtgggagtgtaaattggatcaaccattgtggaagacagtgtggtgattcctcaaagacctagaggcagaaataccatttgacccagcaatcccattacagggtatcaacctaaaggaatataaatcattctgtgataaagatacatgcatgtatgtgttcattgcagcacttttcatgatagcaaatacatggaatcaacccaaatacccatcaataatagactggataaagaaaatatggtaatatacaccatagactactatgtggccataaaaaggaacgagatcatgtcctttgcagggtcgtggatggagcggaaatccattatccccagcaaacaaacgcaggagcagaaaaccaaacactgcatgttctcactcataagtgggaaccaaacaatgagaacctgtagagagagggaggggaaaaacacctgaggcctgttggggatggggggatggggagagggacagcatcaggaaaaatagctaatacatgctgggcttaatacttaggcgatgggttgataggtgcagcaaaccatcatggcacacgtttacctatgtaacaaacctgcacgtcctgcacatgtaccccagaacttaacataatatataattaaaaagaatagcttcattatttctaaccatttgcattactgtataaattttaaagtcatcttctgatgggattttgattgggattgcattaaatctctagcctaaattgggagtaaattaatgtttttacagtgttggctattttaatccattaatatggaatatcccttcctttatttagatctgtctctcacgtctgtcagcatttttgtatccctctatattgtaaaattattgcacatcttttaaatatatattcctagtatttgaaattattcgatgctattataaataatacctttaaaaatatatcattttctgattgttgctgatatacaaaaaatacaattgagttttatatattgaccttgtattcattgactttgctaaattcactgaatcctaatagttctgtgtattaggttggtgcaaaagtaattgcattcataaattattatgaatttccatgtacacagttaaattacttgtaaaagagttattacttttacctttctaattatcacgacttgtatttgtttttcttgcctgttgtataggctaagacctcaaatataatggtgaatagaagtggtgatagtgagcattcttgtctaatttccaatctcagtgggaaagttttccatgttttactattaaatattattaaatatttctgtaagtgttttacaaataccgtttatcagatcaagcaagcccccttacatttaaaattggccaagagtattttcatgaagaggtgttgaatttgattaaatgccttaaagccataattgcacagaatagcgggctcacctctgtacttcctttttctcttggatcatgatcccatgtgtcctcattgccttgggagctcttctttttataccatatctacctttctagattttcttgagggttggactgttacaagttagatcatcattgtaggaattggtactgtaaattcaaattgtactatttttgtctgccatctacacggtatgagtaaaactgtaaaacccccgagaacctattcaattgttatttctttgatctatattgcttttggctggtaagctttatgaaaagattttcttttgttaaattttgctatcttaagaggaaaagtctaccattgctgctacaaatggaggcattatggagtcattgaaagggtgcaccttatattacatttaaatgccatgttttacatataaacatactgattttacctgttcctttttaaaaaagaaagaaaacaatgaaatcccaaggaataaaactgacattctttaaaaaagaaaaagccaataggagtgcttttcttcttaggtcccctgggaacatgtcatcctcttcatctcttagtcatccacttcttgtgtataaaaattggcaacgcttctctgtcactcccacttcttctctagcagtgatacaatctttcatgcgaaataagagaataataaaatgttatttctgcagtcccaatagtcagtagtattagaaactataatcttggaacccatacttaacaaaatataagccctctcatgtgagaagagagggaagacccaagctctaaatgctgactcattgctaaccaggagggtggcattagaacgcaacttgaccttcccaggtcttagtgccatcctctgaaaaccaaaggcttggacttgttcaagggacagaaaaaattgtaatgtaaagggctaaatagtaaatattttgagttctgtgggccatacagtccctgttacaacaactcaattctgctgttgtggcacagaagtgatcatagacaataagtaaacaaatgggcatttatttataaaagtgtatttatggacacaaactcaaatttcatacaattttcatgtgtcataaaatactgttctttcaacttttttttcaagcatctaaaaatgtaaaaacaattcttagcaaagagatcatataaaaagaggtaacaggcttagatttgtcccatgggcccaagtttaccaacctttgagtcagttaaattgtcaagggctgttccagagctctgtgttaggcattcatatgctagccttttaaaaaatattttttttgtcctatgaacattattcaaaagggtctatttttttcttttagaccaattatgaataagaaaaatacaatatgttgtttttacctttattccttcatcagtgcttgttctttctttttagagatccaagtttctgacctgtataattttcctctgcctgaagaacttctttttgcatttcttgcatagcaggtttgctggtgataaatttcctcagtttttgcttgtctgtgaaagtctttattttttctccacttttgaaggataattgcactagatgtagaattctaagtgggcgtttttttttttttttttttccttcaacattttaagtatttcactccacactctggcttgcatggcttctgtaattcttatcctcattcttctataggtaaggaatctggcttcttttaagatttcctctttgtctttggttttctgcagtttgaatatgatatacctagatgtagtttttctttttttgggtgtttgtcctgattggtgtttactgacttttctggatctgtgatttattgtatgtcattaattttggaaagttctccgtcattattccttctaatatttcttctcctttctttcttctcttcttggaattctgattacatttatgttacagctttttatattgttctatagttcctgaatattctgctctggtttttttcctcccttaattctctctctctttttagtttggaaattcatgattgactttcaagctcatggagtcttaaaaaatttcttaaatttttaatttttatgggtacatatgtgtatacttatggggtacatgagatatcttgatacaggtatgcaatgcataataaccacatcatggaaaatagggtgtccatcccctcaagcatttctcctttgtgttacaatccaattacactcttttagttattttaaaatgtacaattgagttgttgttattgacattagtcaccctcttgtgctatcaaatggtaggtcttactcttcttggccatttgagtctgctgatgagcccatggaaagccttcttcatttgttacagtgtttttgatttttagcatttccttttcaaaggagttttaaaaaaatgtttccttctctctggtttcattaccatttactttctccattagaatccttaacatttttcatcatagttattttaaatttcctatctgttaatgacacagataattccaacatccgtgacatatctgagtctgattctgatgattgcttgtctcttcagaatgtgtttttcttacctttcaccatgcgttgtaattttttgttgaaagccagacatgatgtgttgggtcataggaactgaggtaggtaggcacttagtgtgaggttttacttaatctggctaggagttgggttgtgtttagtgtttgctgagctgtaggtgctagaggcttcaaatccccccaagggtccttgtttttgtctcctctcttgactttaggtttccctaactactattcctcagggacgctgtgtcttggaagtcttttatctgtaatccactgttacacctgagcccggctggtgtggtggtagggcatatgtgagcagtaatgttctattaaccatctaattaagagcaaggatggaataacttccctttggtaaatggtaacgttacaggaaaggggtcccaatccagaccccaagagagggttcttggatctcacgcaagaaataattcggggcaagtccgtagagtaaactgaaagcaagtttattaagaaagtagaggaattaaagaatggctactccatagatagagcagccctgagggcttctggttgcccatttttatggctatttcttgattatatgctaaacaaggggtggattattcttgactcccctttttaggccatatagggtaacttcctgatgttgccatggcatttataaactgtcatggcgctggtgggagtgtagcagtgaggacaaccagaggtcactctaatcaccatcttggttctggtgggtttcagctggcttctttagtacaccctgtttatcagcaaggtctttatgacctgtatcttatgccgacctccagtctcattctgtgacttagaatgcgtaactctctgggaatgcagcccagtaggtctcagcctcattttacccagcccctactcaagatggagttgctctggttcaaattcctctgacagaaaaactttcccccataagaaaaaggaagatggagaacatggtggcttcagtgagggtgtctgaagatgagggacttgccttctgctggcttccatttcttccatgaattttgaagtgagctcatcagctaagactatgtgttaaatatgagctgggaaaagatatgacatagccatctcagaaagggagaaacaagcttggtaggaaaacattttgggtttggcaggcagtgttgactattcatttaatgtttgtggccatgaatttaatgcagctagtcagcctggttgtgtgacttcctctccatcccaaagtgttcatctgtttggatgggagcttggggttggtggatagttgggttccatcagtgttggaatttggtaaggatagtgtgacacagaaagggggtgtattagtgttccctagagggacagaactaatagtgtgtgtgtgtgtgtgtgtgtgtgtgtatattctatttttatatatacaatagtatatatataacagtgtgtgtgtgtatatatatgtaggagtttattaagtattatcttacatgatcacaaggtcccacaagaggctgtctacaagcttgaggaagaaggagagccagtccgagtctcaaaactgaagaacttgtagtcccaagtttgagggcaggaagcatccagcaagggagaaagatgtaggctgggaggctaggtcagtctcaccttttcatgtttctctgactgctttatatttgctggcagctgattagattgtgcccaccagattaagggtgggtctgccttccccagcccacggacttaaatgttaatctcctttggcaacaccctcacagacacacccaggatcaatactttgcatccttcaatctaatcaagttgacactcagtattaaccatcacaaggggagatgcaggagtagagggtatgtgcaagggagtgattatgagtgagtataatgatggagccagtgtgaatagtgaaggtgaagcgaagggtaggaatggatagtaaaagtgctgtgtgttcaatggattaaatgtctaaataagtttgaagattgtttgcagtgaatgcagagtaagtaagtgagctgaacagaggaagggtggacagagtggaggatgcttgtagtgggatttgaggtgatgacaaagtttaggatgtggccatgtgagatagtgactcagaaggaaaaagcttcaggtgaggaaataaggaactgagaaactggcttttctggtaggtctttgactctgatgttaaagtcactgaaagtggtgaaggtgttagggaagcagaagaaaccctctgagaggcggaagctggagtcttcagggaatgagaaggcataagcaggagggaggtgaaaaacagcagtgaggatgagcagaaagtggcagagccagatggcctgagtgccacagagcagggatttgtgttggagggagggagggaaatcatttgaaggagcggtggagagccaggaggctgcctgccctactccctggtcttcagatatatgacgtgaggacagagggctgtaggagaggagaaggcaagtttccattaaggtcacagaaggttaaagttcagagaggagatggaaggacatagtgggcatactatttacagaaatgttgaaagggtgggatgagtctgtggggagtcggaggggttggggtttccagagcagcgtggagttcagagccctggtgagagaggatgactgggtagacctggctttccagcagagattgcagtaacaggactcccagggccagcatgccctgttacatggctatctttccacttctccctcctagcttaatttttagaaactttaacagatggaatgcaaaatttttatttttatttttacttcagagatcagtcctcaccctgtcgccctggctggagtgcagtggtgtgatcatagctcagtgtagcctccaactcctgggctcaagtgatcctcccacatcagcctcccgagtagctgagactacaggcaacgcaccaccatgcctggctaatttttgtatttttttgtagagattgggtcttgctatgttgcccaggctggtcttgaactcccaggtttaagcaatcctcatgcatgcatatatatatatatatgcagctttgataatttaattagtttagcctgtcaggcagctgtgatagtgtagagaacgttgtatttatttgtaagtcttaaggtaggattggaatggagaagtcaacttcactgaaaactagcaagtagaatgaaggaaacacagattagttgaggacctactatgttccaggctttgtgccaaacatctactttatgtaggtgatttcacaagatggacatgttggaaaaactgtgggcattggaatcagtcctgggtttgaattttagttgcttggctgacaaactgtgttactttgggcaagttacctgtgctcttcagtcttacttttctcatccatagcgtgggaataataacatccacctgttgtggttgctgtaatgagctgtgcaagaaattctaatcagcaggccgggctgagaaccactgctgcagagtgattagcatttgttccattttataggtgaagaaactaaggcccagtggggctaaatatgttgcttacggccacacagcacttaaatgatatagccaggattgaaagccagttttttttgaccccagaaccttgttgtatccatttcattgagtttttgccttaatacatgggaagctaaaggagcccccccattagcatgtctgcccaaacatcaggcagcatgggatgggaggaagggatcaagtgaagggaaggcaggctccatggaatctaggtcagcggtttccaaacctggctgtacttacaaatcatctggaaaatggttaatctgtaaatctccagggaccaccctaggcctattggatcagaacttctggagcatgggaaccgggagtatgtatatttagaatatctcccaggttattctgagactgctagcctagttccggtccttgggcaagtttttgggaaccactgaattctaatcgatgtcctaaaatgattaagtgattatatcccagtaaaatactgggtgtcttccagtgccaccaaaattggcctttaggggttgagtgctattgccgtactttaagatcttggtgcattacctgaaacggacactctgtctgtcattgaacatttgaacttcgaatatataggaaatgtcaagttggcatactctgctataacaggaagagtgatttgttatttagagctgttgttcttccttctttccccttgggattcctgcccactcagtcagattagagctatataaacaagctcgtactactgagctagcacacatcttgtaaattttttttcctgaagtgcttaacgttgctgatgtcagaaaaaaaaaatccattgggttttaatgggctgaggcaaacaatgagaatttgatataatatggaggagaggaaataacttcaacagaaattcttatttggcagcataaatattcaaactatattacagtcagagtttgattgcttctcctacatggcatttccctgaatagggttttgagggctgggcactaagagtggcaggcatgatgtttaaagcatttagttgcaagccatggtaatttcagtgacattgtagggtaattgtagttggttctcctcttagctctgtgtcaggatcacctgaggaggttgttggaccgctgaaggcttcatctctgatgcacgagtcagaacatctgagggtgggggttggggtgggattctccattgaatctgatgccagtggcctgggaatttcacttggccaaaccctggcttagaacaaggtcactggtcagtttcgatattcattctgtgctggggcatttccatgacttagtgtcttccctcttcaaaagcaaccctgcgtgatggaggggtctcatcttccaggcaaggagctggaaacgtagggtgggagagcccattgtcaaaggccacatagtagccttaatgaggctagagctgagatgtgattcccagtctgacttcaaagcccttccttttcctataccatcgaggcccttccttcctgctctgctcaacattgttagctgccgaaccctaggctttgcttgttccagaggggctggcattataaagtaaacagcaggcatttattgtaactgcaagttacagatgcagtgtcagtttggagtagacttgcaggcacaatcctgactttcaatgattcacgaatctgtttgtgtcacaggtgctcaattgtcctattatgcatagagcatccccttcactatattttcttccctcaccacatattccttcttacctaaattgcttatgaattccagaagtggattgctgagtccaggctggttcatatcaataaaccttggggaaaatctttatgtgtgatgctatacatgggtctttgttgatcaagagtcttctttattggccacttttaatggcttgttatccagatgaatcttctggaaggaggacactgcatcctggtggaattttatcagttccatcattcattcaaacatatttaagtaccttctatgtgccaggttctgctctaggtgccagggagagaggggtgaaccccaacgataaagtccctgcctatgaagaactgactttctagagaggaagtccctgatagacaagtaaacaaagtcccgcagattcagatagttgcgaatccctgttatctcactctccacacttggctgtctcccacttaatctttctgggatcagattatctttgtggcttttttctcttgactgtctagcacaaagctgagccgcttctggggcttcagatttctatgcctgtgtgtgtgcatagccttggctggaatggcaaactttgcctctcccaggcttctgctcatctgtcacctcctcctactctgtgccatcataattgagcaaccacatattacagtgtcctttctgtgaacacatctgttattcctaccggtctctgaacattttaaggagaggatctgtgtctgacttatctgtatatccccagggcctagcatggaaccttacaaaagtagatgctcagtatatttgctcaaagaataaatgatgagttccaaagaacctgagggtgggtggtgtggtataggaattccgtcatggggagggatgctgagtcagatgggggatgctccaccgcagtggttttgtgatttattctttgagacattgagtgctgtcatgaatagaggagatgggctgggatataggcagtattgacagagacacgtggcatggaacattctggtgagaacctttgaaggaaagttagaaatgtgaggttctgagggtctagctcagagctggaaggaactctaaggttgctggattttatagccaatgcccaactgaggtccagggaagctgtgtgtcctggttctgatagttggttagttgcaaaggagctaggggtggggtgataccaggactcctagttcagagggctttccactatgctggggctatggtgtgtgacagataacagattaaaggcacagagaggagaaggaacttgcctaagatcacacagctaggaagtggtggagcctggatttggacatggatctgtctaatgagaggcatcttgtaaccatcaagctgtattgtctcttcttgaagactgtgaaatgcaaggtcctagcccattttcagttttcctcttgggttagctgtgagtccatataggaaaataatattaacatgctttctttcttttggtatgcagttacatgttttcagaaaaatgttcacattcttcaaatgttaatattgaagcccctgggttgtttactgtgtgtatatatatgtatatataagtacaatgaagaacattctgtttttctctaccactaaatttaaacccatttctattgtactccatttaaaagaagtattttacatcatactataatgaatgaaaacctagtcctttaatttcacaagccccagctttaatagtcaatgaatttaattagaaaatctttacctatgtaggtttcacatccagttctctataacatctgttgacctatggactagaaagtatattattattttagaaatgattctttctagacacaggaaagctaaatagcttgtctgagtttcaaaacgagttaatagaggaaccaaaaatagaaacatttctactgaatacgaggcttactaaaattcttcacacagagactatctgcattcacttagtagtttccagtctagactctggaacatcagcctgttttaacacacacaaatgcttctgttggtgggagggggtggctgggcagagggaggccgggcagagggaggcctgacacgtttgtttctaggtcatttctaaccttgctattataatacagttttctagatagaagagaatgtgctcattaaagtgttcattttaaaataaagcgacagaaacttaaaacgtctctattacatggatacatgagtatatataaatgaactcaatttttgttttcatgctctgttgtattctgtattaaggcaaaggagtaggcaactaagtagttgtttaaaaataaaactgtgtgttgttcatttaattttaaaagccattggttagaatggtaatcagtgtttccatgtagtactatattcatagaaatcctgatattacagtgtatagagataatattatagaatgatgctctttacctctttatgtaatctaattttaaaaaacattgtaatttataaatagtgaagaaagcaggtagtgttattcgaatgggatattttcggcaattaaattcttagcataaattacaaattcctctctctcccattttccacccaaatttgtttttatggaatgacctttggtagcaacttgttttataataaaatgtttcctgaatttgtattttgaattgaaatggccttttctgtcacgtatggtatttataagagtttctttgatgaaaagcctctgaattttgtgcaaataacccaggcagcctcttagatgagggataacatttgtataggacttttatggctttatactctgctctcatactcagcttatttgacccttacctgcggggaacttggtggaattcacattttactgctgaggacaatgtagaggaaggtgccttggcatgactcagagcatatagcaggtgtttggtatgtttgttttaaagggaaattaacaaaagaaacccaaaagattcttgtacttgctcaaggtcacacaataaatatagtgtcataccaaggattgaacttccttcttcactcaaaacttccatatacttgttcttatctcactgttatcttttcaggcttttcaaaaaggccacattaaatatatttatttttcttaattgaggtgaaattcacataacacaaaattagccatcttaaagtgtataattcagtggcatttcatgctttcacagtgttctacagccatcacctctatcaaggcccctgaaggagaccctgtatccattaagcagtcacccattccatcctccctgcagctactggcagctaccaatctgtttcttgtctctgtggacttacctattctggatatttcataaaaatagactccagcaatatgtgacgttttgtgtctggctttttacacttagcgtgttttcacttagcatgttttcaaggttcatccacgttgtagtgtgtgtcagtactttatttctttttattgctcaatgatatcccattgtatggatatacacgttttatttatccattcatgcactgatagacatttgggttgtttcccccttttaactattgtgaatagtgctgctatgaacatttgtgtacaagtatttgatatttgttttcagttagtttgtgtatgtacttagaagtggaattgctagatcatatggtaattctgtgttcaacttttttgaggaaacactaagctgttttcagcagtgactgtgtcattttacattcctaccagcaatgtttgaggattttgatttccctgtatccttgccaagacttacttgaggttttttttttttaaattataataatcttaatgggtatgaagtggtatctccttgtggtctggattttgatttccctaataaaatattcatattttaatgcatagaattaatcagaaaatgagctttggcaaggtgaactcaacagcaaaatgattggcttcaactgtcttcaggagattatttaagactgccgtggctgggtgcggtggcgcacgcctgtaatgccagcagtttgggaggctgaggctggtgcatcacctaacgtcagaagtttgtgaccagcctgaccaacatggagaaaccctgtctctactaaaaatacaaaaatagctgggtgtggtggcacatgcctgtaatgccagctactcgggaggctgaggcaggagaatcacttaaacccgggaggcggaggtttcagagagctgagatcgcgtcattgcactctagcctgggcaataagagcgaaactctgtctcaaaaaaaaacaaaacaaaacactgctgtatattcactcctggggtgtgcgattctgagctgaaaatcaataacatgttgtttggggattagaagaatatttgtggatagtaagactgcaatcatcccctaactttaaaaaatgtatcatgtaatatcatgtttttgttcatggcatctgccaaaagttacttaattctttgcatttcaaagccctctttatataattccttcgtgacttaatggtttattcatttatttttgcagtgtgagtgaagacactcaggatggctcaaggatccggggatcaaagagcagtgggggttgctgacccagaggagagttctccaaacatgatcgtttactgcaaagtaaggcgcctggtcaagtgccgtgcgtgctgtccgtgtggactgttgtgttctgtgtagggctgataaaaagacaaatgttttctgcctaaactgccttactgataaatgcatattttcttctcacatcctctggttctctagttctaaaattcaaggaagttcatacttgagcacttggtatttaacacttgaaaaatattatgccatttagttttctttaaacccaaaggttgcctaagcaatgcagatgggaagacacattctccttcagtggaaaggccttagtgtaagatgtatgaactgaaagttcttcagactcgtagtatgtacaaaatctgggctgaatgctgtgggagatagagaggtatatttgtatgagatgcttacagttggtaggagacataagatgtacacaaataactgttatagagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatctctttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctattaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatcatgcttattaaattgcgataaagaaaaaaataggttaatgggactcagcaattagtgaaacatacagaataatagacattgagtcattgttactttcttaacccacccccaaactgggagaccccgtgccaggctggtaggaacatgggctttggagtgagacttaggttaaaatgccaactttaccactctttagcagtatgactgtaagttagttctttaacttccatgagccacaattttttcatctgtaaaaagaaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagaggaaataaatgataaaatctctaaatgttggtgctgttaataagttgtctagagcaaatttatacagtgagtttttttttaagacacaggaaaacaataaaaatatttttatattcttcagaggattgcaaattcatggattattaaagaataagaaatgcaaaggtcatgtaacccaaccacctttctactagaatgtttgtattatgtttacaggaaaaaaaaacttcctgcaggtttatgagaacttggtttttactttttggtggtagtaaggggcccttttctggtttaatttagtaactaacatgtcaattgctgtagttctttagagaaatgacaactagtaatgaaactatatcttactttcgtgtgacaaacttgtgtaaagagtatatatatatatatatatatgttcatgtttatttgctatattaattaccataaaagggacattgaattggttcagtctgttagaaagaagacacacttattgcacagtgtgagctcaggtcctgacaccattttaaacctagttaacctgactgacttaaaccatggttgtacttgaactatgggattttcatatagttttctactcctgatgctgtaggctgccttttggctacaaccaagaacttacttgctgtaggacattatcctcaaggtatcatcagtaagggttggattgtgaagccaatgacaattcaaagcattttctttggaagtccttttgtgtaatcaattattcaaagtcatagccataaacccaaacctttccttagatacccacgactacaatttacatttaaaaaattgtgctttcatttttgttttctttctcttgtttgttgttgttgttttttttctcttgttgtcagacactttcagtgtgaaatttttgcttggactgcattgtgttgattcagatgctgacatttaaaaagccaaatctagagaaatgaagcttttgggtaaactttcgagtaataagtggatgattatgtccataatgttgttgtgacttttaaatgacatttaggatggtaacctcctgacatatgagtaatgatgggtgggtttttaaagcccacacttttcagaacactcttcatttccttttcatgttttcatgtcattaactgtgagaagttgtactttcccaaggcatgacttatttattgacttgaacagactttctaatttagtttttcatccctcatattcacagtttggattggaggtgtgtatgaaaaatgtattggtcacattaaagatctatttaaaagaaaaccttaattattcatgaagacacccagacctgttaaccttttttatattcctgtatccttaggatcctgagttactgaattgcccagtgtaatgatgatatttgaacctagctatacatcacatcatttagggtgctttataaaaatgttaatcctcaaaggaccccctccacaaggtatttctatttaataggtctgagctgggtcctaggaatctgagtttcaagatgttctcaggaaaatctgatgcccaactaagtttgaaaagcacttacttagtcttttacaatatccagacatagtatgtgttgcaaagtaatgagagagttggtgttttgaattagatttttgatttcataattatttgtagatctctcaaaacgtagaagaaccaagctcttgtcatagggattttagtagcttttccttagatattttctagtcttattttatagatgaaagaactaaaagtatagagagggtgagtaacttgattaaggctcctcagcactttcccatggaagccataatggtgtccagggagcctggccactccaatcagttgcctttctagcaccctatgcgactaccatgttatcaaccacagactactgttaccacattgttggagctgagtagccatggggcacattaaattaatgaaaataatatgtggcagatctttgactttcatgtttcttctgggagagttgacttggattaatgtctcacttttttattgatttttaaaaaatactttaagttctagggtacatgtgcacaacgtgcaggtttgttacatatgtatacatgtgccatgttggtgtgctgcacccattaactctcatttacattaggcatgtctcctaatgctttccctccccactcctgccaccccacgacaggccccagtgtgtgatgttccccttcctgtgtccaagtgttctcattgttcaattcccacctgtgagtgagaagatgcagtgtttggttttttgttcttgcaatagtttgctgagaatgatggtttccagcttcatccatgtccctacaaaggacacgaactcatccttttttatggctgcatagtattccatggtgtatatgtgccacattttcttaatccagtatatcattgatggaatgtctcacatttttaatgctaaagtttcattctactcattggtgcttttgcttcttcggtaaagattttctaaaatgtttacataggtaagattgcttttgagtaagagtaggttgctttctgattttgtttggatctttggtgttaacaatgcctcttgacaaagttctcctaactagactggtaatttgatttgtttgggtcaggaggcatggaagacatcacactctggatgtcttctacatccagaaggatggaggcatggcagatgtcacactctggatgtcttctacatccaaaagctggaggctctgcctgtctggtcccagctttgtgtggagaacttcactttcctgattctacttcttgttttgttttctaccttcttcattcttttcctccttccttttcaattgtgagatacttctaacacaaaaagaatatattcagtgtccatgtaaagtagaaagaattaaaaaatgaattatatgcactcaccattagcttaataaataaaatgtaatactttggcctcatttccccttctgtaaagggaggaaattggtctaaaaatgtacaaatacctttctgcaatgatttcaaagttccattctataactttttgatctttcgtaaattagtacacttccctgatatcaaaacaatgttgtgagactatatgcacgtttaaaggtcttttgagcttttgaagaaatattttagatagttgtaggtaatctaaattggattgagataaagcccagttaagtcaggcattagaataaaaagctttaattgtaattatttaatattcaacagtggaatttagatgacatcttggtggcaacctgtttctttggcttgctaataacatttaagacatttataaaattatcattttgtagtattaattatatgctatatacataacaagtggtgtttaagtagcaacactgtacattgccagtagtatatagtgtcatagatgaaataggggttttagaggaagacaaaaaaggccaatgttcttgtatatcaacaggttagttgcctagcctcgtcactgatggcttccttcacctattcatttctagttattgactccttttctgctggaatttgagtctagcctttatgttgctctgataccccaaggtcactcttcctaatgatttagggcccttgaagtcctgggcagttgttggtttaggcatacatccagaaagtaaatgtcacactattttagttacattggctgtggtatgcagcaagaagggaaggatctagcctggaagaatccgatgctatggaggaagctagggatagagtgtggtttggaattcatagagggcagtggtagaagccagcacaattgagagtctggggacctgcaggtcctggtgactaaggcatgatgaggattagaaactgtcgaatcaggaaatacgtattgagtgtcatttgtgtgccagacactattagatgctaggaatgcaagatgagaactgagccctgaatgagcccacaggccagctgggggtaaatggggaactagacaattacagtgttggtagaagcaactgaggggcatgggaggaggtagaggggtcatgtagtccatcccaggagaggggatgatgatgtagaagacatccagaggatttggcacctgcttcgattcttgaaagatgactaggaattaaccagatggaggaggagagagaaggtgtaggaggcaggactagcacctgtaaaagagcagatttgtgatgtcgtataccgagttcaggagactttaagtggttgatatgaagctaggtttctgtgatgaaaggttgaggaatagagctagacagatggattagggccagatcacaaaagaccttatgtaccatgccaaggagtttagacattgtaaaagtatcttccctttgggcctccacacccaagttcaactcctttgcatgctgctgtctgccccagaggctgagctgtgaggactacatttacagggctcctgtgacctctgggtttcagttgggtttggttagtaaaagtctggaaagagatgggagggaaggagaatcgcaatgtcagagaatttcttctcctgggtctcactctgcaaaaccttgcactggccatatccgtctactgaagtttgttgattctctcaaggcagactactttcctcttctgggtccggacatcctttttgtctactcatccttttgggcctttgccgactactttcctcttctgggtccggacatccttttcatctactcatccttttgggccttggggtggttccagtttgtatttgttatctcttgctgtgtaacgagttatctcaaaactcaatggcttgaaaacatttattatgtcacaatttctatgggttagtaatccaagtgcagattccgtgagttctccagcacagtgtctttttaaaaggctgtgatcaagatgttgactcggattatggtttcgtctgaagtctcagctggggaaaagtctactcccaaacttacttgtgtgactgttggctggattcagctccttaggggccgttggaatggtggactcggttcttcgttggctgtttgccagaggccattcttagttatttatgacacgtgtctctccatatcgcagctcataatatggcaggttttttttttttttttttttttttttttatcagagtgacaacaggcagagaaggaagatgggtggtagtagtcttagtgttttataacctaattttggacatttttttctttattatactttaagttctagggtacatgtgcacaacgtgcaggtttgttacataggtatacatgtgccatgttgttttgctgtacccatcaacttgtcatttacattaggtatttctcctaatgctatccctcccccagcccaattttggacatattatcccatcccttttgatagtaagaagtcactaggtccacccctcactcaaggtgagggatttacacaaagatgtgaataccaagatccagaattcagaaaatctttgtgggccattttggaagccatctaccacacagctctacttctactagccaggggtttctgagtgttttttttttataatttccctgtaccctagaactcctttaaacttggtccttttggaaatacattttccttaaattgtcctatgtatatcatctgtttaccaataagaccctaacgaatgcaagtattatcccacaagcaaagggaagcgattgagactctgcgtttcttgataagggaattcttcatgaaagggtttgaagcaggggagtcatttgtccaaagtggaggatgggatctgaaatggggaagtcaatgtggagaagattcagtgtggaggtcaatgggtgatcgatgtggaagggttcggtgtggagggagagtgttggagaagtggtaggattggaggtaggaggacagtttagagattgaacaggaatccaggtgaggaaaaatgatgcccaaatcagtggcagtggtaatacagatgggaggatgtgtttgagagatgtttaggaggttcaggcaacagaatttgggggctgagaagacgtagggagaatttgagaataatgaggaggaatgaggagtcttttccctaggctatatctgtgattctcagaaagtctcctgggataaacttttgaagcaaatagctgtagaactggattgcctgcccctctcttccctgtatgtagataaattgagagagcccaagacagagtctgtaaatggaccaggatatctgggtatttgttctggctgccccactccactagctcatttatggccatgcgtaagttgttcctactttttgttaagtctagttctttaatttgtgaagtaaggggttagctatgctgggtgatctctaaagcatttttttagatctaacattctaggtcttttgtaatctaaaatagagaaacccacattttattattttactacttcatagcctcctttactttatttttaattttctttaaaaagtgaaccgagccaaaactttaaaaacaggtaagtcagaatgtttaaaacaaatggcttttggtcttcagcacttagggcttgttttttttcactctttttttttttttaacattaaataaaattcctggccacatgcagtggctcatgcctgtaatcccagcactttggaaggccaaggcaggcagatcacctgagatcaggagtctgagatcagcttggccaacatggcaaaaccctgtctctactaaaaatacaaaaattggccaggcatggtggcacacgcctgtaatcccagctacttgggaggctgaggcaggagaatcacttgagcctgggaggcagaagctacagtgagcagagatggtgccaccgcactccagcctgggtgacagagtgagactctgtctcaaggactaacttcagaaagtgttcagggtaactaatttaattgttcagtctacattttaagattcctttcattaaattttttgaagctttttttattgccttaggaaaaaactgttctgttttccttttcccccaggattagacttgctggaagaaaagctcccccatcacattatcttggttggcaggagacaggcatgcaggcaagtcccagaccagtggtatcagtgtccacagatgaaagggatggtatttttagtgtggggaatagctcagtgtggtttcatatgatgcattttgatgagtataactttctaatttgaaaagcctttggtgtgtttacgtcttcatttaatctttccaatttctccccctcatttcatttcaaggagtctaagatttttcattttggcaggcagttgatcactcttgttattgacactcctttgcagtattcttacactgtggagaacctgaatggctgtaaattccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgcttacagctgaaataatttttagtattttctttagtgcaggtctgctgaagataaattctctcagttcttgtttgtctaaaatatctttgggccaggcacgttggcttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtgcttggggattctttttttttttgatggaggcttgctctgtcacccaggctggagtgcagtggtgcaaccttggctcactgcagctgccacctcctggaatcaagtgattctcctgccccaacctcccgagtagctgggactagaggtgcgtgccaccacgcccaaataatttttgtatttttagtacagtcggggtttcaccatgttgaccaggatggtctcgatctcttgacctcgtgatcctcccacctcagcctcccaaagtgctgggattataggcatgagccaccatgcccgactgtgcttgggaattcttaaccattaacttttcaaatattgtttatgcctagttttctcatttctctcttcttgggattgtgttcatatgttaggacctttttcctctagatttcatgtgtttcttatgctcttttctgtattttttattcctttgtcattttgtgcttcaacatggatattttctaccgacttatcctccagttcactaattctctcttcaatatattagataatctgtggttaaagtcatcccattgaatttgtaaccttagttattgattttttaagttctaaaattttcatttaattttctttttatagtttctagttttctgctaaacttctctattttgtcatttaattcctaaacttattaatcataattgtttcaaagtccatatctgatactttaaagtctttatcacttgctggactgtttctactaaccttttctttcttttttttcttttttttttgttcttctgtttatttattttattttttattttttttaattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccagtttcatccatgtccctacaaaggacgtgaactcattcttttttatggctgcatagtagtccatggtgtatatgtgccacattttcttaatccagtctatcattgttggacatttgagttggttccaagtctttgctcttctgaataatgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgtcttttggctgcataaatgtcgtcttttgagaagtgtctgttcatgtccttcgtccactttttgatggggtggtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgacctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttctccattgcttgtttttctcaggtttgtcaaagatcagatagttgtagatatgtggcattatttctgagggctctgttctgttccgttgatctatatctctgttttggtaccagtaccatgctgttttggttactgtagccttgtagtatagtttgaagtcaggtagtgtgatgcctccagcttcgttcttttggcttaggattgccttggcgatgcgggctcttttttggttccatatgaactttaaagtagttttttccaattctgtgaagaaaggcattggtagcttgatggggatggcattgaatctataaattaccttgggcagtatggccattttcacgatattgattctccctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatggagttcactcatgatttggctctctgtttgtctgttgttggtgtataagaatgcttgtgatttttgtacattgattttgtatcctgagactttgctgaagttgcttatcagcttaaagagattttgggctgagacaatggggttttctagatatacaatcatgtcgtctgcaaacagggacaatttgacttcctcttttcctaattgaataccctttatttccttctcctacctaattgccctggccagaacttccaacactatgttgaataggagtggtgagagagggcatccctgtcttgtgccagttttcaaagggaatgctgccagtttttgcccattcagtatgatattagctgtgggtttgtcatagatagctcttattattttgaaatacgtcccatcaatacctaatttattgagagtttttagcatgaagggttgttgaattttgtcaaaggccttttctgcatctattgagattatcatgcggtttttgtctttggttctgtttatatgctggattacatttactgatttgcatatattgaaccagccttgcatcccagggatgaagcccacttgatcatggtggataagctttttgatgtgctgctggattcgttttgccagtattttattgaggatttttgcatcaatgttcatcaaggatattggtctaatattctctttttatgttgtgtctctgccaggctttggtatcagggtgacgctggcctcataaaatgagttagggaggattccctcttttcctattgattggaatagtttcagaaggaatggtaccagctcctccttgtacctctggtagaattccgctgtgaatccatctggtcctggactctttttggttggtaagctattgattattgccacaatttcagatcctgttattggtctattcagagattcaacttcttcctggtttagtcttaggagagtgtatgtgtcgaggaatttatccatttcttctagactttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatctattttgttgatcctttcaaaaaaccagctcctggattcattaattttttgaagggttttttgtgtctctatttccttcatttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttgaaagaacatctttatttctgccttcatttcgttatgtacccagtagtcattcaggagcaggttgttcagtttccatgtagttgagtggatttgagtgagattcttaatcctgagttctagtttgattgcactgtggtctgagagatagtttgttataatttctgttcttttacatttgctgaagagagctttacttccaagtatgtggtcaattttggaataggtgtgatgtgctgaaaaaaatgtatattctgttgatttggggtggagagttctgtagatgtctattaggtctgcttggtgcagagctgagttcaattcctgggtatccttgtggactttctatctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggtatgattttgcagcggctggtaccggttgttcttttccatgtttagcacttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggcccccactctcttctggcttgtagggtttctgctgagagatccggtgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaaagttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacatagttgtcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccgtccagctttgttccgttgctggtgaggaactgcttccctttggaggaggagaggcgctctgctttttagagtttcccgtttttctattctgttttttccccatctttgtggttttatctgcttttggtgtttgatgatggtgatgtacagatgtttttggtgtgggtgtcctttctgtttgttagttttccttctaacagacaggaccctcagctgcaggtctgttggaatacccggccgtgtgaggtgtcagtgtgcccctgctggggggtgcctcccagttaggccgctcgggggtgcctcccagttaggctgctcgggggtcaggggtcagggacctacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcacccctcccccagcctcgttgccgccttgcagtttgatctcagactgctgtgctagccatcagcgagactccgtgggcgtaggaccctccgagccaggtgtgggatataatctcgtggtgcgccgttttttaagcccgtcggaaaagcgcagtattcgggtgggagtgacccgattttccaggtgccctccgtcacccctttctttgactaggaaagggaactccctgaccccttgcgcttcccgagtgaggcaacgcctcgccctgcttcggctggcgcatggtgcgtgcacccactgacctgcgcccagtgtctggcactccctagtgagatgaacccggtacctcagatggaaatgcagaaatcacccgtcttctgcgtcgctcaggctgggagctgtagactggagctgttcctatttggccatcttggctcctccctccttctgtttattttttattaagttctgggcattatacaaataatatagaagacatcatttacggctctaggacaatgttacgttacttctgagagaacttaactatttttttcttttatgtcagtcaaaataggaatggattaccttaatcaagtcagacacaaagattacttgtagctggacttcagttcttcttagggctagatatatttctagatctcctttactctctgtagggagcccttctggttccaaccaaaaccctgggtgcccctcctccttggaggactctgacctctaatttttgtcctttaaactctatgacactgccaaaagctctgttcagcttcttgatcatgccttttgtttaagaaattgacaatgctcttgagaagaacaagcagctccaattgctgggctcatcttcttagttttcttctttcaggtcatggcctcacaaactcttactgtcttggttgcttttcagtgccctcaaacatgtttaacaaaatgtttttcagcatttccagttgctctcatcaggagggtgtttctgaaacatctagttagccattgtcagaagtagaaccccagaacattggccttgagagaaggtggatccatcttttatagccttggtttgctcttaaaatgttttagaaaagacatatcctgagtgtcttagtggtctagcgtgatggtggtagaggtgaagaaaagtgaaacttccagtatatttaaaaagtggaattaacccgttattagttttagatggagatgagagaggaggattcagggctaatggccaggatctggactgggcatctggatgtccagtcactaggataagtggttgggttagtgacactggagcctcaagtcaccacagtaacagaatgacattcaccacagcctagttatgtaaaactctggacagagggaataaatccaggcaaatacctctacgtatgaaatggacctgaaaagaagctttacctggaggaaaccttacctgactccagagacctttttggtttagaaaacaggaagtaacttgtatctgtcagtatgacacttttgaacatttctgtattagtttgctaaggtgctgtaacaaagtcccacaaactatggcttaagacaacaggaatatattctgtcacagttcaggaggatagaaatctgaaatcaaggactgggcagggctacgctccatttgaaggcttagggaagtcccctttcttgcctcttccaggctttctgtggctgctggagatccttggtgttccttggcttgcagcagcatcaccctggtcttcgcctttgtcctacctcaccttcctcatgtgcctacctctgtgtttcacatggccttataaggacactagttgtgggatttaggcctacatccccatacccccaattgattgtgacctcatcttaatgaattacatctcaaagaccctaatttccaaatgaacttacatacgcaagtcccagggtttaggactacaaaatatctttttgacagacacaactcaatccacaacaatttctagtttatcaccgcgtgaagcttagtgctctctgcaaagatcaaatgaacaagtagtgtacttattgagctgttgcttctgacaaagcactgtgtggggaataaaaagtagcgtggcacacagtctctgtcctagacaactttactgtccaactggggagaccaagagtgatgcagaactcaggaggaaaataagctttggttggccacctaccatttaccagatactgcagtgggggctatacatatattgagccatttaatcatcagaatagcttgctaggtaagtggtattcaccctatattacagataagggaactgagggtcagaaggagtaaataactagtattaagtggtgctatcagaatttgaatctagatttgttgtattctaaagcctgtggttttggggaagaaactgaattatgttaaaaaaaaaaaaaaaaaaaaaaaacaaagctgttagaaattaaccataagagagttagtgtgagagctgggtgtggtggcttgcatctgtagtcctagctactgaggaggctgagatgggaggatcccttgagcccaggagtttgagaccagcccgtgcaatatagtgagaccctgtctcaaaaagaaaaaaaaaaagttggtgtggacaaggaaggcttattgaggaagaagaaatttgaagagaaatcatctgaactgtgtttttaagaaagggtaggagttggctggtggaaaagagccaaaaactgattccaggtgatgggagctacgtgaaccaaggcaaggggatagaatatatcagatgtatttaggagaaaatatattttataacactatatataagatacgtgctttatataattatagcctcattcttcatatggagaccttgaagtaagaaaacaaacatttttagctctgtgtctcacatggtaaggtattggtaaagctgagccttctgccaatgaattttttttccattcctcttcagaaataatcgctttccatttaaaaagtaataattcaatttagaaagaatcaaaatataaagtagagaaaaaatctcacatattcctatcatgcaaatatgactaaagttaacattttggtctcttcctcccagtccttgaatatgtatcagtagtatacataacacattaacctagagagtaatcatagtgtatgtgctattttgtgcttttctaccataacctaagcactaatctgtgccataatatgtcatcattatcatagttttatttatttttattatttttaattttgagatggagtctcgttctgtcaccaggctggagtgcagtggtgtgatctcggctcactgcaaccgccgcctcctaagttcaagtgattctcctgcctcagcctcccgagtagctgggactacaggcatgtgccaccatgcccagctaatttttgtatttttagtagagacggggtctcactatgttggccagaatggtctcgatctcttgacctcatgatccgcccaccttggcctcccagagtgcggggattacagctgtgagccaccgcacctggctatcatagttttaaaggttgaataatattctaagtagataatgtaccatgatttacttatttagggtttgttattaatagcaaattaaaaaattcctaggtcaaaatgcatgacctgtgttacaactcctattatatatatggttttctggaaggtcaatattgattttggcatatatagactgggcttctctgggttgttgtaaaagttctatgtcattgaactacagaaagagggtgaggggatttctaacaattagggccagtgttttcttcacctctaaaccgcatccccatcctagtgtctgcttggctttgcaacaccatccttatcctgagagctttgttgatgcctggggatattcagaaattttcgacttggaacccttccaagacatttgctattttattctctatttgtttttcttaagcaactaactaaataagaataacatttcaacctctttctactccccacagcattttttcctgcctgcaccacctctgcctacagtttaaccatggggttgcttcttatattttaaagctaaatacaaaagcacagttctgagaagcagccaagttctgcagccaagtttgaagaataaaactttaaaacagctcttctgtcacacacttgagaggggaggcaggctttgctataaataagtcacattccatttctatctcatcctttgcagtcctcttgggtaatgctttttgtatatgactacagtgttctcgaactgcccactcacccctttcaaccttccattttgtgcctcactttatttaaatgttcaatagttttggagtttagggaccctgcatgaaaggagtagacctttcctttcattcttcaggcttagatgtaatgagattcagtggctaacttattagaaactatactttctctttgtctgtaacgttttcagcagctgcctggattagtttcctattgctgccataacaaattgccacaaatgtaatggcttaaaacaaggccaggcacagtggtgcatgcctgtaattccagcactttgggaggctgagatgggattgcttgagctcaggagttcaagaccagcctggccaacatgatgagaccccatctctatttaaaaaaaaaaaaatacaaaagttgtctgggtgtggtggcgtgcacctgtaatcccaactactcaggaggctgaagtgggaggatcacctgagcctggggagctcaaggctgcagtgagccatgatcgtgccaccgcattgcaacctgggtgacagagtgagaccctgtctcaaaaaacaaaaaaccaagaaaccccacaaatgcattttcttataattctagaaatcaggagtgaaaaatgatttggcagagctgcatgccctcagggggctctaggagaattcatttcctccccttttccagcttctagaggctgcctacattccctaagtcatagccccacatcagtcccacctctactcttggcatcatatctccttctccaactctgaccttcctttctctctcttataggacccccggtgattacatggagcccacacacataatccaggggtacctccccatctcagagtccttaacttagtcccacctgcagagtctcttttgccaagtcaaataacatatttataggtttgtgggattagggtgtggacatctttggagggccgttattctacttatcacactgtcttagaaaaggaaaggaaaataattttggaatttttgtctttttcatagctagggaggaggtacgctgaagttttgtttttccttcctgtatttgtgatggttgatatgtggcaatctaaactaagtctgggatgtctgtttgtattggctgaagttcattggagggcagaaaagaggagagtttcagagactggcagtgaggatgggagggtggcttaaagaccttcacaacctgctcactgggtgctcctgttaggccccacaaacaagcccatgccatcgaggagaagtgaccaagcagatacattcaaaatgaataaaaggaagacctcatttactgtagtcccatccagtgtggcttccttataggactatttgtctctaattattttatttattttttattttttcagagagagtctcactctgttccccaggctggagtgtaatggtgtgatcttggctcactcagccttgacctctggggcttgatcctcccgtctcagccttcccatagctgggactacaggcatgcaccaccacacctggctaatttttaaacttttttgtagagacagggtctcactgtgctgcccaggctgggcttgaactcctgggctcaagtatatcctccctcctcagcctcccaacatgctgagattacagatgtgagccaccatgcttgaactatattttaaaaaaatattaattatgatactaaacaatacagtgaataaataaccttctcatgactgtccatctggcatagtagaagactttatgtgcttttttcaaacaatgagagaaagtgctggcatatcgcacttcccttagcttgagagacatgtgccaatctgcttgttgactctgccaaggcctctctttccgtcattttccatgttctggtcaggatttgtgacatatagtggctgacaaaaggcacacaagtgatagtgttggtggccaatctgccagggaagagtctgaccctgggcgctaatgtgactcaaggtagatgagcccttcgaggagctagtcaaggaaacagatgataaagtctaactatcagtgagcgagcagggggtgagcattttctttctgaagggagttattactgtcattaacttcattgcgttgctgggaaggaggggtcagtagttgaaacaaaagtctcctatggctgatgacatgttacaactttaggacagttgtcagcaagcaacttgctgttgggcctaatctgtccccatgcctttgatcccttgagcctcaggatggtttctacattttgcaatggttgaaaaactttaaaagagaagccatattttgtgacatgtgaacattatgtgaaattcaaatttcagtatctgtatatcaagttttattgaaacacagccacatcatttgtttatgaattatctatggcttttttttttgagctaccacggaggagttgagtggttgtgacagagactgtccgtatgaccggtgaagcctaaaatatttactaactggctttttacagagaagtttgcagcttctgttttcggagatttgaaagagactgaaaaagcatcggcaaatgtccttgttgggacaatatttccataggaaccaagacccagtgattccatgtggtgctgatttatttccaggaacccatggagggtctaactggggagggggtatacaagataaattagaaacaagtgcacattcctgtactacaaaaaatatacaagacctgccattcacccctcaaataatatgtttcctttcctgaggggtcacataatttatgccagtacattattgatgagatttttgtttgtttttttaaaataaaaaacaggcatattgagctgctggaagtgttgagctggctgttctgaaatatcccactaggatattccacttgctggctggctacctccatctcagatgcaatgtccaaatggctgtcaatttctgcaggacccactttgtgccaggcattgggccagtgctttgggcacgtgaattgctcacactgagagcactgctgtaaaatcattgttattcccatgccgcatatgaagaaaggagcttacactgggtaaacccatgcctgggcctcccctgtaagtgggaatcccgagttgcaggtcaggctgtctcttcttcacagaccatgctctttcacaagacctggaaggaacaagacaaccacctggggagctgcttacttctgatctttcctctgggatgccagggctatcacaacctcataggcaagatactctaatcactgagttatggtgttcggtgataatatcgacttccatttttataatttcttctagcactctgcatcctgcatgttatatttgtaaaaggcctgtgaaaaacataaggcagacatatctatttctgctttgtaaatgaggaaactgaagctcaggggtaaagaggcctttctaggctcaaccagcttttagtggcagagccagacctcttgacctggggtctggtgcctgtacactacttcccatgggccaggtctttgggaatagagctgcgtcactcacacttaccttagcagaggctgtgatagactctaagccgtatggtttttagtttatcctcagtgaacctcaggtcatcaactgacctccagagacgaatttcacgttgtagatggttttttttgttggcattactttacaactgtgactctgctgaatgcactgtacctttctctttcctattaccacatccattgcttgagtttcagtcctgtcttagtccattttgtgttgctgtaaaggagtaccagacactgggtataaagaaaagaggatttataaagaaaagagggttatttagctcacagttctgcaggtgtacaagaagcatggcaccggcatcaacatgtcagagaaggtcaaaggagaagtgagtacgtgtgaagagacaccatacccaaagggcatcctggctttacataataataaaccaacctaatcccatctcgccagagtgagaacagcagcccagcacgaagtcattcatgagggttctacgcctataactcaaacaccttcccctaggccccaccttctgacaccaccacagtggggagcaaatttcaacatgagatttgatggggacaaaaaatcccattatccaaaccatagcaagccccaatccaaaccaaaagcagatccccattcgtggttcccctttccacatggttccaaatgaggaagggcaaaattcatgtgttctgctcagtaaaaggttgaaaagttattgggaaacacatcttccaaggtttgtgtcctttgggacatgggaatatgttattaaccaggacagctgctcacagctgcacagggatgtactgaaacagctcattttaagcaaattttaagtagtggagaggatcattcctgggcacatttcacaagcattctgtcttggttttaccccaatctctgcatattccttcttcgtcttcattcccggggcagcttcttctgcccaccccgtgaaactttggcccattcttttctgtatgctgtccaggggccatctcctcctctctacatgctgcattgaggatccccaaattgctatcctctctccaaactccaaatgcctatatccagctaccaaaaagacatctctgtttgaatcttcctcacttaccacaaacataacaggtagaacatagcttatttcttgccctgccaaaactgttctccttctgagcttcagtgcttggtgtagcatcctccacatagttggcatcggaggcagaacctgaacctgattctctttgacaggcctaatcactcaccactctacgcaatatgaaaatgacatgccatgtgaatccaatgccatgtaaaaaaagataacattttctgtttgtctccctaggatattgtaaatgcttggcaccaagtaggtgataaataaatgtgaaggacaaacctgttgattaagcgttcctgagacatatcctttatctttctcagatgagattctctgccacatagcttatccctgtattgggtggattgtgtaactctgaggttcaaacattgggtattgcctctaaaccttgcacagttatttatctcagaactattgagtttggcggctgtccacatcatgtaacaattctgctgttaccttcctttccttgttttcttccttccctctctcctcatcttccacattcctatctgtgagagaggatgagaaaaaaacagacaagaagacaaaccaatatttctctcaccaatgaaaaatacctttccgttctgtttttaccattaaatgtggtatttgccctctgtgtctcaattaaaacaggttatttccttcttagtttcttcttttatattttttttcttgtttcagaaatggttcatgttaattgtaaaagaaaaattccgaaattatagataagccaaagaaataaataaaacatgtaacaaccccctgctcagagagttgtggttaacttttgaagtacctacttccatgcttcttttctaggtacatattttaacagaaatagagacttactgtacttgctgttgggaagcttcttttcacataatagattgagaatattttcttgtgacagtcaatattcctctagaccagcaattggatcactttgtttaaagggccacatagtaactattttaggctttgtgggacttactgtctctttcagctaatcaactctgctgttataagtgcagaagcattcacagaaagtgtgtaaatgaatggacatgtctgtattctaataaaactttatgaaaacaggcagtgagccagatttggcccatgggtggggctgtagtttgcctatgcttgtctagaatatcttttttttttttttttgagacagagtgagacagagtcttactctgtcacccaggctggagtgcagtggcatgatctaggctcactgcaacctccacctcctgggttcaagtgattctcctgccttagcctcctgaatagctgggactataggcctgcgccgccatgcttggctaatttttttgtagttttagtatagacagagttttgccatgttggccaggctggtcttgaactcctgacctcaaacgatcctcccaccttggcctcccaaagtgttgggattacaggcgtgagcccacactccactagaatatcatttttaatgcctaaatagtgttctatcttattgatatatcattatttacttaaccagtcagagtaatagctaatgttgtttgaggccttactctgcgcttgcaacattgcttcgtttgttctatttgcattctgacttacacctgcccacagccctgtgtagtgtaggtattattctttctatttaacagatgagggaactcggataaagaacaggtgggtaatttgcctaaggttagatggttagtaaatagaaaactcaaaatttaaatttgtttgatttttagaagccatgctcttaactactcattatgtttttacgcacgttagtaattatttgcttggataaattcctagaattagaataacacatgcattttaaggttttgatatttgttgtcaggttgatatatttggccaacttatatttcttgagtggtatatagcagggctgtgtttctacacccttgtctataacaaggactcttttgacgctttgctactttaataggtaaaacaagcttcatctttttttatcttatgaatactctctatatttcttctaaggtgagtgtctgatgcatgttctttctccattgttcaataagagcatttgtcttctctattaatttgttggagccttttatgtaagggacttctgtggtttttaagttgatgctacatgacgtgttatgaacatagccttttactttaaggagatgttgtctttacaattgaagataattaaatggaaaagtatttagttttaatgcagcattaattagactcctggaattgaaaaaattcccagaaactgtaaggtaagggaggacttactcctgttggggaacttgtccctttagtttccatctcttaagtactagaatttgtgttctttaattggaaccattgctttgctgtggccatggcaacacatcttagctgccatgaacagcgcacactttgacaaaatattttttttagagagtggcttttagatggaattcattttccaatgtattcatggagtctagatgaattaatggatggtagacccatacttttataataatagtaataataatgaaatgaatagttactatctattgatcccttactgtattctagccacaatgctttattttatattatttcatcggatctttgtgataatcttatgtcatagatattgttgttatccttactttatacataaagaaattaacacagaagagttaagtggcttgctctggcttatacagatggtaagtagtggagtttgaccttgaccttaaccttgattttctactgcgtgagtcttacaggtttattatagcctttagggtatatactgaattcaacagtggtagcatggatggcaaatcttgatgtcatctagagtctaagatgacactagcatcagtgggccacagggaatctgacccagactttcataacttgtattattatgaagattagagttctgaagcttactggattagaagagcacgagggggtagctgccccaatatattctaatttctcttgaggaccaccaaattggcagagtgtctctgatagggaaaaggaagagttggaaggcatcttagcctctaggacagaagaaccatttttattggccaccaaagttacatctagttgcctacaaatttatatccaaactccttatcctgccaattcagggttctgcaaactgatgccaaactatagtttagtcttctatcacatgactgcattatacatacccaattatctgggcaaacagacctgatccaaacacagtttgtactttcctttcctttcctttgtttagcctgttccgtctacttggggtgtctttgatttctccagcctcagtctcccgctgttagaattctgggcctccctcaataccaaggttaagtagtacctaacgaagaattttttatttttacagacaaaagcagtttctctcctcctctttgattcttatggttatttatattactctcaagtcaatcataaccttcttatttgtaggatagtttctccctgtaggacttgcaggattcctcgaatacagtgcttttccaaaggtaaatgacgacataccttaatcttgttgttagggattctgactctgagagacatgaaaccactgtttagagtcttgttatgtatgaattgtgtccccctccacccagtccatatgttgacatcctatccgcccatgtctttgaacgtactttgaaatatgattgttgcagatgtaattagtaaagatgaggtcatacaaaagtagggtggactcctaatccaatttggccgtcacactggaaatttgggcttgcacccaccgagaacattgtggaaagattggaatgatgctgtcagaagccaaggaactaccagaagctagaagagaggcctgaacatacccttccccagagccttcagagggagcatggccctgccaacacctaggtcccagacttccagcctctggaactgtgggacgatacatttcttttgttgaagccactcagtttgtggtactttgttgctgtggccccaagaaagtaccacaagcctgaggttttcaccgtccttacagccagcaagacgggatgtttcagatgaccctgtcctatgtggaactgggggctgaggtggggtggcctgataacagagtcaccaaagagctgcctctcttatctgtactcctgagttctcacagccttctgggcatcttcagcaccagcaactcagcatgtcaaaactgaacatctttcctctccaaaccccttttccctcataagcccatctaaattatggttaccatgtccctctcagtccctctggaattcttcccttttctcatccccaattgaaaaaaaaatctggaattctatgttcttctggaaaataaggaagatctggcaacaccaggcctttgttactgcatggctataattggccagatggatgggctgcccctgaacatagagaatgtgtcctgggtcctgtttgacatcgcatgccagaccctgtgggcattggagcctggcccctggcagggtggaagtgattgcctctgcctcacagggacataagtggaaagcttcagatcattctctgagtcaagctgtccggtttatgtcctgctgtgtcgcttactggctgggggcagccatgggaagtttccttgatctccctgtgcttccgtttcccagtctgtaaatggagataataatggtgctcgcctcataggggtgttgagagaattaaatgatttaatgcgcatcaggagattggaacctgacacgtagcaggtgcacctgaaatgttcccttatattcttatgtagtcaagaaaatcttgtcaccctttatctaaactgctttattatttttcatgacgcacggcatatttacttcttggttttactttgctactctccatcccccaccagcttgacacacattcagaaaatgtggccatagtttatacacatagattcagggctggcctaccaaggagtttggacaaagctcccgggatctcacttggtggagctcctgggcctctcctggctgccgagtcccctgtgctttctgccttctgtgttgtttcggttccagtgaccaagggcacagcttggtgactggcctcccgaggccttccgagtcaccgggggatccctctaattaggtacactgttgagcatgcaggtgtatatcctgcaggcaagaagggctgctgaaatagtagcttaacatgaaatccaggcagcaagtcgggtgttcgttagaagtgtgtttttttttttttgtgatttgggacactgacaaagcccagacaaacctccccacaccaattgtttcccccagctgtattccccttattgggccactcctaagcagtgctgatgacttatttagctaatatttgttgactgaatttttattaatcaatagagatttgttaagtaaatggagcattattcagacatgtggcatcagatccattactagatgtaagtgataaataaagtggtaggtaagacacagtcctgcctgtaagagatgtgcaatctagtcattgagagagaccctatgagaaacagtgggtggagctgggggattaccggtgttgtttatgggatcccagagaggaaggaccctgactcagcctgaggttgggactgggggcaactgggggatcatcagacttgtcattattgatctaatgtcccagtaaaattgggcgttttcaggacagggactgtgactgtctttttattgctctatgtcttgtcctagcccagtggttgacatataacagacggtcaataaacatttgatgagtaagggaattaagtgacatctaagctgagaactgaaggatgaggagtctgccaggaggaaagtgtgggaggtaggggaggaagggggtggcgggaggaagtaaaatgatgacgaaggatggtacagggagggaggagcatgtgctccttgagggtgacaaggactgcagttctgggaactgttagcttgtatggtgggtggcatggagccatttcaaggtgggggcctgggcagagctgaatggtgagaataacatagagttcttagtttttacatgatgaggtttgatatgcatgatccaaggtgcaggaaatggattggagaggacagggtggaagaggagaggccattcgatggctattgcagcaatcttgagagatggtggtggcaggacaaattactgacacctgagatggagaggtgactagattcagaagcaactagggatgtagaattgtcagaacctggcaattaggtgtctgtggggaaggaaggagagatgtatgaatgatgctcaggcctccaggggatgtgggcaccacttacttgtgatagatgagaagaggagctgtgagaaggttaaattcacacttgggcatggtgagtttgagatgcctgtgggaagtccagagcgcagttgtatacagcaggcttcacctccagagagtgatcagatttgagatacaggtttgaacactcattggcatagagggtcagggcttcatagcctagaaggacatagataaaattaagaaggcctatgaacttcagaaattatattaaaatcataatgcatgtgcattgttctgaagagctagctttgtatcaacttttcaaaatgtctgtgtcctcaaaaaggttaacccttggtgcatatggttaatgaagccagaaggagagatgagatttttcaggcagcaagaagggaagagagccagggtttgtgctgcagaaaatatcaacatttcgggggtgggaggcactgtgctgagtcagaggcctgggggtcagagttctgggaatgagataaagacttacaggtagcaatagctttactgttcataaagcacttttacatacaatgccattttatctctcaggaactcaactagatctttataatttggctctgtatcagttagagttcagtacaagacatgaaaacttggctataaattttaaagaagggatttcctagagggaataggtgcttactatggacccagaaaatctgagataggtctcagttaatgtagaaagtgtattttgccaaggttgaggatgtgcacccatgacacagcctcaggagggcctgacgacgtgctcaagctggttggaatgcagcttggttttatacagtttagggagacatgagacatcaatcaatgtatgtaagaagtacattggttcggtgtggaaaggtgggacgactggaagcaaaggcaggaagactcaaagcggagagggagcttccaggtcatagataggtgagagacaaacagttgcattattttgagtttctgattagcctttccaaaagaggcaatcagatatgcatctatctgagtgagcagagggatgactttgactagaatgggaggcaggcttgccctaagcagttcccagcttgacttttccctttcacttagtgactttgggggcccaagatattttcctttcacattacaaaatctctggaagggcagccccagggaaagattcccagaacaatatagaactaaggtcagagtacatccctgtagctgccaccctggcatcgaaaagctgggactggaaagccaccatggctgcagctctttctcggccttcatggagctgaaggaaggatgctggacactactgtattaagaaatctgttttcgtgacctgccttgatagcagtgaacagtcaaatagaagccaaagcatggccctcatctcacttccaccttctagaactccttgcttgagtacatttaattagtggaatccacttcagtcctgaatctctagatgcagagaagtctggaagatatctttataccacctctcttcctaaaaggagtgtgaaatggagctagagaaggggtcttattttgtaagggtcaagttaagaactgtttcagtcttagtgagccatgtggtctctctgcagccttgccattgaagtgtggaagcagccagagaccatacagaaatgagtgagcatattgtgttccaataaaactttatttataaaatcaggcctggcacagtgtttcacgtctgtaatcccagcactttgggaggctgaggcaggagtgagcttgattgtgccacagttctccagcctgagcaacagagtgtgagaccctatctctaaaaaataataatgataaagttagttaattaaattaaaatgagtgatggggcctaaaggccacagtttattgacctctgaggtaagcaaatcaattctcaataattatcgtaggttcttttttacagatgagggaattaaaaccggagagcgtcagtcgaagtgaaaataagtcctggttatttagttttcaaagttcatgttctccaggaaatcctgatgctcagcctctcctcttacaaggcttgtgatctaaaagaggagataaaatatgtactttgttggtgcagaccatggtaaatgctcccgggatggtgcggaatgcttttgcatacaaggcatttttgacaggagaaatcagaagtatgatggtgaaagtagttttagctagatgttgaagaaaggtataactctaacaggtggagatggagaagggaggagtcaaaagagctgatagggtttggctctgtgttcctgctcaaatctcgtgtcaaatcataacctcaatgttggaggtggggcctggtgggaggtggttggatggtgggggtggatccttcatgaatggtttagcaccgtccccttggtgctatccccgcaatagagttctcatgagctctggttgtttaaaagtgtgtagcacttcccctctctctttctcgtgctctggacatgtgaattgcctagctcccccttcaccttccgccatgattgtaagcttcctgaggcctccccagcagctgagcagatgctagcatcatgcttcctgtacagcctgcagtgcatgagccaattaaacctctttttttttttttataaattacccagtatgaggtatttctttatagcagtatgagaactaatagagaatttttgatggagtcaaaaactgcaagagaagtttaggaaaacagctagaaatggaaactcatctgaacattgtgaccttctatggtgttagtggagataagactggatcagggagaaccttagatagtaggattaggaatccgaacttggaaaaggggaagcactgatagtcttcgagcagggttgtgatacacacattacctcaggaagaattatctggttttgttctacagaattttgtgtaagtcagaagatacagccagcaagaattcgctcaggcggttgttgtaatatctttacatgaggatgcaaaggaagaagtggacatgagtcttgggccattcatgggacagggcaacttgtaaatgtaggtggaatagaaggatggctttgatgggaagagatgaaatgaataacaatacttgggaaatttgaggaatgggagcttgttttgtgggtaaagtaatgggccccatcttggatatgaggtgctgaggggcagaaacggaaatatggagtaggcgattggaaatgttggcttcatcttcaagatggggttggttgggagtcatcccatacaggtggatagagagccaagtaagagctcagctctctgagggagtgtgtacagtggaggatgccggaaggagaacccaggagacaaaggtattccagaactgggagagggacaagagataggaaaatgtagtaggcagggtagtgagagtggcaggatggatgttgtaccagaggagtcaagttagggagctatttccagaaaaagaaagagccaggaatgttgcatgccacagaaaggtcaagaaatactcgaaaaaccactggatttggtgaccacatctcaaggtcatgggcgaccctgagagagctgtttagtgtgtgttcttctcttgaggagtttcatattgaaagaaaagaggagagaaaatgggagattgaaatttgtggcttgttttaaagtggattaattcttcagtgccagaagaccacaaagaacttggtctgagaatatatcctgatttctccccaagacttttcttaagaaaaagcaagttgaaagaggaacaccctttagtttcgttctctcttgatttcaggattcggtttttggtcagttgtttgtgtctgactccacttttggccctgtcgtggggccgctcctggcaacctgggaggtcacgcacaagtgtgtgcagttgttaagcaactgctcgcagtcgcggtggccctgctaaattgggaacatgtattcgtcccagtctgagtcttcattcagtgggaaacaatgagtccctgactttgaaatctcagaggttacacatttgtggaatatgaaatcagtgtgttgatgatttttcctacctcatagaattctttaaaaataacactggagaattgctatgcaattctgtgaaaatttagttctctctagggccttttctagaaaaaacgttatgcccaaatcccaaaaggaactgagtattttatatcaatgctttctaagataaataaaaacagaacacacacacacacacacacacacacacacacacacacacacacacacacaacgcagcaacaacagcaaaagtcaataaaacaactcaccaaactaactctagagtttcagatggaaatgatgttatcagtccaaattaaagacatattctcttattttcttttacaccttggtttgtggcttccataatacaatcatctgagtcttgtatggtttctgaaatggatgctagaagagataacttgaatgagtacttttcccctggtggaattctcttcctcatctatatttaaacagttgttttgcacctaaagggccctaagttacgtttctctggagatatttagagataagaagtgttgtaagtactctttcacatttgtgcagaactttagtctttgaagtgtttagacatccattaatctttttttttttttttttttttttttgagacagggtttccctctgctgcccagactggaattcagcagtgcaatctcagctcactgcaacctttatctcctgggctcaagtgatcctccctcctcagcctcccaagtagctggcactacaggcctgcaccaccatgcctggctaatttttgtattttttgtagagacagggttttgccatgtcacccaggctggtctcaaacaatctacccacccttgcctccaaaagtgctgggattacagacgtgagccactgtgcccagcatccttaatctcattctacctcactttctgcctattgagagataggcaccccaagtaggaagtccaaatgctgataaagaaattgggattcagagtgacttactaactagccccagatcacacagcttattagaggcagattcagggctaaaggtcagattttccagctgcagatttattctgctttgagtggcattttagacattagtgttttctttaatccttaagcatttcagtgtctaaggtttgtataacatcaggttggtttctggtagtacgttgattgtggagagggcccagaagcagaaaccacagtctttacatgatagttactcttatctgaggtttggcctttattgaatggaagtctcttgttaaagaagggtatgcattgaggcaagagtcttgccaacttttcaaaaaaaaaatgggaacccctgggctccttggggatggctaatgacaatgattatggaggaggctgcaaatgtgaagtactttataaatcctggaggtgtggcagtagactgtgtgtttctggggagacagatttttgcatacattatcctctggacacttctgcctttggtgcatgcttgtttttataaaaaagcttgttttgttcctcctgtagaaatgagcctatcatctagagtcatggtggttttctgtatgtgtgagcttatgcttcagttacactgaacactcgtactactgcaaaatcgaattcagtgacattgccaatatcttcgctctcagtagtctttaaatattcttagccctgggaactggcccaagaaactgcttattcttttccctgtatcacttagcatataaatcctgaattactgctgactgaagatacataaagtacaaatcaataagtattttgtttctatattttggagaatgagacaatgagtgaaagagaacccctcaatgagggctttaaaatattgtcattgttctatggattagtagagctgcggctactattttacttacccactggccaccaggtactcacactgcagtgaaaggattcctaaaaacatctttattaagatattcacatactatacaatccacccatgcaaaatttaccattcgacgttgttggtatattattactttgtaaaaatcatggccctatgcacaacatacaacttgccactttaatcattcttaatgtacggttcggtggcactaattatgctcacagttttgtgcaactgtcactgctacctatttccaaaactttttcatcatcccaaacagaaactgtgtacttattaatcaacacctccccgtgaaagaatttttaaacataccttgattattagctttggatgtatataaaacctttaaggaagattttgtttagtctgttttttttcagggaaagtttattttttaaggggcagttccatacagtaggtgacacaggttaggttcctccagaaagcagcctcttatagtagcatgtgggacattgccagagtctcaggagcaacacttctaggggatgggggaagggatggagggaggactgggtaaaaggagaacgtgtactgtgttgtcattggaaggcctcaccctacccagtggaactctggaactggcatttcccaagttggggcaacagggatggatctttgtaccatatcattcagtcatagggttcagctcccaggacggcgcatgagcttggacaaattctctccagccaagggtcagagaaggttgacagctgagagctaagagccagcagctgaggggtgaaatgctcagtccatactttgccaaactttgctctccactggaatcacctttgcatcctcaaaaatactacgcctgatttaattggtatggggtaagagacaagtggaatgcttccaaagctccccaggaggtttgaatgggcaacacagattgggaatggctgctttcagtcttgaaggggagtcagcatagtatacatcatcatgggaaatgcctggactttggattgaaaaaaagttgaacttggctcaaccatttactgacgttgtagttcttatttatgttctgttaagattttgctactaggctttaaaaaatatgaatggatggtgcacctgggtggctgagagggcacttacaaattaaaacaaaaacagtgaacacctccagaatttgatagaacacaagaatgcataattcataaagaagaaattcaaatgctttttaacatttgaaaatatagtcttaatagcaactgaaagaatgaaagttaaaactatattttgcttattatattagcaaagatgaaaaataattgctattgctcagtaatggtgaaggtagtggcagaagacactctcaagctcagcacagtggttcatgcctgtaatcccaacattttgggaggccaaggtgggtggatttcttgagctcaggagttcaagaccagcctgggcaacatggtaaaaccctgtctctacaaaaattagccaggcatggtggcatacacctgtggtcccagctactcaggtggctgaggtgagagaatcacttgacccccaggaggtggagcttgcagtgagctgagatcatgccactgcactccagcctgggtgacagagcaagaccctgtctcaaagtaaataaataaataaataaaacaaacataaaagaaggcattctgatcctcttggtatgtccattggtgtaacacgaatggtggaccatttggcctccattcatgtgtctaccaatgcaatgtagataaaaattcataaaaagcgaatgccttttgacataacaaatctaattctagaagtttatcctgaggaaataacagaagagtatgtaaaaatgtgtgcataagttgtaattgcctgggtcttgctggcaattaggagaagcacaaatggtcattaataaaatattggttaaataagttctggtacatacctatgtacttctaatgagagaagccattaataaaatagtgtgagcctatttttgcattaaaacatttgcattgaaaaatgactttgagaaaaatatcagatgttaatggtaaacagtgtttttccccctgagtataagaattatgggtgaattttattgtctaactcatatctctttataatatttatacttagaaagtattacatgttatttaattatgtgttaattttatattcataaagagcatagagctatttccaaaaattacatatttccaagattacacacctgcatatctctatctatctatctatctatctatctatatctccctattcattcagcaacctaaaatgaaacagcctataatccaattagtagttatccctagaatttgaggtcacgggtgatttttattttctttcttgtgcttatttatactttacagatttttataatgagatcatatctctcttataatgagaaatgttttaaaaaagcttttaatatctcagtgcacttgcctgacctattttatatccattcttgcatctatttcatttgaagggtcctttggatagcatttctttctccatgtctttcttcctgctgtcctatttaaataatcacaattctgtgttgaaatttttgtatgctttacctaattaggacaaatattctgactcttgcatttgttatcaagatgtacatttttactttattcattattgttttttttttcttaagcaaagtttggcctttagatgatgcatttccaagcctagcatccatcatctaccattatgcttttgactcatctattaaatagtaatgtgtcctccaaaaatattgatgttaaattaaatgactctatatttgtccttggaaaaagctttgaggctataaaatttaccaagcaggtaggacatgcaaaaagagaaatgcatgcaaatgcttcctataggcaggagctcttcaatgtgtctgacaaatctcatctatcctttaggtcctaaattaaacatcacttctctgtgatgcccaccttgactttcccagggtaagctggtgctgacttctccttatgtttattatgcctcttattaaatcttattttaagtagttattgatgtctaccaatgcattagaccaccagataggaaatatggttgccatccaccaacactcttccaacagtccctacctcctcatattcaagcccctgacaaatagatgatgacagacgcgaccatatgtcacttccaagattaggttttgaaagacagaggtttccgtgttgggctgtttctcttggcccactaacctatggaaagctagctgttgtgacgataggcaatgtatgcagagaggctcatgtggcaagagctaataaaaaatggaagctggccacacacatgtgagtgagctttgaagcagatcctcccccttgtcaagccttcaggtattacaggcctggccatcagcttgattgcaaactcataagaaactctgagtcaaaaccgtccgtctaaatggctcccaattcctgaccttcagaaaatacgtgaaacaataaattcttgttgttttcagttttgagttttaggatagtttattatgcatcagtagataactaatccacattggtactagaggtgcagtgcttatgtaacaagaaactaaaatgtgataggactttgaacgaggcagcgggctgtggaaaagctgtaaggattaaggaccatgttagtaaaagtgtaaagtgccttgaacacactgtccatagaagtttggactttgaggaggctgccattgaaggcttcaaggaaaatgggagaaatcctattggaaactggaaaacagagaatctttgttacgtagtggcaaaaaaaagaaagaaaaattaacaacactgtcacctgcagtaatgtagaaagtagaaaatgtgcctgataaactggtgatatagttaaggagatttctaaccagagtgctgaaagtgctttctgattttttttttttcctgttgcttagagtaaaactgcaagaagagaggagaaactgaaggtaaaactattaaataaaaaagagccaggacttgctggttttaaagattcccagcctccccacatggtacgtgatgctaaaattaagaaatggcatctgagcaaagaccaaattcagggcacttttaggaaaacaaggtccaaacattaagccaaggatgcgactataaagtcttttcttaacatctcagtaaacaaagatagtgtctcagaatactgtttagtcagaaaaacctaaagatactaagacaagcttgtccaacccttggcccgccggctgcgtgcaacccaggatggctttgaacgtggcccaacacaaatttgtaaactttctcaaaacattatgcgtggacctttatttttatttttattttttagctcatcagctattgttagtatattttatgtgcggaccaagacagttcttcttcctatgtatctcagggaagccaaaagattagacacccttggacgaagggcttgccttacagatcctctctatcaaccagtagtgctccctggaagctcacagacattgtacctcagtccaagctcaagaaggacctgtttcaaagagatttgtgggtgtggcttttgtgtagtggaattaagcctaaagggattcccagaagacccatggagttgaaagggggttgtgcttgaagaaacaccatcagctggaaagaaaagagacataaagagtacaaaatgcagagaggcctttggaccaccaagtgtcaacaagtaaaaagcagactgagaaaactaactccccaagcacatgttacctttcatgaaaatgaaaggatgcctgagagggcacactcaagatttcaaagggtgagactaaagccatagagaaatattcctaggccttaattagagaccaaatcaaggagcttccatcatttgcttgcctggatttcagaactactatccttgcatacttcccattttcccctttgtgagttggagtgtctatggcagttatcctctccttatcctgcccttgcatgttgggtgcatggggccagataacttgtttctttatttgcacatgcctctatatcaagaagaaccacattcaattgttgtatgtcagagactacacccaagaaggctgatttagatgatgagggtctggacttggaactgatgctctgttgggatgagacttttggggacagtaggaggggtgggagtccttgggagccaaagggtgtcctgtgttaggcagcctccaagatggctccctttgatctctgactcctggactcacagagttgttaatcccctccccatcccacattgtactagggttggcctgtgtgaccaattgcaaatggcataagtgatggtatgtcgctctcaatattagtttattaaagactgaagcttccattttggtcctgctctaatcccgtgctttcctggatccctcacggtggggaaagccagctgccataagttgaggacattcaggcagtctggtggaggcccacatggtgaagcagttccagccaatagccatgtgaccctctagttccaatcaaggcttcagatgatgcagaccagattgacagtttgactgtaacctcatgagatactatgtagaaaaaaactgctgtaggccttagacttctgtacttacaaagacttcttgcaaaattggcttggctggcatccaggaatttggatttaggggaggcctgacaccatttcctaatggataagagtggttcactgtgcctaaactgtaaacaatattatttatgctgagcacttgctttccatatgggagtcttggatttttatatgtgctaggcagagggtgtgtaatgagcaaccctcagtaaaaaccttgggccaggagtgctggcttacgcctataatcccagtgactcaggaggctgaggcaggagggtagcttgaggctgggagttcaagaacaacctgggcaacagagcaagatgccatttctgaaaacagaaaattagccacgcatggtagtgtgcacctgtagtcctagatactcgggaagctgaagtgggaagattgagcccaggaagtcaaggctgcagtgagccattaactgtgccactgaactcccgcctaggtgacagagtgagaccccccaccccaaactctaaaaaaaaacagacaaaaacattgagcactaagtctgtgataagcttccctggtagacagcattttccacttgtcacaatacgatgctggaggaattaagcccatgctgtgtgattccacagcgagagaactcttggaaacttgcatttggttccttgtctggcaaagagaaaaggtgctgattttgctttatattcttttgctataataaatcctagctatgaataatattatatgagtcctgtgaatcctcttagccatcactgaatctgggggtggtcttgaggacctccaacccagagctcctgagctaggagcacctagatcttcctagaccctcagaaaccataggataataaatatttgttatgttgaggcactgagttttggagtagtttgcttcacagcaataggtaactaattctggaagccagtcatttctctcttcccagcatttagtttagtgtcttggaacataggtgttaaagaaatatttgttgagtgacttgacactatttctgcctttgaagaagttcatagtccatttggttcctttgctggaggaatctaaatcctggcttggtattatgaagcaggcttactctcttttttctgtggcctagaagaatcaatcgcagtggcagcagcctgccttaacgttgtcaggttctgccatcttccctgttgaatgagatccatgggtataagaattagtgtatgaccatgcctcttctcttttactcacttcttaggtcctttgatttttattttctctcccttctatgtcatggcagtggtagctattcttactattgaaataaaaacttcttcctgctgaaaaattaattaccaaatgtttcagggccttataagatattaatatttccatatcgagtcttgcctcttactctatcatatgattgccttgaggaaagttcagacaaattaactttccattttacattgcaccccactttcccagcttctgcaaactgtcttgaaatagactttatagaaagataggaaccatttccactaaaatgagtttaatgtagggaaaaaactcaaagtatacactgaaagtagacttctttgagtcatttacagttaaaaattattttaatctaaaggtgtatttgagtgtgtgcacaggtatacacatagaccgccccccaccccatactcattcctgtggcacacttcttgctagttgttggcactgttaaataaaaattacagggggccatcgttttggactaagcttctgcacttggccccaacaaaccagattgaaaatcaaaatggagtcactcatgctaaagttccatgtcaccttccaataaatcaggggaggaagataacaatctaattttccaaacagggcagtttcaatcttcaatcagcctgatgaagttctctctgctttaatccttacaacaaaaagtaacctgaaggaacgtgatgttaactagatatttttttctctattgttctgttttcctgttcctggattacaaagaaagtaactatgcaatgaccaattgcttttgttctgtgtttctgctttctctagcccttttctgcttacaaagccaaccatctctgcccactcattgcagcacttattaatggcaaaaccgcaatacttttgcaccaaaatatttaatggaatgaagtgttgttctattctaaaattgcaaataaagctacttgagctcctgaaagtaaatttgttgtaattttgtcctttgacagatccttttcctcctctttgagtctccttccggttcagcagatgaccttggttatgagtttcatgagaatcccagggtgatctaatagaagctctctcatttatcttctttccatctaattttttacaatttttattgttttttcttgtgtcagagaatcatctacctttgtttcaaagggttctagtcctgctttcaatcccatatacttgggcctgatggatctttcgaaagtgaaattgtggcctcatgatggcatcatttgaaagcctccgatgactgtttcccgaggagggtgaactttctctccttacctgctcttgctttcctgcctccattttgctcatggcattcccttgaattaggttctatgagtggaatacagctttgaaggcaattccagagatccaacaaaaacccaggagattggaaggaattcatatttgtcaaaaaatgtgtagctcaaaaatataaaaaaaaaaaataatgcaaataaaacccaatagagtataacaactatttacatagcatttatattgtattaggtattataactgatctacagatgatttaaagtatagaggagggtggcataggttatatgaaaatactacaccactttatattaatataagagacttgagcatctgcagattttggtatcctctgggggggtactggaggcaatcttcctgggatactgaggggtgactgtaacttattttcagtactttggtaatagtgtatttaacggtctattgtttctcagggtttgtggatgatagtccattaggatctgaaaataagatattagaagttctatttacttttttttgtttttctgaaattttaagtgtatatgaagttaagggaatacatgtaattttgaaataattaaatattcatgtttggaaatctgttcaaatttttgggtggctgggaacacaaccaaaaagatatgaaaaccaataacaattatgtatcagtaggcattttataaatagtctttgatattattttggatataagtgatttgattggcacttctcatttaattgcttattaggtgggtttctgttttgtagagaacatttaaaaaaaatttagacaagcaaaagttaataaaatcacctgtggtatgaccactcagaggtaagtataatgaatgttttattgtatcttctttgcagctagttttctatacacatagacatgattttcttctaaaaaaggaaagatcatgatgtatttataatttgtaaaacttttataccttgctctttgaactttaaagaatgtcatgaacatttccttagatactaaactctttccccatatattttaatggccttattatatgaacatataaaaataatttattttgataccttaattcatgtgctgttggatttttaggctcttgcaccattttccccacttctctgcttgctgttataaacagttctgaaaaccagatgctgttagccacaccatacatatctgtgatgtttcctgacaagattcctaaaagtagcaccttcctttcataggtgaggttttacctctacctttgttgtctgtctctaaggcaaaggcaattttgtgtaatggtgaagaactcaggacagaatttgaattgtgcctcaaccagttactactgtgtgactctgggctagttgtgaacctctctattcctcatttcccctcatctgtaaactgggggaaacactaataccaacattgctgggtggttgtgagcaaacaataaacaaataatagtgtaagcaaacaataaattttagcaattgtttataaggtatttctcttgtcaagtaagccaagttaatcatctaatggctcctataaaataaagcatagggccaggtgcagtggctcatgcttgtaatcccagcactttgggaggctgacgtgggcggatcacctgaggtcaggagtttgagaccagcctgaccaacatggtgaaaccccatctctactaaaaatacaaaaattagctgggtgtggtggtacgtgcctgtaatgccaactactcgggaggttgaggcaggagaatctcttgaacctgggaggtgggggttgcagtgagccaagatcacgccactgcactccagcctaggtgacagaacaagactccgtctccaaaaaaaaaaaaaaaaaaaaaaacaacaacaaccataaaataaagcatagttatagtattcagtaaggtgaatgacacattaatgactccattttccatttgatcagttcttacatccaggaaccatgaacacagctatctcaacatatggtagtttatagggatagtctgtaatcttgcaaatttaaaaggtaaataggagtccttcagtaggcagattcatatattgacaaatgaaggaagaattagtcttgttagaagaaacttgccatttcgtttgtgaacaatgtagttaatttatcacaggctcagtgagggcaaggatggagctatttcactttactatttgtgtacagatccagctcttgggccgtggtaggcactcagtgaatatttgtgaaatacataaatattcatgagcaaatatatctatactttgttgaatgtattgcaatgtatgttgtaaacataatgaaggctttgtgtgatgaaccgacaattgacaatgaaattattgtctgcaaagtgggctggggccttcaggcttttctcctgattatagattcagaaataatgcaagaggctgttgctcaaagtgaatcccttactccgtgctggtcgtgttctttaattcatgtgctgttcccttgtgtgtgctcagtccttattgcagctgctgggtctgagctcactgtgaaaatcgtgtttcctttctgccgacccatagggctcagtgtttgattaataagtttcccattttctgagaaaaatacctaggtaaatcccccttggacagcacaaggatctgcagtaatttacaaccaccgtgtgagccttgtgttgaatgacatgctctttgtaaggatatggcataatttataatgctggccccaacgtccactcctagggcgttctcagtgcagtgccttgactctgatattggataatgttgacagttaagagaggaatgactttagttgctgctgctgaattaaaaaagtcagacacacagtctaaatggattttgctgtcttcaaagtagtgaccttgggatagatagaactctttgatgcttccattgatgttgctattgccccaaacatttccggaatcctttaaaaattacctttaaagcatgtggcacattcttgtgaatatttttgagtctaacaaatactcattctttgtatgaggctttgatttttggaaagagtgaagagtcactggcatcaagtgcaacaactgaggtgggtgatgagggcagagagtgctggttttgtttagggcaacatatggttttagaggccttttaataatgtcatgagacttgagcatttgttctaaacatgatttccttttaaaataatgtttgaaatgatgaaatagtccaagcctacagaacacaacattacatgccagataggcacgttcccagcatggatgttaaacagatgttaacgtgctgtgtttgtttgcgtgtgttctttcatcttgctctccttccctgttttttctttgaaagacagtgttttagatattcctaaacaccccccgcttccctccatacccgtctgccttctcccctttttccatcaatattcatacttctgccaatgttgccatgcttcattcccaggtgtgcttgtaccttttgaggaaatgtttagaaatttaaaggaattatcttgtgtgtgtccttctaacattgtctttgaggtttatccatgttgatttgttttaactgctgttttagtccatttgtgttgctataaaggaatacccgagactgggtaattaataaagaaaagaagttcatttggttcctggttcttcaggctgtacaggaagcatggtgccagcatctgcttctgctgagggctcccagctgcttccactcatggaggaaggtgaggggaaaccagtgtgagcagatcacatttcaggaggggaggagagaaagagagagaaagggaggtgccaggctcctttcaacaaccagctcttgagggaactagtggagtgaattaactcattactgcaagggcagcaccaagccattcatgaggaatccgccattatggcccaaacacctcccatcagttccaacctccaacattggggatcaaatttcaacatgagatttggagaggacaagcaaaccaaactatagcaactgctccataggattccagtatatacgaataaatcaagagtcttcatctgttcacctgagagaaagttcagatgctttcaccttttttgttattacaaatagtgatacagtagtaactgtgtgcatatctatctagaaatatgtactagaggttgtctagagccagtactcagaggaaaaatggctaggttctagaacgtgcacattttaacttagtggacattaccaaattgctctccaaagcagttgtaattatgcttccattggtggtttcccatatcctcttagttatcagatttttaatttttgctaatccgattggcacagaattgtatctcattgttttatattgcatttctctgcgttctagtgtgattgagtgtctcttctgtactcagtggccgtctgagtttcgtcttttgtgaattgcccatttatattccttgctagtccttctattgccattggcctttttattaatgatttataagaatcatttataatctagtattctttgtcagtttaatgggccccaaatatctttactactctgtggcttatgttttgactttttatgatgtctctaattaaacagccgtgctaaattttaatgtaatcatatttatccatttctcctttgtggcttgtacttttttatgtgtttttaaaaagaaatactgctctatcccaatgtcataagaataatttcctatacattcttttaaagttttcaaatgtagtgtttcacagacacttagaattgatttttgtgtatatgtaacattggaatccacttttatctttttccatatggatgtccagttgtctcagttacatgtatcaaatcttttcccactgtcatacaccacattcccaaacacgtgtgactgtgtgtggcttctgttctttattttatttttatgtttatttttattttttgaaacggagtctcgcactgttccccaggctggagtgcagtggcttgatctcagctcactgcaagtgctgcctcgcgggttcacgccattctcctgcctcagcctccagagtagctgggactacaggtgcctgccaccacgcccggctaattttttgtatttttagtagagatggggtttcaccgtgttagccaggattgtctcaatctcctgacctcgtgatccgccctcctcggcctcccaaaatgctggaattacaggcgtgagccaccgcgcccgactgttctttgttaatggtgtgtttgcttactctggctctaccctattttaattaccttggtcttataggtttgggtagtttaagtttcacttcagttttcttttttggaattttttttggctattctaagctcattatactttaaactgtattttaggaatgtggaagccctattgggcttttgttggaattactcagatggtttacagataaatcgtaagaatttgctctcttatcctgggtcttctcatctacaactatggtatagctatgtttatttagttctctttttaggtctttcagtagaattttgtaatttttgccatacttttcttacatatctttgttaaatgtctttgtaagtatctcatttctttctttcatttgttcctttttttgagataagatctcccaggctggagtgcagtggtacaatcatagctaactgcagcctcaaccctcctgggctcaagtgacccttgtgccacagcttctttctaagtagctgtgactacaggtgctcaccaccacatccagctgatttaaatttttttatcccacattttttgttgctgtcaatgatatctttttattgtatcttttcctattattgctggtgtataggaatgttatttttgtatatcttgctgaactcattaattttcatggtttagatactcatacattatgcagacagataaaatcttttaataataatgacaggtcttttccttttcatgttatgtggcattcacttctttttcttgtcttgatgtactgacttggactttcatgatatcacctgtttttgttaataaagttttattgaaacacagccacatccatgttgtctgtggtaccattgtattataacatcagagttgaatagttgcaacagagactacctagtttgcaaagcctaaatacctgccttcaggctctttacagaaagtttgcctatcttcacaaaacagggttgaacagaggcagtgatagtaacctttcttgtctcatccctggctttaaaaggagagcttgtgccaccaagaataagtgctgcttctgggttggttgatgtgtgccttttattgggttaagaaaatgtcttttttttttcttcaacttttattttaagttccagggtacatgtgcaggatgtgcaggtttgttatataggtaaatgtgtgccatggtggtttgctgcacacatcatcctatcgcctaggtattatgcccagcatccattagctattcttcctgatgctaccccacacctcacaggccccagtatgtgttgcttcctcccatgtgtccatgtattctcattgttcagctcccacttataagtgagaaaatacagtgtttggttttcttttcttgtgttagtctgctgaggatgacggcttccagctccatccatgtccctgcaaaggacatgatctcattcctttttatggctgcatagtattccatggtgtatatgtaccacacaagaaaatgtctttcttagatttgtaggaagtcttttcttgtttgttttgttattaaaaaaaatcatgattgaatgttgaattttatcaaatgtagttttggcatctgattattttttctctcattttaaacatacgcaattatattcttttgaatttttctattatttctagtccttggggctagaatccgcccctttgatgtgcttttataacttgtgatctcagtgggtctcattttttctgtaggaattgtctgcagcatggattgtgggaattttgctctggcattttccctgcccattcattagtccaggaccaatttttatgtgaatttctcagattgggcatttccggaccatataggaagcctaaatttgtaccgccaaaatgttccagaggcggtggtctggagtttaaactttgcaagggaaggcttttattctcctcccttggagacagacagaaacatacgagtctctttgtggttgcagctctttgaggagcctcactcagggcagcagccttctacctcgggcagagcccacagactttgcctgtttctcctctgtgctagttgaaatctaaatgcctactccccctggaccaatacttgtttctctccttctccctcaccatgatcctgtcactctctaaggggagtgaatttatgcttgcttctggttttagttgttgctttgtttctggcacctggtaatttcttctttcttattgcaggttcagctatgaatttaaaaatatatataatatttccaggtgcttgtaggaggtgagtgtgaatgtgtgtcttctcaccctcttgctgaaatgagaggctgccctctaaatgaaatttcaatattgaaaagataaaacccaaataaaacaaaaagcaaccccccaaatcagctccctaaccatgagccaggcagcacgtgaagtcctttgatattagctcatgccattcttatagaaactctgtaactctttttaagtggagaagttaagaaactggcccaatcccatgtcagggcagagccaggccaaaaacccctctgttttattggctgttacctcattttacatgtctgaacagtaataacagtgggtgtcaagtgtacctttcctaaaggtaactactacaaaggtcaacactattttccatctaacactcctaatatatttttacacattagtctcacctggtaattctaagatagaataatgatcatgcttgtctgtgagaattagcaatttttttcatggatttaagttcaagaaaaatcagaaattagcagttcaggagttttcaacatttgtaaaaaggcagatgggtgcaccattagcacttccttctgagtgaggtagatctccagggaattaataggaacccgttgttttccatgttggcaagatattagagaaatatgtcttactctcaggtttactaagacatgttttaaagataatactgtcatgcatgtggcttatggaaggctatagggatgtggatttttatattctctctagatttatttgcccatactctgaaatcaaggcagacggtaaaggtggagtcagtggtcattctgtttttttgattaggggtttatagatggctgacattttaatctcagttaatgactggggatggactccagggtccttcaccacagctcacccttgtttgtgatctaatttagcagcatcttgatttgaattgaaagacagccttgggaatattagctcggcccttgtgagagcattctggaatgctgcatattacctgatgctacctgagatgtaggtggttgggcagtgacagcctctctgagccctgacctgtcggggagaggttgagaagtggcaaaactttgattctaccagctgcaaagaccgatgtcaccatgaagttatattaatgactttgacaagaattttctcagtgtacagtaggcatatttgctgaatgagctgatcttgtaatcccagtatatctggagtagtcaattatgaattttctaattagcttgatgtttggtctcccagctaagtgagctcttgtgaactctgccagaatctggatttccaaattatctgacaggaggaaaggaaaggattgggccaaagtggccattgcaagtcagtttcttataagtcaaaaatttaatcagaccaagtgcctttcttttctgtgttcagaaaatacccattctttgtttctcacaactgttaacctgtcctaggatgaactggttctgcctccctttgctgtttcctgcattagtacttggaaaagcctgtggctgcatggtctgaggtgtgaccttcatggtgggcacaccttgtctctcttctctgcccgaaaggaggccactgttttcttgtctctgtaactgctctgtgaattcttcttcttcctgatgactaagtgtgactattctccaaggtctttatctttttgcaagttttctgagatcttcaccaataagcacgaatacttactgaatatgttttgtgtgccaggcactttttaaagcactttaataacaataactaatgtttattaagcatctactgtgtgccaggcactgcttttggtacaaaagatgtgaaataaaccacacaaagaccatccctcttggaacctatgttttattgagatccagccaggtggtagaacacatcagtaaacaaacatagacttcagcaggtggtgacatgtgctctgaaggagaaatggagtccgagtagagagtgactatgcatgatgaactggtcaaggaaagtctgtctgataagggggtatttgagaagagcacttctccaaggaagtggaggagcaagcccagtttgcttccaatttcttcctccttgtgtcttgccaactgggaccaagcatgcctggcgtggaacaaactctttctgttctctgctgatggagccattttctcccagagcccaggctctaggtctgaaccctgatccttctcttcacttttcttttctaatggccagacgtctttgtccttcctttgaaatagaagtgacagcaaaatcttctttcccacagccgttgtggataggaagcctctgcctggctgagcactttgctactttatttctgaattcctgtgccagcctcctcaatgatcttagctgctagtcttgctcttctcacccatctgtggccaccaaagcactggaacacgtaagccatcatttgagtgcttactccataccacacactggatcctcacaacttgctgatgctattacaatatgttttttttcttttttcctttttctaactttttttttttttttttttttgagatggcgtttcgctcttgtcacctgggctggagtgcaatggcacgatctcagctcactgcaagctctgcctcctaggttcaagcaattctcctgcctcagcctcccgagtagctggaattacaggcgcctgccaccacacctggcttatttttttttgtatttttatagagacggggtttcaccatgttggccaggctggtctcgaactcctgacctcaggtgagccaccctcctcggcctcccatagtgctgggattacaggtgtgggccactgcgcctggccttttttttttaaagttttatttaggttcaggggtacatgtgaaggtttgctatgtaggtaagctcatgtcatggggagttgttgtacagattatttcatcagccaggtgtattaagcctagtacccaataattattttttctgctcctctccttctgccacccccaccctcaagtagaccccagtgtctgctgtttctttttgttcataagttcttatcatttagctcccacttataagagagaacatgcggtatttggttttctgttcctgtgttagtttgctaaggaaaatagcctccagctccatccatgttcccacaagagacatgatcttgttattttttatggctgcatagtatttcatgatatatacgtaccacattttctttacccggtctgtcattaatgggcatttagattgactccaccatgtctttgctattgtgaagagtgctgcagtgaacattcatgtgcatgtgtgtttgtggtagaatgatttctattcctctggctgtatacccagcagtgggattgctgggtcgaatgatagttctgcttttagctctctgaggaattgccatactgctttccacaatggttgaactaatttgtttttcttttacaaagttttttttcaagactagtcaagtacactagtgagaagggagaaaaaagtagagcaaggagtttgatctgtaactgactgaacaatcaatggagatacctcttacctttggaccagttgctattacaattatgattcccattttgcagagaaggaaacagactttcctatggtcacttgctaatacaggaggtggctaagccaggatttgaactcaggtccaatggaatccacaggctccttccagccaccagaccaagcttcacataccctgctgtggagcaccatggagaccctggttcgctctttcactctttggctggctcaggattctttcatgcttcctattatcagtgggataaaagtccaaatgttctggaataatatttgagatctttcatgcctggaccgtacttcacctgtcttctggttttgtatctgagctccctcctgtaacaacctttgctgaacatactcaaatgtatcatggaggtaaacacagcgatgcctacgtttatacagtgagtgctttttctttccctttacctgaactcactctttcttcatgccccagctcagactccacctcctctcttaccttcgtctgtgttcatctatacttccaaactctcctgtcagttagaaggcgtgtcctgcctgtttcatgtcattcctaacatcagaggacatagctcttaaagatcttattaccaacttgccatttccatgaatttccttagcccttgatcctaaactattgagaaagcttacatatccaaaatgagtctaacttttctaagcaatggtcttgggagatgtacatatttcactagggcttcctggagctggaaatatatttggtggagctcctttttctaaattgccttccggctacccaagaaagtcaatttccttctttaatagctgtgactcatttttggactgatgatggcactattccagttcagtcacctatctgagtcatcagtagggactccatttaaaatttgactctttccctaaattgaatcaattctcaagggattaaaactagatattcactagaacattccccaggaaaatttagaaatcagagttctgaaaatgtttgctcaaaatgtcaaggggtgaaactgagagaaggcaactggaacgtttctcttaatccactgtccctcacttacctgcttggcagaaagaaggcgggggaaggaaagcattagaataaaaagagaaatgttcagaggcagtttgagtcatgaggaaacagctaaaacttccaaaacagaaactgaatgacatcctcttcctaattcaagccttcctcaggggaaaattgaacagaacatttcacttgataaatggaatgagacctggtcctggagtatttggaaagatgaatgacaggcaggaggaatacagtggaagggaatgccatttatttacaaatgcatctcctcaggtaagggaggggatttcacagagagagggaggtggaaccgcagagggcttggtccaagttagaacatgaacttactccttgctctcgtttctgggggagaaagccatgtatacctccagcactcagaagtgctcgcgacaatgagctcattgggatttgctactcaattagattctgctttgtacatgtagcacttagcactgtgtctagcacataacgaggactcggtaaatatttgttgaatgaatgaaaaataattgctgcctgggagaagttgagaggctttgtaattctgccctgtcatttctggtagtgaccaccaggtggtgccttcttaagaacaggaggaaataaaatcactccagtgaacacagaaggcttggggttgactcagaaccttgcccctgtgcacaccgtctaacagtacatcacaatttcttgttcctaacgttgaatgtgcacacaggattcagatacgtggctggcactgactttctttacttgagtcaaggtcaagtaaggttttcatcgttggctgagctctgggatttaaaaccagttctatcccaggccaagtgggtttctgttgttcctgcttatcccctgtcctccaggagaacacatgctgcccttgcttccatattttctcagaaattcgtccccagcatcactaatggattcatatccagctcttgcactcacgggttgaaaaacttggtacccctgtgtattttaagcagctacctgatgagtacctatgttgaaataggtttctgtggtcgaaattctcagaaaagtcccacaagatgggcataaatgaacaaactagctcagcaggcttaggtggctctcccaaagtaacacagataagtgagttggcagagaggattccagcccaggacagtctgcccttaggttgtgctgtgatctctattctgttttatgtggagtgagtttaatgtatctgcattaacgagatccagggacaaaaatataacaaaattcaaggaatgtgaagcaatgtcctatagaaggaggacagttcactatcagtgtgagccaacacactcagctcttggcagttttcagacagttgcaaagaaatacttagcctgaggcttcttcgtgcccataaacctaattaagggtactagagattctgattggcaagagctagggacagagaggctgagtgagactatacgtgtccctatgtttctgtatataaagacagaaagagggagtttgagagagcgaatgagttaaatcctaagtagacctggaaaactatcattttgctaggactggacttaagcaaaacagcagagcaaagttcagagttaagccagaactttgccttgaacctcaggcccattgagccctctgctccaacagggccaaatcagcatccaatagtccccttcaagttgtatctgtcccgtgtctcggtgtttctggtttctgttatttggtaggtcacaattaattatacagggttaacaaaaatagattaacataatgtacttgccgaatagtgtttctttgggagaaaatgacttaactcacctaaaatatctccaggcataaaagatattaatgttgggaatatcaggagtgattaacctctgagagaggttgaagggaagcaaaattggacaggaaggataggaggaatggagataggggatttcgggtggggagagcctcttagagtcttttatttcagaccttactctgtgcctttccatagggccaagtctgatcatcctctttttatggtctgaatatctttgagcccttcagaaactttcaaattagtaatatacatgattaatatttttgacacttacatgttaggaactagacattatttcagtaatcctcagaggagccttgagtggtagatgctatcattcttccccctttcttttaaataatgaaatagaggtttaggaagacccaaagctagttgatgtcagagccaagatccaaagcccatgtgtggttataaagccgtgttcttaccactatattatgctgtaagaataaagggacaaacctcaaaataaaagctttcactatcagtaacacagcaaaaaacaattattcattcaataatgagcaggatgaataaaaacagacaaacctcatcacatgaagttgaacttcagagaatagtcgaataaaaagttccctcaaacttaggagaaacctaaggctatgaaactgattgtttcatagccttggtaataagtagccatcaggggccgggcatggtggctcacacctgtaatcccagcactttgggaggccaaggcaggtgaatcacctgaggtcaggagttcgagactagcctggctaacatggtgaaaccctgtctctgttaaaaatatgaaaattagccgggcatggtggcacatgtctgtaatcccagctactgaggaggctgaggcagaagaatcgcttgaacccaggaggcagaggttgcagtgagctgagattgtgccactgcactctagcctgggtgacagacagagactccatctcaaaaagaaaaaaaaaagtagccatcagaacccatttaaaatctgttcatttggtcaacaacaacttgtcttagtgaaagttggttttaaaactggcagaactgaccagtgtcaaatccttacttcagcccatcagggatgcagtttccagtaaacatctctctgagtgccagccaatcaaagaatcaattacagcctcagctgagcacccacgtgctgtcaacccacgtgtgcctctgaacatctcacaaccacagagctccatgctttcaaagccctctaagccatcagccatctgtcctgctcacagacactgtttggccagcatagctctcttctgtgatgagcaatgtattcagccttggagttctgtgtcagatactaagtggtgatctcattgttatttgaaaaaacaagcacacatcagtatgtatgtagtgtatggctacagagacaatagcacaggtaagaggttgggtagggcaggtgctagggggggctactttggatgggaagctcaggagagcctctttgtgggtgcaaggtttatgaagagacctatatgatttgagaagagtccagacattcacagatctaggcctggggcttccaaaaagaaggaaaggtcttaaggtaggagaggatgcctgcgtgtctggggaaggagtagaagaggaggctggagaggaaatgggtggaggctgatccttcagggccttgtgggtcatggcatggtcaggatttgggattttgcttcaagtccaacggggaggcaggaaaccacccagggaaggactatgtcctctgctttaagagagagagagagagagtgtgtgtgtgtgcatgtgtgtataatatacacttgcacatatgtgcatattgaaagaaaggggatggaggcttagggtcaggagtgcctcttagagtctcttactttataccttactgtatatctataaatgcacatacatgcatatatacacacaagttttgcagttaggttcaaagatcctgtagatctagaagaatgtctatgacattgacaatgtgagtcagtacaccctccactgtgtgctaccaaatctgcccaccctcttccactgggagtcccataaatgaagtggttttactaccctgttgtagcccagtgacagatgatcagtgatgtcaaaagcgtgattctggagaggttggtcactttgttgcaaagctgctgtatcatttcaggtacatagtctgggaggtacagagtctagggtcagagtagagtctcaagccattgtgcatgcctgcccaagacagagtggagttggtctactcctgaatatattaaccattttttcccttagtcattacatgtaaagcttcatgtctgcatttgtcagttatgatttatccggatcacctttcttacagaaagcggtagatgccaaccagaagactggaataggcttccttttatctcttttgcacagttgtgtcttcggtgagatgacttgactctctgatgttgagagtgtttttgttaatttttgaagcatgatctcagttggtttaggatatgaatgccatacacactcattgttttcgtttggggactgccgctgtgctgggtgactgcgtgtttgtgctgctggcccttgctgacactgatattggatttacaaagccaaccttgcagttttgtgtgggcaggtaggctgcctttaatttgtggttgctttgcccttctgaaaacacgaacttctatctggttggaagtcattttctttttcatcaatctcaactactgaacctatttcttcaggcacatctccagactgccttggatatttcgaggatatgttctgcgtgttcacatttgaactgcagcttggtttgcagacaccctctccttagattggcagctgtttgtggaattcctgagtaccaattacatccagtagcaggaaataaaagacaaacaaggaactagtagagctcaaggtattctttcatccttcctccttcttagctaatacatcttacagttagctctgaaaggagaatttatttaaacatactaaacactgtgcatagtgactcttacatcttttctggtaatagcatgctaatgctatacttcaaagtgcagtgaataagccctgtagagaaatatcctcatggtatggtttcaaaggacaggcatccttctggaacatattgttatcttaggtttttgttttaaatgtcagcacatggagaccttattctaaggctgcgtctgtgctccgctagtgagtatggaaggcttaggtgattcatggtgggaagttgaagtaactagagaagacttggtgctgtttggctttagtgaaatttttagaagctgtagttgaaaaaccaacacagattggccctctgtttgttgcttttggctgtctagggactgcaaagtaaaaaatgacattttcttgatgtctttctgacagtttctcacctgtaggtcaagtcctaattgaaatatgacataaatatttggcgtcataaaagcagaatctccataacacattaggtgatttctagagtaatgctcacttttattgtttgggttccattgatgagttaggcagggttatattttaagaattttcttacatcaggaagagtcaacagaggatggataacatattttgaacgtggacattgcttgtaagttgcaggacacttgtaaacactattgagtgtcacctatagcaggaaccagtttttctttatccctcgttctgtgacagctacctgggttctatgttggagccccgtagtatagtttcaaatgcaatagccactgcataatccttgtcacccaaagactgcagatcttgacagaacttgtacaacagtggccttgctgaggagtgatgtacatttcttttgtcatttggccacataagaaaactgcagccatcactgtattttgatgcatcagactctgtgtcctctgagtgtgattcagctgttggatttcttgattatgaaagtatctagagtacctcatgttcagtgatgtgaactgctatgaaagttccctccgtgtattctgctggatttcttaagttatatcttcacagagagggcttgcctcttatacagtctgcatccagcacccataagtactttcctttgctgcaggagcaggaactgaacccaactgtggatggagtgggaatgtgtgttctgattcctgcttattagcggtaggatgtgataaatatgttccaaagcaatgcctggtagaagtgttcccctacctgcatgtgacaagaagcattttcctcccttcatttggatagaggaagggctttggataaggaaaaaaaataaagaagatcttggaccttaagctggagacaggaaggtcaagtgctttattttttctgtgatgagaaccagctcatttgagaactgaaggtgaatactgactgtcatatttaataagtagtgatggaatttgcatttcttccttgaggtcagtagtctgctttcatagatagaacaggagtttaaattctgagcaaaatatgcaatcttttctctttctttgattcttatcctgtcaattatctcgtcattctacagaggactaaaaggtaaagagttctaagatcttcgcattgtctgggaagaagtggaaatgttaatattagtctttaataagttattaatgacacatattataattgttaggataactcctaaaaggatagtgaagagcatataacttccatattaatggttaaagatgtgccaaacaatagcaacaaaggaggaggaaaatttgaacattgggataaaagcactgcacacagtggtagatgtaaacacaaatatttcagcaattacattacatataaatggactaaatgatgcaattaaaagataaagacatggatgaaaaaacttttcaggaggcatatttaaaagataaggaaataaaagtttgaaaaaataaaaggatagaaaaatattatgcaaatactaaaggaaagcagctgtaggttggctggtatcagtgttgatcatatcatggacatggttgattatggtatgagtttgtgccttatgttgtaagtattcacaatcagagtttcttatagttagaaaaaattagatgatcaaattataaattactagaaagatttcataattgttaaggtgtaggctttttactgcacctggagaggcctttcagccatgatgtgaattatgtaccattatgtaagataagtggagcgtaaatgctttgttcaaacaattataatgtaattggaaacttcttgtgttaacaatatcattatcttaaaggtgaaaggggtgggaagaatgtggtagaaatcaagttccctggggaataggctttacagccaaaagtaaagtcattttttcctgaccagtgacttagcttaaaacaggtcaatgatattctttaaataaagcaatatttaattggattcatttgcagctgatatggattctggggcttgatagcacttacatattaagctggaaatctagaaataagaactttagcaacaatttttttttttttttttaggatttgagattagttattaataacacaggatgcaagactcttaggttgtagttgtgggtaagcataaatatatactgaatagattcagacattggccaagtagactcagtttttttcaggagatcatgttcattcaaagggataatttcttctttctgaaaaacttctattttgaaaatattaaatgatagaattccccctgaaattttttattgtgctgtttaaggaatggtattttacccattagtgataatccatgaatgcatgctatgaatggatacttaggaaacatttcctgcatgtccatggaaagataattatttttaatatttgtatggactgttaggcttttttctgtgagtaagatgtttttaatgtagaggtgtacttatagagtatacgatttttattgtattcttttaaatggactatttaatataattgacatatttcccatggagtaaaaacactatttagatgcttgtggtaacataactcctcaaatcttagtgacttaagacaacaaaggtttattacatggataatgtagatcaacaggaaactgctcattggaattgaagactccatgctgacactgatgggaggctccatccatgcacaggcactcacagtcaccaaagcagcataggaaaatatggtaatccttgcactggctgttaaagcctttctagaagagaaataacacttgcttatatttcattgaccaaagcaagtcatgtggccatgctaacttcaaagaaggtgggcaagcgcaatcctgtatgtccaggactggactattagggaacagcctaattgactactccagattgctactgacaacacttttttaaatgattgggataatactccaataaatgcctatgccatagtttacagagttagcccattttaatgtttgcagtgccaatagtttattaataatgctgaaatggacattttggtatagtcaccattcctccacactgctccttttctggggtacttaaactaatcctagattaagtctcctgttgtatagtttaatggactgctgtatgtctactttgtagcacttattttctaccaacacgctataaatttcatatagagaccacacctttttttcagtgctgtgtctgctaaccgttacataatagatattaaataaacattaatgaaggaatgaattaattggggaagtgggaagggtaaattggtaaaactactattaaggctttttctatatgtttccaaattgctttccaaaagaattatagcaaattcacatgtgagtcagcagtggtttatcagtttaccacccattgccaccactggttattttcctttgctaaatggaaagtcaaaataaataatatctcaatatttttagcactgtaattggcatatctttgattatcaataagactgggtatttttcatacatttggtttttgttattgtgataaaaacataacaaaagttaccatagtaaccattttttaagtgtacagtaaaatataactatgtgtacattgttgtgccacagatctctggaaacctcattttgcaaacctgaaactctttaaccattgaacagtaacttgtcttcaccctcctccaacacttggcacccaccattctactttttatttctaaaatttcgactacttaagtatacctcatataactagacttatgcagtatttgtttttttgtgactggttaatgttacttagcataatgttctcaaggttcatctatattgtagcttattgccagatttccttctttttaaggctgaataatattttattgcatatatatatgtatatcaaattttaaaatctgttaatccgttgacatttaggttacttctacgaacttggctattgtgaataatgctgtaatatacatggtgtgcacttatctcttcatgattctatttttgattcttttgaatatacagatgcttgacttacagttacgtcctgataaaacccatcatcagttgaaactatcataaggtgaaaatgcgttcaatacaactaaccaattaagcacaatagcttagcctagcctaccttaaacatgctaagaacacttacattagtctatggttgggcaaaatcttccaatacaaagtcaattttatagcaaagtgttaaaattgtcatataatttattaaatactgtaccaatagtaaaaaacaaaatggttgcattggtgggtttttgatgttggttatcatgacaaggtctctcactctgccacccaggctggaatgcagtggtgtgatcacagcttgctgcagcctcaatcccctgggctcaggtaatcctcctacctcaacctcccgagtagctgggactacaggcatgagccaccatgtctggctatttttttttattatttgtagagatggggtctcactatgttgccccagctggtctggaactcctgggctcaagtggtcctcttgccttagcctctcaaagtgctgggattacaggcatgagtcagtgtgctcggctgatgctttggttatttaccctcatgatcatgtggctgactggaaatggtggctctttgccactgccccgaatcataagcgagtatgttactgtatattgctagcctgggaaaagatcaaaatttaaagcatggtttctgctgaatacatatcacattcacaccatcgtaaagttgaaaatagtaagtcaaactgttgtatgttgaggactgtctgtatatctaagggcaggattgctggataatatggcaattctacttttactttttttcagaactgctgtcctgttttccacagcagctgcatggttttatattctccccagcagtgtacaagggttccagtttcttcacctcttcaccaacacttggtattttctgttttgttttttgtttttgtttggttttgatagtggccatcctaacaggcatgaagtgattatggtttttgattagcgttttcttgatgtttagtcatgttgaatatattttcatgatgctcgttagccatttatagtatatcttctttacatagatgtctctattcttcaagtcctttgcccaattttaagattggtttatttgttttgctgtgtgaagagagataattttactccaatttggatgccatttatttattgcctaattgcttgggttaggacttctagtactatgttgacgagaagtggcaggagtgggcctctgtcttgtttctgaacttaaaggaaaagctttcagtttttcaccattaagtttgatgttagctgtgggattttcatatatggtctctgttatcttgaggtaatttctttctattaatgaaattttttgtgtgtttttgtcatgaaagggtattgaattcttttcagtgcttttttttttttggcaccaattcagtcatgtggtttttagccccttattaatgtggtatatcacattgattgatttttgtatgttaagccatcctatcattccaggaatatatcccacttggtcatgatgtataattactttaatgtgctattgaatttggtttgctagtattttgttacgaatgtttgcatcagtatttatcagggatccttgtggttttcttgtagtatctttgtctgctttaggtatcagagtaatgctggcctcaaaaaaatgagtttgaaaattttccatctttttcaatttttttgtaagagtttgagaagaagtggtgccaattcttctttaaatgtttgatataattctccagtgaaaccatctggtccggggcttttctatattgggaggtttttgattacttacttagtttcctttccagttaccatattcccctattatctgagagttcactttctgcagtttcaggtactggcagtcaactgcaatctgaaaatattaaatggaaaattgcggaaataaacaataagctttaaattgcatgtcattctgagtagcatgataaaatctcccactgtcccatttcatcccacccagaacttaaatcatccctttgtccagcatttctacgtatacactactcccccattactgtataggaaaatacatggcatatagagggctcagtactattcagggtttcaggcattcactggcggccttggaatgtattccccatgtataagggggaactgctatattgctatgttcagattgtttattactttatgattcagtcttggtagatggtatgtttgtaggaatttattccttttagattatccaatttactggcatatgcttattcatagcaatatattataatcctttttatttggacatcaggtataatatctcctctttcattttgatttttgttatttgaatcctctatatttagtctgaggatttatcaattctattggtctttaaaaaaactcaatttttgttgtttttttctattatttttctattctctaatttgtttatttttactctagtctttattatttccctctttctcgcaactttgggtttagtttgtttttctagttccttgaggtgtaaagttaggttgttaatttctttcttccttgttaacgtaggtatttactgctataaaattccttcctagtattgcttttgctgcatcctatatgttttgcaatgtgaatctcaattgatagaggtttatttagccaaagtttgaggacatgcccaagaaaaacatgggtcacagtagcatttgtgccctgtgcttttccaaagagcattttgggaacttcagtatttaaaggggaaatagcaaaaatgaggctctgattagtgctcagcacatctacattttatttatttgttttaacttcttaaaattttactttttaaataaacatatggtaaaattgacgttgtatgtgagtacagttctatgaattttgacacatgtatacatttatgtaaccactgccataatgagaatacaaaacagttccgtcaccccagagaactccctcatgtcatccttttgtagtcaatatccctagtcccacccgtaacactaacctttagcaagcactaccctgttacccatcaccaaagttttgtcttttccacaaggtcacataaatgaaatcctaccgtatataatcttttgagactggcgtctttcactctgcataatgcctcgaagactcatccaagttgttgcatgtaaacatattattattattattattattattattatggctgagcagaattccactgtgtgaacataacccgttttgttttgttttgttttgttttgtttttcacccattgtagagcatttggctgtttccagtttttgataattaagaattaagcttctataatcattcttatacaggttttggggtacagatatgttttcatattgtaatgcttaggtaattcctagaagtaaggttgctgagtcaaccggtagatgtgcctgtaactttatgagaaactgccacactgtttgccagagtattttcaaatttcagccattctaatatgtgtatagggtattttatcatgattttaatctacatttttcaaatggccaatgatgctgaacatcttttcatgtgcttatttgccgaccctacgtcccctttggtgaagtgtctgttcaggtcttttgctcattttaaaaattggactgcttgttctctcaatattgagttttgagagtccttaatatattctgagtgcaagtattttgctggatatgtgatctgtaaatattttctcccagtctgtagtttgcctttttattcttttaacagtgtctttctaaaaacaaggttttaattatgatggtgtgatttattttttctgttatagatcatgatttacccctttagttataaaaattttataattttatattttacatttaaatgtgtaacttagtttgagttaattttggtataaggtattgagaggtgtagccagctgggcttctgggtcaggtggggacttggagaactttcctgtgtctagctgaaggattgtaaatacaccaatcagcactctgtaaaaacacaccaatcagcgctttgtgtctagctaaaagattgtaaatgcactaatcagcactctgtaaaaacgtaccaatcagtgctttatgtctagctaaaggattgtaaatgcaccaatcagcactctgtaaaatggaccaatcagcaggacatagatggggccaaataagggaataaaagctggccacccaagccagcagcagcaacctgctcgggtcccttccatccacactgtggaagctttgttctttcactcttcacaataaatcttgctgctgctcactctttgggtccgcaccacctttaagagctgtaacactcactgcgaaggtctgcggcttcattcttgaaatcagcgaggccgtgaactcaccagaaggaagaaactctggatacatctgaaggaacaaactccagacacaccatctttaagagctgtaacactcaccacgaaggtcccaattcttgaagtcagtgagaccaagaacctaccagaaggaaccaactccagacacagtatgagatttaggtcaaggttcattttcttgcatttagatgtttgaatgcttcaaacaccgtttattcagaagactgtcctttctctgatgaattgcctctgcaaatttatcaaaaactcagttggtaaaactgtagttgcccatgggtatatgcagcagagcagaactttctgaagtaatggaaatgggaatacacgttacagggtgtgttatgtgggcatatgcatttgtcaaaacatcaatttacacactttaagtcagtgaattttactgtatgtgagttatacttcaattaaaatatcagttggccatatttctgtaggtttatttctggaagtctattctatgctgttgatctacatgtttatctttttgccaataccatgctgtctttattttttattattttattttatttttgagattgaggctcgctctgttgcccaggctggagtgcaatggtgcaatctcagtcactgcaacctctgcctcccaggttcaagctattctcctgcttcagcctcccaagtagctgggactccaggcacatgccaccatgcctggctaatttttgtatttttaatagagacgaggtttcaccatgttggccagtcttgtcttgaactcctggcctcaatcaatccgcctgcctcagcctcccaaagtgctgggattacaggtctgagccactcccggccaaccatgctatcttgatctcaattactttagctttatagaaaccttgatgaagtggaaaagtgtgattcctccaactctgttctttttcaaaattgttttggctattcttgtttctttgcctttccatatacctttagaatcaccttagttctacctacaaaaatcttgttgggattttgattaggtttgtgctaaatttatagattaattaggggaagattcacatcttcacaatactatcttccaattttgaacatagtatgtttttttcatttatttaggtcctctttatttcattagcattttatagttttcagcataccctctaattgtttacataaatatttattagatttatatgtaagtatttcaattttttggaattgttttaaatatcatttttggagttattttaaacagcatttaaaaaatatttggtttccagctccttattgctaacacataaaaatatgatccatttttttacatgtactctacaactttgctaaatacattcattagttgtaggaggtttgtatgtatgctatttcttgggatttttcatgtaaacaataatttcatttgtgaacagggacagttttatttcttcttttccagtcaggatatctttatttcttttccttgcctgattgctctggcttggaattccagtatggtgtgaaataggaatggagatagaagtttgccttgttttcattcacaggaggaaagcattcagtcttcatcattagatgtgatccttgttggttttccaatgatatgtcctttattaggttgacaaaagtctctttttgtagcaaatctacattttacatgtcaaaagagggagtagatgaaaaaagtaaattacatattcatctcatactcagtgaatctacattttactaaataagttgaagtaaacataaaaagaggaagcagaggaaaagtcaattatgcattaatctcagggtaggtgaagagataatttctggtcttgtccttgtcctgtacccgcaaagataagctggtagttgacattgtgagggtgagagtcaacagagctcagttttagggctagtttataggagggatatagatcctgaacgatttagggcctcacgtttatacttattgtatcttccctatgaattggcccttttattgttgtataatgtccttttttgtttcttctgacagttttgacttaaaatctatttgtctaatattggtatagctacctctgttctcttttggttactatgtgcatggaatatctttttccattctttcatttcagcttatgtgtgccattatatctaaagggaatctcttgtatacatcagatagtgaggtcttgttttttaattccttcagccattctgtcttttgattgaggcatttaatccatttacattgaagcaattactgattgggagagactttctgttgtcattttgttaactgtattctgtatatgttgtatctatctattcctcttttcctttttcctttttatttgctgccttcttttgtgtttcattgatttttttttttttttttttggtgacatgctttaattcctttctcattttcttttgtatgtcttctataggtattttctttgcggttgctatggagattacaaaaaacatcttatagttgtaacaatctattttaaactgttaactacctaactttgatcacataaaattcctttacatcccccgtcctactttgttaccaatctttcaaattatacctttttatattgcatatccaatcaagctttcaaactatatccttttatattgcatatccatttatagagttttataattgtagttattttttaagcttttatcttttaaattctataccagaatttaaaatgacatacaacctaccagtacagtattacagaattctgtatttgtctatatattgacctttaccagggagcttacattttcatatgctttcatattgatatctaggatcctttcatttgaaggacttccattagcatttcctgtaaggcaggtctagtggggatgaactctcccagcctttgtttatttctccttcatttttgagtgacagcttttttggccatggtattttgtgttggcttttttttttcttttagcatgttgagtatattatctcacttccttctggcgtataaactttctgctgagaaatctgctgataatcctatggaagatttcatgtacatgatgacttacttttctcttgctgtttttcaagattctctctttgtttttgattttgacagtttgattataatgtgcctcagtttaggctcttcaggttcatcctagttggagtttattgactttcttgaatttagatgttctttttccccctagatttgggaagttttcagtcattattttctcctttctctcactgttctttctcagggactctcataatgtgtatattgatctgctcaatggtgtttctttctttgtttcttttttggctttgactagaaaatttcaaatgacctatcttcaaattcattgattctgttttgctcttgatcaagtgtgctgttaaactcctctggtaaatcttccaattcagttgttgtattcttcagctcaagaatttgttaggttcttttttaaaatagtttctatttatattctcattttattcattcttcattttttggatggtttattttttattgctggttgtctgtacacccagttaactctttaaacttctttaagatggttattttgaatcctttgtcaggtaatttatagatatctgtttttctgatctgcttttggagatttattttattcctttgattgggccatgttcccctgattcttcatatgcattgatttttgctgggatttgggcatttgaaaaacaactacaacaaccagctcttccagtcttaatggactggctttgtgtaggggaagacctttaccagtcagcctggctagagattctgagggtctctgcgaccttctctggagatgtgtcttgtctgggcttgcatgtaatttcccaattagagaagtttgctaatttctttttcaacagtttgtgttctcttgctttctctgtgacactccacagtactgtaggttctccggtacagcaagaaaacatcaagttcttttgttctctgcagccctagatgtccaaagtataccagtttcccgttagagtctgtgttaagcaaaacagaaactagtctcttaggcagccccctgaaaaactggaacactggatgtgcattcactcctcttttcctcccaaaggagaagctctgagtaggttgttttctcccaattcattgagctgtgccagcctggggaaaggctaagaatagcaaaataaaatgacttttcctacctgttttaattctgctgttcttcactttgtatttgcctaggggcactgtggtttcataactggtttctggaggtcttataaaggcattttgtacaatatattgttggtaagtctgtggggggtgggcagggaatgagatctggggcatcctattttgtaatcttacttatatcacctcccaggaagatcaaattttatacttatcagtgtatgagagtagaaatgtcattgtattggggggtcagtagataagattccatatctgtttctatcactaatgatagaactactgctaaattataaaaatgtaaaatggtgctagaatagagattagagtaacatatttttgaaactttaaaatctgaaggaatttactgcttaacttctgcctactttcagggtattaatactagagaaatttcctctaatactttcctttttctttttctttttcttttttttttttttttgagatagagtcttattctgttgcccaggatagagggcagtggtgcagtctcagtttaccgcaacctctgcctcccaggttcaagcaattctcctgcctcagcctcccgagtagttgggattagaggtgcatgccaccatgcctggctaattttttgtatttttagtagagatggggtttcaccatgttggccaggctggtctcaaactcctgatctcagatgatcctcctgcttcggcctcacaaagtgctgggattatgggcatgagccaccgcacccagcctctaatacttttctaattatgaacctgatgaatgcttagtaggatatatatgtaaatcatctgcaattcattcaacatgagtaattactgttaacattttatagtattttctttacattttgtatgtatctgtataatgtattcaaaattatgtatatttaaatgttctctatacacagatctgtttgctctctgatcaccaggctttatataataaactttttttttcatgttaaacattcactggtttttcaatatctgcatattttcctaataatatattgctgtaatatacctcatttgaccatgtaaccatatctcatatttctattttgggaggttattataaatatggggccatgaaaatgtttgtagaaatattctatatgcttttaaaatatcctgttttcttcaagtagattgctggagatggaatttctaggtcaaagaataatgtggacataaatgattttagaactttttctacctttgccagttacctttgaaaaagtgtgagagtgttacattgcttttgtttctcatgaatactatcttttaaaaattttagctaacttgataggtaattttatttgtatttctttgaacattaattctgcttctgtggcttgtttattcttatcccctttgcccttttctttattgtgatattggaaatgtccctttcaattagtttttactctttatttattaagggtgttaatactttttttagatttgtggtaaatattttcccctgattcgtagtctgcatagcttttaattgtcttatgttattgtgggttgaaacttttatttagtcaaatttgtacaactttctttagtaacttttttcctttgctgttgtgcctgcagtcacacaccatccagatattaatcacctagattttaaattttctatatatatacaaatttctgactatactatattccttctctatgaataacctcttttaacatttttttgatgggcaaatttgctggcaatgaattccctcagtttttgtttgtatgaaaaagtctttattttttcttcacttttgaaggataactttgctgaatatagaaatctatgttggtggactccccccatttaacacattaaatatttttctccattctcttcttgcatggtttctaacaaaatgtctgctgcaactttcatcctctatagatgtttccctccttttggcttctttcaaaatttcttatttgactttggctttcagcagtataaatatgatagcccaggtgtaggtatttttgacatttattgtgcttagtggtggtctctaagcttcctagattggtattttggtgtctgtcatttattttggaaagttcttggtcattattccttcaacatttcttttgcttcattctttcttccccttctgttcagttacacacatgtcgcacctttgcaattattccacagttcttggaaggtcgctgctgctgtcactgctgctgctccttcctactcctcctcttccttgttccgcttctcctcctcctcctctctttttcttctctgcccacctcccactctgttttcttctctctttgcatttttatctgggaggtgtctattgagctatcttcaagttctctgattctttcttcagccatgactagtctcctcatgagcccatcaaaaacattcttcacttctgtttgtctgatttctagcaattcctttagattctctcttacagtttccatttccctgttgacattacctgtctgttcttgcatattgtctgcttttcccatcagtgttcttaacatactgtgatagttaattttaggtgtcaacttgactttagaagggatacccagatagctagaaaagcattatttttgggtatgtctatgagggtgtttctggaagaaattggcatttgaatcagcgtactgaataagaaagatctgccctgccccaatattgacaggcaccattcagtcagctgaggtcccagatacaacaaaaagggagaggagaaatgaattcatattctctttctctccccttctctctcttccttcctccctctccctctccttttccctctctccctcccttctagagctgagacattcatctgcttctgatcttgaacatcagaactccaggttcttggctgggtgcggtggctcatgcctgtaatcccagcactttgggaggccgaggcaggcggatcacttgaggtcaggagtttgaaaccagcctggccaacatggtgagactctgtctctactaaaaatacaaaaaaataagctgagtgtggtggtgggtgcctgtaatcccagctacttgggaggctgaggcaggagaatcacttgaacttgggaggtggaggttgcagtgagccgagatgatgccactgcactccagcctgggcaacatagtaagactccgtctcaaaaaacaaaaaaaaccaaactaacaaaaaaacccaaaaaactccaggttctccaccctagggattctgggtcttgtatctgcagtcccgcagtttcttaggccttcagccttggactgagagttacattgttggctcttctgattctcaggcttttgagcttggactgagccatgctaccagcttccctggttctccagcttgcagatggcgtactatgggacttcccagcctccataatcagatttaattcccctgatgaatcccctcttgtctatctatttatcctattggttctgtttctcaggagaaccctaatacacatattaatcatagttattttaaatttcctatccgataagtccagtatttatctggtttgattattactttgcctcttcaaattgttttttcttgccttttagcatgccttgtaattttcattgaaagctgaaaataatggattgggtaatagacctttagtataaggttttatgttaatctagactagattaatcacagactacagttggcctgtgtttagtatttgctgtagctgtaggtgccagaggcttcaaattcctctggcgtcattgtttcagtctcccctgttgtctttgggattccctaagaactcctcagatagagtttgcatcttgcagctcttttagacgtaatctaatgtaatctgttattttactggtgaggtatggtgctaaggtgtagggaaggggaaacattctgtaatcttaggactacataccagtttcttagtgggcttgcattcatggcctatgaccttcacaagtgtttcttagcttttattttcttaaagaaaaaaaaaaaagctcccataatgagataggaaggctagagggggccagagtaggaggaatgtccttccctcaggtggataaggctctggtaaagtctttttggattccactctggagagtaggcctttatttttgaaactcctctgggcatatttcacaatagttaccattagggatggaatatttgtgtccccccacgcccccgcaccccgccaagtttatatgtggaagtcctgacacccaatatgagtgtgtgtggtaggctgcgtgtggaggtattgggaaattcaggttcccaaaagtttggtcgtagtgaagtcctcagaggtcttcttgagtctttccttttcttcaccaaaggctcactgacgtcatccatcctcctgatggaggtcaaagcattaaagtcatttttctccctaggagcgtctcccccattgccaaattgccaggctagtattagggagaaatgtcctccctgaatttcattgttgggtttttttttttttttttttaaaccttattatggctttaatgttgaaatttctgttttggactttttagcatgacacatacacacacctctcattttattttcattgctttttaaactcccatgtccaatgtctattttaatcttatgtttggcagcctgaaacattttatttctaaaattaattctctaattatacaacatctacatggcttgtaatgacatcagtagagcagaatctagaatccaactcaaggttttcgttttgttttttaagagtaagtaacttattttgatcaatgtagtaagaggagattgaaaggtaccagtgtgtgtgaaagtgaatagttgcttcctctccccatctcctcttcttcctcccctgctcctctcctcttcttcctccccctcctttcctcttcctcctcccccaacccttcttccttctactcttcctcctcctctgcttattccttcatcttaactcatccttcactaaaaagagttatattagcattagaagtattccttaatggctatacttttcagatattataacttcagaattttctagccaataacaggattctagggcaaatgtcatgtaggatatggctcttcgagtaccaacatggcaagaaattgatttcctctattgaagacacattgattttcagctgtactgaaaaactcacagccttccagtatcgacaaatagtaaaaattgacttcacataataacacctttatttacctagccttgtgaccctctgattttgttagatgatcctatggtgaaagaatgcaccaggaccaatgcttggacaaatagtaagtctccattttctttatagtagatgcttctacataaaattccgctttgggcagtaacttgcgtagacagctgttcttgtgacacgacataatgcacactgagcacggtgacagctccagacgatggtctactctggagtttccaactggactggtaatctactggatactctcatctggaattgtctcctagctgagtggttaagctatagaagcccatgattaaacaatgttgtttctggaaagaataatagaaatggttattattagtgagtacttactgtctgccaggccctgcactaagggctttttatgtgttagttttgtttaatccccacaatatatctaagaggtattatcccccttttcccgtgaggacactgaaggtccaacagctaataagtgaagctggcgatatgtcctgttttagctactaacatttatcagcttcatcatacagacatactttgtcagattggttagccaggcaagtgaccgctgagagaatggggcacaggagaagtaagtgatgactgcgaacacaggctggacaaagatcactttcttatacgagtctgcagttcttgaaataatacctatcagatatggcattaacagtgattggtagccttatccaaatgcgatatttgacttttgccttcatatcatggtttgaatttacaaacttcatttctttttctttttttttgagatggaatctcgctcttgtcacccaggctggactgcaatggcgcgctcagttcactgcaacctctgcctcccgagttcaagtgattctcatgcctcagcctccagagtagctgggattacaggcatgtgccactatgcccagctaatttttgtttttttttttttttttttttttagtagagacagagtttcaccatgttggccaggctggtcttgaactcctgacaaacttcagatgggggcattgccttaagtgtatgatgcccaccattgaggtagactaccacatggtacctggatgagcatcttatgtttcaccaaaccagaaatttcccaggcaaagtgaacggaacaagagagactgcggattcagacgtttcctatgcagttatacttctgaatgggtagtcacagtgtgttcaagggtaaatgatagctaaattatcacccatctttaaatgttttcactttaacggggttaccaaatcgctctttaaacttgaatttctatcaagcttcagaaccataaatgttttcttagaatttttccaagattatctgaatcagtgagtcctttaactcacttctccaggtatcaaaagtcttttaagtcttttttctgccaaaggtgaatctatgctaacgccttctagtactgattctcctttccattttcccatgcaccctactgctttctgtctccctttgcaattcaacagaaagagaaatcatgaggcagtatgaaatgaaggacttttctgggctgattttccttttgaatcagaatggaaatttatggtcatagtgctttccatgaggtatttagaagtttccagtcaatcattgctcttatcaggggttcttaaaggctttgggagatactaggttagctttcttacaatataggctgccctttgttacagcgacactttctttttgcagattttttttttcttaacagagaaaattgagatatgaaattatttccttaatctctacaataatcaaatcataattatttctattctattttttaaacttttaaatttcactaacagtacatagccattgcagtaatttttttaaaaaatagagaggagcttaaaaataacaaaaacctctataatcccatcacccagagatgagttttggccccattcatctcacaagttctgtgcaactattgcatttcatgttgcctattcatattaagagaatagcattacttttattatgatgatgatttgtaaacaatttcccagagttaattcccagacatttaaaaattttggccataattgaaagtcaggattttatcttctcagttggaaagtagaagagaaaagtataacagtgaaaaaaatttttcttaggtgtgtatttgtgttggattgttctaatttcaaaacagagaaagttttgaactcctgctttcatggttcattcttagaaataaatagaattgttttcccaagaaaaccttggaaaactttctagtaatagcaggaggaatatgggagtaggaaatggcaagttgaaggattttaatttggaaactgccaccttttggaatacagaagagctggttatgggattggcccctggctttacttgtccttaacatgggctttgataaggggaaaacaaagtgagggcttcgagccacaagtcaaggtcttgggaaagcttagcaaaatggtgcaagtctctcgtgatatctacctttatgcttactgctttctattggcaaaaatctctcatcttttgcagatgcactgagatcccatcagtagacagagaaagaacgtgggtgagtcagaagcaatcagccagaagcacacaaatgggtgtggacatgtcactgccaacaacccacacagagtggctggctactgcattcacccttaggatctcctaatgagcacagttaacagtagttggagctttgtctctgacatcctcttgcagtcatctgccttatttgctgattgatttctgttcttgaaactctgaacaggaagccttctgttgactcatccctgcttttcagactggaaagcacttgtaattttatctgccatgtatagtctctaaaaatttattttgaagatatgctgtatcaaaagcaatttaagaaagtaggaaggtaggaaatataacaaccaaaaccaaacagtgacactaaatatatacatatatatagctgtacactagacttaacctaaactgaccagctagatgattttgatgcagtaaagacaagttaagaaaatttgtctttactgtcaacaagacagtaaacttgtctctatgtcaacaagaaaaaaggcaattagaaattcttggaaaaacagaaatttgcaaatgaagtcccaatttaatatgaggtaaactgaaatgtgacagaattctgcataattgatggtatataagaaaaaagaaaaaagaatacattggaacttgacgcttacagctagtatggtgacaacggactatatctcctttaactgatttagtttcaccatctggaactgcactgaataaaaatatttacctaattgtaatactgaatatattttattagttttcatttttcataattaacctgtatgcaaagcatggaagataaattatatttgctgaacaaaatggaaatattctaaaacttgatgttgtaaattaatgcttattataggtgataaaatgtaagggggggattgaggtggaatggagtacaagagcatatgttttcttctgtttcatagtggatggttgaaatggtactctttagtcttgatacatagagaagtagagatttaggaatatgattacatgattaaggtaacaaatgaaagattatatatctgaagaggacagaggggaaaggagatgctgtgtctcaaaattgtgttctcctctagcagggaatcaatataccgttgacccttgaacaacacgggtttgaattcaggagtcctcttatatcccagtcttttttaaaccaaacatgaattgaaaatacagtattcccaggatgcaaagcctgtgtatagggagggctgactttgcgcatatgcagattctgcaggtggactgcaggacttgagtatgcctggattttggtatatgcaacaggtcctggaaccaatcccccaagtgagtatactgaggggcgactggattgtttcacttttgtagaggcatatgggagttaggcagccttgtgcttttcatactatgttcttgtttaatttctggggttttttgtttgtatttttgttatccatgtacatcttttgaaactgaaaaaatggtgatcagatgatttacaagaaactttgattaacaattatactagcacaactttgttaaatttccctaggagaagacaacagcctcaaatgcagtgggaaaaaaaagcaaaatctgcctgcttccacattgttttcaaggagagcacttgaacaaaatggtactatttggacaataaatagatgggtaccaattctagacaagcacaagcaaaaagaaaacagggctggcagtattcgcatgggggcaatttcaagacagaaagcattaagtggacaaaaggtgatattttgtaatggtaggggttagaatccaccaagaatttatacagccatggttctttacgtatggaaaattagcgccgaaattggtaaaggaaaaactgttaggagataaaagaattaaagaataaggcaaaaaatattagtacttagaaaattataatagccaatggtataatttaaggtatgaaaataaaacaaacaaaagtctgcacctgcaaaggaaacttgaaaggcagggctgttggggatggggtgtgtgtggcggtgaaaggggtacagatagtttatcctaatcataggttttaatcactttcttgtagaaggaaggaaaagttttatttctgtgacaccatctcattgtaaaatccagtaaaattgaaaactttgagataaatgtattatcaggagttacagccataacttttagtatgtgagctataaattctgttcttatcactaagtcactgagaactaaggctgctgattttcccaacatagtaaaacagagcgacctgaccaaaaaatgaaaaacatttttatggacttttattctccttcctgcaaccctaatctccttccttcctctatagattctagtctatctaagaaattctaggtggatggtttgctttctctgagggaagctaagattgaggccaaaaggagatctgctaggtacctgtgcaaacgtcaggtgggacagtgaatagaaagtaggcatgcaggggaccgagaaagataggctctgggcatcacaaacagcttttccaactctagagacttgaaaaatgtatttggagttacatctaagtcagaagagtacatcttgtttatccccccaaaaagcctcctggtatataccttttagtcaaatagcattgtgatcttgtcacaatatatggacaacagatattttcagttcatttgatacttaacatagaacatattaatgtgccattttatcagaaacctgtaaaggagtttaataatggataactagaatgaacataagtggtagcaggtccttactctcatcccccctcccacttttcataatgtactgatttgaaatgttcgtgaaatcaatacagacaaattaactcagtgagcagcttctccccagtctcttgctgcagtgatgagaagcctctttctggatctacttgtttccagatggtagacaaggcttattctgacacatggactgaaaacagggcagaccagcagtcggaatcttccctgcttagtgtcttaatctatagtaagacctcaaagaattagattccctagcatgaggaatttttcttactgaattttttaatgccactatatggcagtgattaaatagcaagttcaagtgattaaatctggtccatctctatacttttcctttacaattgctatcaggttttgtaagtaaggaagtggaggcatttttgtaagtgtgttaactctcaaagcccacaaaagtatgtttttaaacttagggatcaagttgtgtggatccgatttcagacccccagaggttcttccaatgtgtctaatgtccaggacagtgcacatgttcagagtttcattgtatttttctttctttctttctttctttctttctttctttctttctttctttctttctttctttctctctctctctctctctctctttctttccttctttctttctttccccctccctccctccctccctccctccctccctccctccctccctccctcccttccttccttccttccttccttccttccttccttccttccttccttcctttctttttttgatggagtctcgctctgtcaccaggctggagtgcagtggcatgatcttggctcactgcaacctccacctcccaggttcgagcgattctcctgcctcaacctcccgagtagctggggctacagctgcccaccaccacgcctggctaattttcgtatttttagtagagacggagtttcaccatattggccaggctggtctcgatctcttgaccttgtgatctgcccgcctctgcctcccgaagtgctgggattacaggcatgagccaccgcacccagccagcagcatgttttctttgaagtgttgttcaggggtctcttgcatcagaatgtcctgaactgcttgttgggaatgcagtatcctgatcctaccctccagattctgattcagtaagcctggactgagccttggaaatctgcattttatttagcataatgtcctgggggcttgggggctccccaaagtttgaaaaccaccgctaagggctattatgtttctgtaggcaaacctatttttctgttttcattttatgtcatacaaagtaggagtttaagaatttatttttggtgaaactagaacactgtcttcaaattaataagagccttgttgtgtaggagaaatattctcttcaaaatctctccacgaaattgatctcaaaaagactggctgagtcaaatgctaaacagatctgtcctgtatctggctgccacctgtcaaaattgctgaccttacacttatgtattcaaatgcttcctggaagtcaaaacatattttcaaaagtttctagtggaaaagaactaagcctgtcgcttggttttaaaaggtggaaattgagataagaccgaatggttgagattaatttcacatcacaagaataggggtgagaagagaatagcaatttccataacttctatcatttatcttttaggttgaggatactgtgaaataatccttccctttccaaccaacatgaagatgactgatacacccatcatactgaaggattcctactgtgtcagagattacattatattaagtccttacagaaatataaagagtataaccttcaaaaaactgggaattgttaaattatacattggattttgggggctattgtttgggaggttttgttttgttttgttttgtttttccttctttcataacagttcgctcaattaactataccagaggcatctttggctgcaaaggtggaggaatcactgtgctcgaagatgacagttctacaccttggcctgacagttttgagattcttgcttctaaaataagatggaacctgaaagatgggatgattctagcatactaagtatttgactttaattggaatcattgaacgtcccttgaattttttttctcattggtattggattctgttgtctttactgatggaaatttcttttccttccattcttggttcatgacaaaccaccaactgtccacgcatgatctcctttcattttacttgtatttgaaatgaaaacctgtgagtgcaatgcctaatctaagaatcagaacattattcttttatacccctatctctgtaattctcctttatcttactccttcacctccccatccctctgccaccagaggtaaccaccattctgaacattgtttatcattctcttgcttcacccctacatatctacatgtagccttaagcaatacattgtttcattttgcctggctttgaactttatgaagaggtatcatccctggcttatatgatctcttgagacttgctgtttcactcagccttatattcctaagattcatccatgctgtcattgctgtgtagtatttttatttgtgcttatactgcagtttttctataaatgttagtataggttatactatgatttatcaatactcatgtcattgggcattcagggtgtttcctgtttttgtatctatgagcagagctgttagtaagcatttgcgtctcctggcatgcatgtgccgaggtttcccttgtgtctatgcttagaggaagtacagcaaccactgctgtgttgtggtgtatgaaatcattcaactttacaaaagaatgggaaagcgctttcagggtcgctatatccatttacacttccaccagaggtgcagaaaagatcctatcagttcacctcttcaccaactctttgtattttcagacatcaattttttttttgccaattttgtgtttataaatctactgatatacttcttaagtattttatctatcccttaggaaaaaaggtaggaaatagaatgtggttgccttcacatagagaggctagaaaacaaagtatcatgcctgcttagtttgatggcacccaaatttttctcccagttatctcactactagtagttgacattcttttctcaccctcgctagaaatatgaaaaccttgcctctgcacagtggaatcccttggaacatttaaaaaatgctaatgtctggaccccacctccagagactctgatttctttggagcccagcattgaacatagggatttttttttttaaataaaagcttcccaggtgattctaacgtgcagtcaaggttgagaatcactgctttaaaatacagaaatcttgacaagcaagcataagctcagggtagcctgatattgttaattgttctttttctcatttctaaagtacaaagtttgcataattttggagaatcctcttgcctctaatttctagctcagcagcctttgagagttttttggtttttgttttggtgtttgttgttggtagaagtaaatagtagaaattcaataaaagttagtatgggctagaaattgtgcttgacatttatttttttcttataactgtggatctcaaagtttagtgtgcataagaaacacctgggaagcattttgttttgttttacaatgcggattttgattcagtaagtcttggcgtgagcccccgggaatctgtgttctaacaaagtgattatgatgtaggtggttctagaatcacctttggataaaaactgcctcataataatcctacagtataagcagtattctcatttacagatggggggatgtgaagcccagagaagttaagaagcctgcgccgtgtcacagagctccctaggggactagcctttgctctgtaagctctcagccctgctcatagtatgcctccaacaaggctctcagaatttaggaaagtctgctttggaacatgtgttatcttctctatacttacattctttcttaatctgccatgactttctctcctcatcaaaaaacagcctttaatctcctacccaaatccacctcgtacctgtgagtcttcaggtgtgttacactctgaacatggtcccgtgagagaatttcttattaaaaattgagcttgcaaaaaatcaaatgtgttatatttttgttcttatttcaccctaaaacaatgactttagttgacaatcacttttatgcaaccttagtaattatttctaaactcatgtacaagtggatggaagtatttctgtgcacatttagaaaatttatattcattgcttgtttccctcccctgccaccccacagagtgaggactttaccatgaaatctgggcctttggcctatgtatttttaatcatgttcatattgtactgtatctgcaaccatctgtaatacagctgtatatgtttacatgaaacacaataaacttttaagtttaattccatttgtgagcagatggtagcttgtcaaggaaacatttgatcatgtttatgtctgtatttggccacaaaaacctcataattactctcattaattacatatccttttcatgttacctgtaataaatgctaaggtatcatatgtgttggccttgtgggatatatttttgtatgtagagacagtcctcttaagaatgtttgcggcctggagcagtggctccgacttgtaatccaagcactttggaaggccgaggcaggcggatcacttgaggtcaggagttcgagaccagcctaggcaacatggtgaaaccccatctctactaaaaatacaaaaattagctgggtgtggtggcaggtgcctgtaatcccagcttcttgggaggctgagggaggtgaattgcttgaacctgggaggcagaggtttcagtgagctaagatcgtgccattgcactctagcctgagtgacagagtgagactctatctgaaaaaaaaaaaaaaaaaaaaaaaaaaagaatgtttgcttctgtaggcacatttatgtctacctattatgatgtcaagggtgtattccagtttgtatctgtagctgctacaagaagggtgtcatgggatctgtggttacactcttactcttcccatctgggtatttctgagtgtatttgctccaggagagccactggttctgctggcctacatgcaaagtgtatctatctctctgttaatgcgtttcccatgatgatactcgctgctgagatacttcctaggaagttttgctttcctatcacctcctttaagtgctttcctttaagtgttctcattttaactcattattaaactagcagacttgattgcagtgaatttttcttaaataacttaattgtagggccttttgcgcgtcattttgtgctcctacttactgctcagaggtggtacaaagtcagcagctcaagagacagacctgccacccatgatctctcctccaagttctcaggatgttcagaaagttaaaatttcactctgtcgagtttccatctggcttggcaatcaatgccggattagctccaaatactctttccaagtctcttgaaggatgtgctagcctctgttttgaattctacttcaggatcacaccatctctgcatgcaagaatgacatatctgagtgactgccactaaacccacatggtggaagtgtttgcttatcctgctatgtgatgctggctatcatattgtcagtttatgaggtgtttttttttttttttgcttgtcttcttccatgtaagtatttccagagcagaggcattggcttgcagaaggtgtgcctgcaatcagtccagcttccccagatgtgctgaggcttcaacaggggtttttaaaacttgtgctagaatactcatcttccaaaaaatctttaagttgatgcaatataatagctgccaattgagcatacattttgaggtagttttctttaatgggagtatatgctcatccacactctctttccagtgttaaatattttaagacagctggttagagttgagggtgccttttttttggtcataaaacgatgacagaactctaaaatcacatggttatttatcaacattaaaaacattcttttatatccattaattaatttattctttataacagcttctgtggaataggtatataaagggtttttttttttgtctactgttatttaagagtatcataaaacctgagaaagaaaaacataattagttgtcatctagtctaatgctctcattttgcagataaataaattgaagttcagagagatgaagtcactcacttatggacctatagctagtgaatggccctgaaattgtttcccagtcatggctggaggcacaactttgtctgagacctgactgatacttttgactatgtgatgttgtgtcaattatctaacacttctggacctcagtttctttacccatattatggattattgtgaatattatattagactacatccaagaatgctattaacccagggcctaccatcaaataagtagttaatttatatcagccacttcacagctgcacttatttttatttttattttttctgagacagagtctcgctctgttgcccatgatggagtacagtggtgtgatcttggctcactgcaacctctacctcctgggctcaactgattcttgtgcctcagcctcccaagtagccgggactacaggtgccaccatgcctggctaatttttgtatttttagtagagacggggttttgccatgttagctaggctggtcttgaactcctgatctcaagtgatccgcctgcctcagcctcccacagtgctgggattacaggcgtgagccaccgcgccttcctgctgtgcttattttcaatactcttttctcagggatcttggtaaccagagcagaatggcagtttttcagctcttacaatgcctttgtttagaagtcttgtatgtgtatatctgctccatcacttaaaagttctcctaatgcaatttggaagggtttaatatggaacaagagcagggactttgggatggagtctaatgataacttgtcacatgttcttttagaagctgaattaggtagtttttgccttactggtgcgctctcatttaactgtgaggtatcctggcacttcaaacaggtaccatatggtaactgttttgtgttttaagcctggtactgtttagaacacatgcttcagagagtggtcattgtttcgctgccacccagttaaggcatgtgttacctcttgttatggatggaatgcctgtgagccctaggttcctatgttgaagccctaacccccagtgtgatggtatttggagatgaggcatttgggaggtgggtaaggttagattagctcatgatggtgggaccctcttgatgggattcatggccttataataagaggccatgtgaacacagagaaaaggtcatgtaaggactcggcagaaaggtggccatctgcaagccaggaagggaggcctccctagaagccagacactgcctgatcttgatcttggactttccaggcttgagaactgtgttgtttaagcccctcagtctgtgatattttgttatggtagctgggcttgaacagactgagagacctctgctggagtgtgcgttgttcaatgatttacttccttgtttgcctacattatacactttcactatgtctccacgatggaagaggcatgactgttcagatgcatcggggttcgtctctacctaccaaggtcctgtgccatgaggagatgtcgggccagggactcaaacaggagcagtcatccaactcctttctattaggtctttggtgatttaaaatctcatatgaatcaagagctggtagagtgctaatgttcacaggtttttatagaacattaaagctctgtaatagttattttgtatgttatataaataatttccctgcaagtatttattcatttactcttcatttacataattgcttataatcttttttaatatattcttgtcccctgcgccacccctcccaccttttttttttttttgctgtggttcatatgcttttatgtaacctgagctataaaagactagaatactgcagatattctatctgccatgtctgtcattttcttatgatgggtacttagtctaccgtatacaaatttctgtatagttaccaatgtctttttagctatttattaatcttatcttgtttctttggcttctgaatcactttgctgaagttgaaatcatctgaggtcagagccagtttttatttaaatagactgaatgcagctaaacctggattatagccaagaaagatcttacaccaagtgcctacaaaattagaagcattgccaaggacgcatcagcagagtgttttgcttactgaagtcttattctgaaataaatttgaggccctggcgatgggagcttttggttgttattggtagacctcctaaaaaatgtaatgtagtttaattttacttttaatttttttagcatgaactttctccttcatttcttctttccagagatttttgggtctatccattggttgccatctatgtgttcaaacatgtgactaggtagaagagaggtaaacaggagtgtattcacctgttatcatggagaagttattattcaagacctgtaaggggaatgtggcagtcctaaaggctgcaaatattctggcagcattgtaggattgcactttccctcctcctctgaaggtagatgggagccatgtgtcttgctgtggctaatgaaatgtgagcaaagtgttgcaagctttaagagccagtgcatgattcatcatgttcccatcccattgccacagtgtttgtgaaagcgagtgttgagatggaccctttgttttctgggtccttaattgactgtggtaagataaattattgacaacctgtactagacatatatcttcagcagtatcctttggttgggattttgttgagataagggtccgtgatttggcatactcagtgtaacctaacctattctgattcttatagggaatcagagaagtgtccttacactcagggagcttgtgatttaatatagttgagaagatgtgtttgcataatgaagaaggaaccagctgcttaactgtactctttatttagccacattactgaacaagagacaagctgattatagcataatattgagattttgagtatattcctgagaccctggtttcaactggaaaagtaactttttttttttccttgacactttcagatcacaattgatcaaaacacctatgcaaggaattaaacttgctacaaataagccactagatgcatgatacctttaaaaaagaccaattatgagttatcttttattgttctttttatattaaaaatctgcatgggaaatggaatgagaatatttataacagtacagatttgctatgatggtgtctattaatcaaagttctttattttttagtatgtggggacgacacatactcatggctaatattggtgaaattgctaattcattcattctttatttggtgattcactccacaaacatttattgggcatttggtataaaccaggcatagctctcaatgctgctggtacagcaagaaacaagacagagcctctgactttgtgtcttacattttagtgagagaattgggtaataagcaaacaaagaaaggtacagtgtggtatcaatgatgagagttataaagacaaagcagagaaatgagacagacagtgcaaggtgtgtgatctcacatagagtggtcaggaaaggctgctttcagaaggtgacatttgaacaagaaattgaagaaagcagggagaaaagccatgtgactgccctgaggaagaatccttcaagtggcataaatagccatttcaaagaccctgaggcagggatgtagtaggatgtttgaagaacagcaaagagaccagtgtggctggaagaagggtgagcaagtgaggagaggtgggtaggagatgaagccagagacgtggtcaagagccacagaaccagggcctgccctgcctctgatgaaaaggcactgggattttgaatgtgagagaaccatgacctgctttatgttggaaactgatgtagtctgtggagggcaagaaaacaaacagaccagcaaggagacttttgcatgagtccaaattggagatgatggagtttggacacagttggcaagtgtggtggttgtgagatgtgttgggttcaagatatcttttgaaaatattgctattaggactttgtgatttgttgtggactttggcctgagcatctgattgactgatgatgctattttctcagatgaggagaatgttcaagatgttgttacctatttaagagaaggtggccattgcatattgcatatgtgagcctggacttcaggggaaagtttaggactggagataggcggttggtcattcaatggataggtggatttgaatccatgagattggatgagattcttttttgtttgtttgtttctgagacatagtcttgctctgtcatccgggctagagtacagtagcacgatctcaactcactgcaccctctgccacccaggttcaagcattcgtgcctcagcctctgagtagctgagatttacagatgtgcaccaccacgcccaggtaatttctgtatttttagcagagacagggttttggcatgttggccaggctgatcccgaacttctggcctcaagtgatctgcccgcctcggcctccaaagtgctgagattacaatcatgcgccaccacgcctggcctggatgaaattcttgaggaaaggagggtaccgagaggagaaaagatgttgaagaactgaatctggggtgctcccaacagttagaggttgaagagctgaagaggaaccagtaaaggggaccgaaaaggagcagccattgaggagagaggacagccagacaagtgaagtgatccacagctacatgaagacagtgccaaggaggaaggagaaatgagaaatgaaaatactactgagaggttgagggcctgggctgagactggaacacaggatatagcagcatggagatcatggtgacattgacaatatcatgtcattgattgggtgggggcacaagcttgattgaagctggttcaagtgagaataagagatgaggaaataaagataggatatacgtttcttgagagatttttgctgtggggtgagaggtaagggaggatagctatttaggatgtgaagtcagaaaaatttaattttttaaagatgggggttatattacacttgaaagctgatcattatttagtagagataaagaaattgacagaagcatctccttaagtaggcaagaggggatgggacctagtgtaagtggtgggttggctgctgcattagctggagttaaggcattgcatgttctagatttgtacggagacatataggtgaatgcacacacttatgggaagatactgttattatcttctgcttgcctttgttttctaagaaatagaatcaagatcatcagatgggtgtgagtaaggggtcatttctaggagtaggagtgtaagttggccaagaaagtgtaataagattgctgagcagaactgaaagcacattgagattactatcatatctttaaagcaaaatcagccagtgtagttctttgtttttctctagattgtgtcatttgctgtggtgtagggagagagtctaaggattctctcgtaggtaatcatggtcatagttttgcaatctgaataatgtggaagtggagatgggcagccgtgcagtagggcacttgcaagggagcaatttttgggagtgccaaaggccaggctggaagaggtgaaggaggagggagtgatttttgggtggtgccctagaccaggctgaaggaggtgaaggaggagggtgaagacataaagtggggaacggaccatggagaggaggtcaagtcaatggatccagagggcactgatgccaaattgttgacaggcatgagagggaatgagctggaaattcctttgaaataaaaagttggcagctttcctcaagcttaatctcaaaagagacatttaaaaattacttacttttgctgcatggttggggaaaaatgtatttttcaagcatgagttcaactcattttgtaccagggtattcacactgatattcttgggtaagtcattaaaattagtcaactatttctgtgtcttcacccacaaaaggagacgtgtgagaagtgaatacttagtgattgttagattccactgaatctcactgctttgttgcagtttaacgagcaggctaggattgcagcgctgtcatttcagttgggccaccaagccttgaatgaggagataaaactggaagataaagtcttagtaggtacaacaaaagaagcttttgagagatcgttggatagatgtcatctatttggttgctaaataataacacacaaagaaatctctctactgtttatcatgtgtacttatcttgagaagcatcagtgattaaaaaaacaactttgaaaacataaaaatggtgaagtgtggcaatggtatcatgtggcaacggtaaaatgtgtttacccatgtaaatataatgtcacaaatgaatcttgtcattatattttgtagtatcttggaggttactggccagaactattataatagtcagattcatttcatatttatttaaaatccgcggtgttttcacatacattgtgtttttaggggaaattttaccaatgattaacatatattgtctagaagcagagccatctgaattgaaactcaaatataattgccacttttattaaatatacaactggcagactttgaaaatgttatctcagcatctagcattggcttcattttggtttctcattttcctattttattttgttcagtttagcaggggacagtggggaacagggttacaaattgcattttttcctgcattattggtttttgtcaagtggtttacaggccaaagtttgtggatctgccagaggctttatcccaaaactataggcaacagctatttcttgaaataattttagatagatttctacattgatttatgttttggggtatatgatgcacaatcccttaagtcttaatatgactattggtttaatatggcagaattaggatcaggttcactcattgtttattataatttacccatgcttgactacccaataaaatgtcttccctttacaatgatctttttctattgccatattcttcttgtccttaaaacaacaataacagatcctcaaacgtcattggggttaataaaagatgtttctttattttcagatctttaacaaagcttctccttaacccagagggttttcagaggagtaaagagtggaagtcatttgtacatgaattggcttttgaaagtggccctcattattttattttattttattttatttttttattatactttaagttttagggtacatgtgcacaatgtgcaggttagttacatatgtatacatgtgccatgctggtgtgctgcacccactaactcatcatctagcattaggtatatctcccgatgctatccctccccccctccccccagcccacaacagtccccagagtgtgatgttccccttcatgtgcatcattttttatgaagtggccctcattattaagccatgtctctgcctgttgattgatgttaactatctgcttatggtctgagatcagtgtgtactgcaaatgtttgggaagatatcttctttctgtggaggtgaaacttaaatatcttctataaaatatgcctcgatttcagaagtagcaattgtagcaatgcctgatgtgaccactttattactgccttagaagtacttttgtggtttgactgtggggagggaacgggtcactggagattttgctatctctccaggtttcatgctttgggaatcaaaggtaggtaacagtttggaaaaactctgtaggggctaaagctttttctaaaggtttttacgtctatatatacctctgtatgttactgcttcaagcccagcaactagcaattttagtttcactgaaattgtgttttctttaaatacacaagataatagaattgtaactggaatttacatgttatatataaagatatattttatttaatcttgtcagaagggttttttttttttttttttggtgcttttaagctaatgtggcatctttctcttttcaaagagtggcatctccaaggaatagctctgcctggaaggtgtttgtggctgtccacttaaaagctgaaattaggtcagtgttattttgtcttgagataacaaaaataagaccccaagggagtagtgacttgggatttcatttaagtacttaatttacaggaaaaaaaatacagtttccgatactgaataattattacactactgaataattatatattttttcttctcccggtgttcttatactttagaggcaattttttttttttttttgtaaagatcacaaaaggtctgattagtcaaagaatgaaagaaatgcactgtggctccaaagtcccttatccaaaacctctgggacagatgtattttggaatttaagatttttgtgctgagaatgatggtttccagcttcatccatgtccctgcaaaggacatgaactcattcttttttatggctgcatagttttccatggtgtatatgtgccacattttctttatccagtctatcattcatgggcatttgggttggttccaagtctttgctattgtaaatagtgctgcaataaacatacgtgtgcatgtgtctttatagcagcatgatttataatccttggggtacatagccagtaatgcgtcattcccagcaaactaacacaggaacagaaaaccaaacactgcatgttctcattcataagtgggagtcgaacaatgagaacacgtggatgcagggaggggaacatcacacaccaaggcctgtcggggaggtggaggacaaggggagagagagcattaggaaatatacctaatgcatgcggggcttaaaacctagataataggttgatgggtgcagcaaaacgccctggcacatgtatacctatgtaacaaacctgcacgttctgcacatgtatcccagaacttaaagtaaaatttaaaaaaagattttttggagtttagaaaaataatacatttggatttagcagggtttagtgcggcactttttaatcacacacactaatatttctgtagtgaaactgaatattcacactgagataaagactatgaataacttcacatcagttcaggtaaggttttgcctcctattaagtcttgataacaaactttaaaaacttaaaaaaataaaataaaataaagtttattttcaaaacttttgaagtttgcgcgtacagctagcttgtaggtctggccttgcttttctttagattatatttcccttattagtcttctaaacacattaaatctgtgtttaccaacgctgtaatattttgccaccgtgaggatggtctagaggccagcaccatccacatcccttgggagctggctagacatgcagaatcacaggtgctaccacgaagctgctgaatcacaatctgcattttaatagaatccccaggtgattcatgtgtgcgttaaagatcaagaagcattgctgtagtattatattggctttaatttagattccaagtcttaaagggaaatgctgatggggggatactttagttgtttaaatcctgggaaagtgagcccagattacactaatatcatttatttaattatgtatgtatgtattttttttttttttgagacaagatctgacggtatcacccaggctggagtgcagtggtacaatcttgactcactgcaacctctgccttgtggggttcaagccatcctcccacctcagcctccagagtagctgggactacaggcatgcaccaccacacctagctaatttttgtattttttgcagagagggggttttgccatgttggccaggctggtcttgaacttgtgagctcaggccatctgtccacctcagccccccaaagtgctgagattacaggcgtgagccactgcatctggccgaatatcagttctttttaattttttattcaatatttcctccgtctctccctcccactcttcctatttttttttttttttttgagacagagtctcgctttgtcgcccaggctggagtgcagtggcgcaatcttggctagctgtaacctctgcgtcccaggttcaagcaattctctgcctcagcctcctgagtagctgggattacaggcgcctgccaccacacccggctaatttttgcatttttaccagagatgggatttcaccatcttggctaggctggtcttgaactccccacctgttgatatatgtgccttggcctcccaaagtgctgggattacaggtgtgagccactgcgcccggcccactcttcctttctctcctccttccttttctttttctttctttttaaaaataagtctcataatacttgactttaaatggatcatttagtctatttatttacatttattatattcttgatatatttggatttcttctcttttatactttctgtttattctacttttgtttctttctcttgttttatttatttttttgagatggagtcttggtctgtcactcaggctggagtgcagtggcgcaatcttggctcactgcaacctctggcctcctggcttcaagtgattctcccacctaagcctccgagtagctgggattacaggtgcatgccaccacgcctggctaatattttgtatttttagtagagatggggtttcaccacgttggccaggctggtcttgaactcctaatatcaaatgatccacctgcctcagcctcccaaagtgctaggattacaggcgtgagccactgcacctggctctttttcttttaggttgatattttttttctcatcctattccttcctctgctagtttgttatataccctatttctctcttttagcagtaatcctagaaattgtagcatgcatactttatttataaaagtctaaattcagtcagtatcttttcttcctcctaaacaatagctcagaatgttttaactcccgttttcctctcttgtgctgtatactattcttgttgtgtgtttattctatttttaaaaattattaatcatagatgattttttaaaacttatttttttcaagacagggtcacattccataagccaggctggagtgcagtggtgcagtcacaatgattgcagcctcgacctccctgggctcagatgatcctcctacctcagcctccagagtaactgggactacaggcacacaccaccatgcccagctaatttttgtatttttagtagagacggggtttcaccatgttggccaggctggtcttgaactcctgggctccagcaatctgcccgccttggcctcccaaagtgctgggattacaggtgtgggccactgcgcccagccaatcacatatgatttggttgtttaatagtggtgtttatctacatttattcacatatttgccacattagttgcttactacgtatttttgcattttagaccttctacttggaatcaccttcttcaacttggattctttagaccttccttaactgagagtctcttcatggcaaactgtcttggattttgtctaaaaatgtctttattttgcccttattctaaactgttactaaactatacattttgttttttgttagtgtatctgatttgctggctgtcattcattgtgctttatttctctctctctctctctgtctctctctgtgtgtgtgtgtaagggagagaatttgctaattagttgattaattttccactgtgagctgttcatttttcttacagctttgttatgaggattcttccaggtctgagttacagaaggattctcctagaaagtatttaaggttgcttctgctatgtgcctgggttattaccaactgtgactcttcacattaaatttttggcttcagggttttgggactctaagagctgtatgaactcgcactgcaaactcatatgagttttcacttattatagtaaattctcaggtttgatttttttcttcttccatccatggccaagatttgagacaggcaagtttccttgcactccaggaatgtagcttgacttactgttcctggtgttggtggtggtgctgctggagatgagatccttttagccatcctatctttggcaggccctgggctttgtttcaccctgaactctgaaccctgaatcctgtgggcagggcttctgctagcccatgtggctccactctaaattgatgcaggcactcagcttgttaaagggagcactggatggatttcagcaagcttcctgttccttatggttctgtctggtaggccttaaacctaggctcaagtactctggagttaaacaagtggcccaaggcaaaagccagcttcagtgcttaacttacttcgcagggattgtatgtatgtatgcatgtgtatgaatatatgttatgtatacatatgtatgttttgtgcgtgtgtatttcaccgttgagtgttaattactcccttgttacaactcattgatgcatttaaataaaacatttaaaatattttattcatctcctctcatggttttcagcaaaaatgtaggtcagggtaaattaccagatatattggaccagctggatgtagtcgcctttgatttttttttagttctaccacctatgtatgtatcaataaacaatgtattctttagtgcttccttatttttaaacattatgtgaattgaataacttatgtaatcttttgcaatttggtttcccgcaacatttctatatggagtatggttcgttcatatttactttataccaatatatgaatttctttagctattcaacacaatttaactattcagattccactgttgatggacttttggattctttccaatttttgctattggagttttccagttttgctgctaagaacactctcgtacatgtcttctggtgcattgtccaggattttctctagaatatattcctgggggtagaattgatgattcattgagtaagcatgtgttgtaccttactaggtaattacaaatggctttccaaagtagttgtaacaaattatgcttccattagcggtacacaagagtttctgtggctccatgtccttaccaattcttagtattgtcaggtttcttaattcttgcctattaggtgggtggacttaatacttcttagtttagttgttataacttgttttttaaaattaacatatctatgtgcatattcgtagtcatacatgtttgtctggtcatttaggtacttatgcaatactctagtagactcagaatagaaattagccatggcaacatatatattacattcttcatattgctacatttgaaaataatcataattatttgcagaaatatgaacagaacatatagaattaaatgttttcacgatgtcttgtattatctttcatgtttcatagcaatctctgtgttataggccacatcaactgcttttgcattgttctgacttacaggaattgcagatttattgttctcagtgccatatttaagttccttctctgtaacaatcaggtgtaatacttgtaaatttttttaaccttagtacaaatttaaaaagcagaaatttctcttgcagcttcctgtgtttcaggcccagtgctaagcacatggcaagcattgtcccatttagttctctccaccatgcttcgggcaggtgctgttgttaagcccctttcatggaggagtgaactaaagcatggagaggttaagggtcttgatcaaggtcccacaatcttattctcaatggaccttctccttctctaatctaaaaccctcattttattttgggaagtggatgtaggtctaggaagcttgtttgtgtgtgtgtagtttgtttgttttttttttttttgagatggagtctcgctctgtcgccaggctggagtgcggtggcgcaatctcggctcactgcaacctctgcctcttgggttcaagcaattctcctgcctcagccttctgagtgctgggactacaggtgtgtgccaccatgcccggctaattttttgtatttttagtacagacggggtatcaccgtgttagccaggatggtgtcgatctcctgacctcaggtgatccacctgccccggcctcccaaagtgctgggattacaggtgtgagccactgttcttggctgtttgtgttttatattaggaggcagagagcacttaggggaagcagaagctctggtctgaggaggcagtggtttacttattagttcacaggccttttaggtaatcactggtccttcacttaattaagcaacttaatatatgtcttacggattaagttaattttaaatcaatgctaatttttatgtcaaaatatattaagcagcatcacattaaagtcaaaggtagtcttgtaattattagagcaataggtatcgtgctgtcgttctccaatgtggctgcacattggacaacctgaggagctttaaaaaatactgctgcctggggatcactcccataagctctgatttatctcgtctggggcaccaggagttttaaaatttctccaggtgatctaatgtgtagccaagcttgaagattactcgatagtcattgattatgtgcgtgccacattcagattggtggggttcaaatcctccttctgccactcactagatgtgtggccttagttaagttttgttaacgtttctttatgtcttcatctgtaaaatggggatgaatgataaaaatactgtctgcatctcagagcattgttatgaggattaaaggggtacagtaagtccttatttaacgttgtctataggttattggaaactgcaacttttaagtgaaacgatgtataacaaaaccggtattaccatagattaattgacataaatgagagttaagttcctgcagcatatttttggtcctaaaagtattatcagacttctacataaagaccaaaacatttctaatattaaacactgagagaaatctaggttatacatacatttaagaaagattaattcaatcatttactcaattattcgactccagaatagtgggtggtccgagcctgtcctggcagctcagggtgcaaggtgggaccagccaaggacaggacaccatcccatcacagggcacactcacgctcatccacactcacactgggaccacttagacatgccagttcacctaatgggcacagctttgggaagtggagaatgtgaagaaaatccatgcagatgtggtgagaacatgcaacctccacacagacaatggccttggctggaataaatttttttttctcacaaattttataatgaaacaatgttactgtaggacctgctgtataatatatacatattaataaaatgcttggaatagtgactggcacaaaatagtcctttactgtgagctattttaagtagactaagaaaaaattattactattattggatattctctcaaaagtatcttgggggctaagattttaaattaaatcaaattttgcctagtactaagcccactttggtgttttcttggctttgtttaatttttttctccatggttttatttaaaagttatttctaatcaccctgtcaacttagcagatatctgttggaatcatttaaggtgtttgtttccaaaagactgcagaaattaaatcaagatatttgcagaggaatgactgacagcttgcaggtagactggagaaagtgcttcctaccataacagacagaaaaaatggtagtacaagagtcagcatttcttatttatttttctatgaggcagggtctcgctctgccgctcagactggaatgcagtggtgtgatcatagcgcactgcagcctcaaacttctagactcaagggatctcctgcctcagcttcctgagtagctgggactataggtgcttgccaccatacctagctgattttttgtaggggtgggtagagacagggtctagctctgttgctcaggctggtcttgaactcctggcctcaagcaattctcttgccttgacctcccaaaatgttgggattacagacatgagccaccatgcctggccaattgagcatttctttaaactggaaactagcacctttataataatttcacacataccattattgttgaaaatagtcagattttcagaggaaatctctattaacctaagttgtataaccttttgaggttgtaccagtgtagagcctgtttttccgagcatctacatgctcaatgctattttttcagttatccagcatccccccacttgtttctatcctatctcatatgcaagagggtgtaaatgtttttgtgcattgcttttacatttttatttatctctcaagtgggcaagtaagacagtcatcaacagaggttgcatttggagatcatattctgttttttctttaaactatttgatcatttcagagaaactttattctcagttctgttttgtcttcagctgtcaatatccctgactccaggccctttatttagcttccattcttactgatgtggaaacatacttttaaatgaactgcctttaaaaagaaatattttagtaaagtgaaggatctttttgtaatgcaaataatgttttgttcaggattttcttgagaaatctgccatgttctctaagcctttgcctccatactggatgtggctttgccttttttgttgtgttgaagggcatgcacagatatagtttctgattatttttctcagtctgatttctccaattaggcatattatcattagaaaactcgcccattttcccatggtgtttaaaagtaaaccaggacttgtgacactatgctactcggcatttatgaaatgtaatttaattactttgtttccattgtgaagactcggtttccttatttcctatattcatttatttattcattattggtatacccaacaagataagtaaatacgatacagccttgcatttgacaattttatggtgtgtatgtatttatcatgcctgaactgtgactagacttaagatgaagatggtacctaaatcaagctcttttatattttgtctttcccataatctagtctgtcttttctttcccacaaaatagaatgggatactttttattataaatatatgacatgttcactataaaagagaggcagtaaaggaccagagaaaatgacctgtgatgccaccacctagaagtaatcactcttgttaacatcttgttatttacttgtacagtttttttctgtgttcataggctgacatttttccttgcagatgttctctctctatattcatacaaagctgcagttgttcaagtcccaccccagcctctggaggtccaggatgaatgcctccctctttctgtcctggtaccttacgtgacctccggacggcagtgtcagtgttggaaatggcaggctgctgcaaatatgctaaaacctcatcagttgtctctattcgtctgaccaaagtccgtgggaagagcaagatgctggtgatatcctggagctcttctgacacaaggctctggctagccttgatacattcctcaaattcttccttccaattctgaaaccttttgttttccagacaataaaaccctcccaaactcctacctagacattctctctaagcagtcctgggagaccacatgtgacttgacttttaactatctttacagcgtttacattttgctccttctttttgtcatgccattactagagggaggatgggccatccagagcagcgtgcgccctccacaggcaccttagcctgttcttcactccgccatgattgaaagaggagaaaatattctatagctgttccttttctgttcttggctttttcactcttactgaccttacaagttttatttttccatttctgaatctcaattattttcatttctcctattcagtatagtttttaatagatagcattgcattacatggatgtcccttatttaatcaactgtttggtatttcttttctgtttttcaaaatctaatgaacactccagtgaatatccttttgttcgggatttatctctagaaggaagattactggctaaaaatatatgtacatttaacattcatatacatatctatacacacttttttttgagacagcgtttcactctgtcacccagactgaaatgcagtggcatgatcattgttcactgcagcctctacctcctgggctcaagcaatcctcccacctaaacctcctgagtagctgggactatagacacgtgccatcatgccagctgagtttaaaatctcgttttgtagagacatggtcttactatgttgcccaggctggtttcagactccttgggctcaagtaatcctcccacctcagcctcccaaagtattgggattataggtgtgaaccactgggcctggcctatgtatacataattaggctatactgtctataaaatttggctatctatagtcaaattattttatatgcatatatccaaatatacctataaatagccaaattatacatatacagccaaattttatatatatatatatataaatgttatatatatatagccaaattatataaagctgtatatatagtcacattatcctacaggaaatgatgtaaatgtaccaatttacattcctgtaacagggcattagaattccctttttccagagccttgccaacactggttatttataaccctttcaaactttgtatgaaagttgtatgtattttaagataaatgaaaacttatattgatttgtaattatttattggtataattgaacacctttccatatctttattgtactaatgtgtatgaattccatcttaatagttttgctaacttgtccattgaggggtttcctactgatttgtaatggctctctatataaaaaggatgttaatttttgcctattttacagtaatagtacaaatattctctcatgttttctattagtcttttaacctttgtttagttttttttcgttccttcataaatgctaaattttatgtcatcatatctttcagtccttttctatattatttctggctttgatggcatgcattgaaagcccttttccaccccagagttatcaactcgttggaaaatgatgttgaaatgtcacttttaatatttactaaacactcttgcctaatttgttctattttgaagccctttaattctgtttctttaatctgcctgtcttttttttgtgcctgttccttactgtcttgactactgcaggcaacatacttacatctaaagaacaagcacacctattctgcccttttgctaaacaaattttcagcctctttttcaatgattattttttcaaatcaatgttaaacatcacgtaaagtttcaagaaaacccctaggggtattagtatttagagtgcattaaatttttagctaattcatgggagaatttgaagtattatatcttctaatttaagttagagtacaggaattgtctgtctttatccctctaagtacattcagattctcaagaatagtaccaaaattctcagatccccctctaccagtatttttctcccactgatggctcttcaaccctaaaatgtcttagtggtatggtttggatctctgtccccaccaaatctcatgtccgatcgtggtccccactgctggcagtagggcctggtgggaggtgattagatcatggggaggcttcttatgaatggcttagcaccctccactttgtgctgttcttatgatagtgagttctcatgggatctggttgttaaaaagtgtgtggcacctccccaaaccccttgctcttgcaccggccatgtaaggtgaggatgcttcccctttgtcttttgccataattctaagtttcctgaggcctctccagaagcagaagccaccatacttcctgtacagcctgcagaaccatgagtcaattaaatcttcctttataaattacccagtctcaggtatttcttttcttttattcttttctttctttcttttttttttaagagatggagtcttgctctgtcgtccaggctagagtgcagtggcgccatctcagctcactgcaacctccgcctcccaggttcaagtgattctcccgcctcagcttcccaagtagctgggattacaggcgcccgtcaccacgcctagctaatttttgtatttttttagtagagacggggtttcactatacgttagccaggctggtctcgaattcctgacctcaggtgatccacctgccttggcctcccaaagtgctgggattacaggcgtgagccactgcgcccggccaggtatttctttatagcagtgtgagaatagcctaatacacctagcctgatgttacacttaggatcctcttcattattcttctgaatccaagcctccaactttatctacccatcacggttttagcttatattttgattttatttcttacatcttcccttatatttattattttaatattttgtttctcttttctccttctatacttgtactagatttatcagaatctgtaaatctcttttaaccctattaatttgttaactcagttaaatatatctattttgccaatgctcatcttcctatttttaacagtcatatatcaaactgtatttctcaactgatgtaccaaaattaaaggacacctagatgccctccctcagctaaagtgtttactactgcatccaaacccatgaattctccctaactgagagaggatatttagagggcctttgtgccttttttttttccccctatttcttccttgaaaattctggagctttttgaaataatttagaattttacttttaagatattattaaatttttttctacagcatgcctctgtttaaagaatcaaagctttttaaacatatcactagtcacatatattatctgtgtagacttagctatattatcatatatttatttttataaagatattgctcagcactattcttttacagttttatttatcttaactgacaaatgaaaattgtatatatttatgtatacaacatgatgctttgatatatgtaggcattgtgcactggctaaggtaagctaattaacacatgcctcacctcacagacttatcatttttttgtgagaacacctagtgagaacacctagaagtcacccacccagcaactttcaaatacattgttattaactgtagtcaccatggtgtataacggatcttttaactcattcttcatacctcactgaaattttttgtcctttacccaacatctcctcagtccccttacctcctctagactctggtaaccactgtttgaactctgttcctatgagttcaactttttttattctacatgagtgagatcatgtgatatttatctttctatgcctggttcctttttcacttaacattaatgtcctccaggttgaccatgttgtcataaatgacagatatccttcttttttaaggctgagtagtattctgttgtatacacataccacatttcctttacccatttgtttgtttttgaacacttaggtggatcccatactttgattattgtgactaatgctacaatgaacacgggagtgcaggcaactcttcagcacactgatttcaattcctttgggtatatactcagggattggattgctgtatcatatggtggttctgtttctcattttttgaaggaccttcagaccatttccataatagctgtactaatgtgcatttacatgagcagtgtacaaagattcccttttctctatatcctagccacacattatctttcgtctttttgataacagccattcgaacaggtgtgaagtgatatctcattgtggtcttaatttgcattttcctgattagtgttgttatttttttttcatatacctgttggccattcatatgtcttcttttgagaaatgtctattgaggtcctttgcccattttaaaaattgttatttactttcttgctattaagttgttcgcattccttatacattttgggtattaatccctatcagattatgatttgcaaatatattctcccattctatagattgtctactttgttgtttcctttgctgtgcagaagctttttagtttgatgtaatcccacttatctattttttgcttttgttgcctgtgcttttagaacctgatcaaaaaattattgcccagactagtgtcttggagcttttcccctgtgttttcttctagtaattttacagtttcgaatcttaggtttaagtctttaatccactttgagttagttcttgtatatggtatgagatgagggtccaattcatttttctgtatgtggatatccagttttcccaacaccatttatttaagagacagtcttttccccatgtgtgttcttggtacctttgtaaaaaaatctattgaccattgactatgtggatttatttctgggctttctaccttgttccattggcctaagtgtctgtttttatggcagtaccatgcattttgattactgtagctttgtagtagtttttgaaatcaggtagtgtgatgtctccacctttgttctttttgctcaagattgcttggctctttggggtcttttgtggttccatatgaattttaggattgctttttctatttctgtgaaaatatcattggaattttgataaagactttgaatctgtagattgctttaggtagtatggacattttaccaatgttaattattccagtccatgagtacaggatatctttccatacatgtgtgtcttcaagttcattcatcactgtcatatagttttcagtgtacagatttttcaattcctggttaaatttacccctaagtactttatttatttatttttttgctattgcgaatgggattgttttattaatttctttttcagatagtttgttgtatgtggaaatgctgcatcagcactaattcttacatattttatcttcttgagatcttttctgtttactttttatttgattgagatgctttcttagataccagtattggtatactttcttgagtttgtttctaaattatcttttcctcctcaaatatgtatttctgctgttctggtcttggattgcagttctctttattcagatgtgtgtgaacactgttctattgttatctgtggtcaagcattgcagacgagaagtctgatggtagactaattattttccctttttaacttacttctcttgtctgaatggaaggctgtagaatttttctctttgtctttgaagaaatttctctagaatatgtccagatgtcttttttatttagcctgactagaatgtctgagcctttttatgctaaaaatgcaagtctatcttcaactcagcaaaaacttcaaactgaaaaccgaagttttaaaaccagtgaagctttcttccacttttaaatattattaccacacctacttcttctcgtaattttttactttttttttcctaaaaaatgtagaaagtacagaaaataatgcggaaagttctcatttagcccaagcagagagttaaaaagataatcttttgtcatatttgttttagatctttttttaacagtatggttatattttaaaatgcctagaagactggagttaaagtcattcagttatttcttaatagtacttagagagttgctcatgaattggaggataatgaaatatgagacatgccagagcaggagaaggaaattctaggggctatttggggtcttttgtggttccatatgaattttaggatttaaaaaaaaatttctgtgaagcatgtcattggtattgtgataaagattaattgcatctttagatccctttgggtagtatggacattttgacaatattcttctaatttgtgaatatgggatatcttttcatttcttgtatcttcaattaatttcatccatgttttatagttttcattgtagagttcttttacctctttggttatattcattcttaggtattttttatttgtagctattgaaaaaagattgctttcttgatttctttttcaggtaattcattactggtgtatagaaacacctctgagttttgtatgttgattttgtatcctgcaactttactgaatttgtttattaaactattagatgatagtttaatgataaatgtttaaggtggcagatatactaattaccctaatttgataattacacaatttataaaagtattgaatcatcatgttgtaccccatacatatatatagttagttattatatgtcaattataaataaaaaattatatactacgttggttttcaaaattaaagtaataattaaaattcgcaaatgatgggaaaaaaaccggaagttcttgggggaaataagcatatttcacagtgtcatggaaattgagtcctgaatgtcaatattgtttcataaatacttgtaacatacaatgcaatagggatactacatcaggatgcttttggctccaagttacaaaaaaccccaactcaaattggcttaaagagggaagacatttgctcatctcacacaaaaggctactcagctttgcctcaatccaagccatcatgtaatcacatggtgggtatagaaatttgaggtgtacttacacctgtgtacatacctctagatgtaccagtgtcctcaagaataagaaatgccatttgccttttgtgtttcttatttagaagtgagaaagtcttttccagaatctccctagaaaacttgcctataaggtctcagccacaattcactcatacgctcattcttgtaccaactggtggaaagaaagaatagaattcacgggaattctattgaatctgacacagattgatctgacatagatcaacggttcccaaccaggtggagttttacctccagaagacatttagccaagtctggaaacatctttgtgctcgctggggtcccctactactggtatctagtgggtagaggccacagacactgctaagccttctacagtgcatgggatgcttcccacaatacagaatgatctgattcaaatgttaatagtgtcaaggttgagaagccttaacatagaccagttaggatctcacccttcagggccaaggaaagggctgtttttcactgaagcacagggctaaggaggggctatgtggatgttgtgtagcccactgggaatgcccactgccatgacgtccctcggatggagctggtcttctgagctgctcagaaagggaagctcggatttgtgggttttaggctactaaaaattaaccaaccacattgaatttcatgtttttctaattcattcctagtcttcttgcctgttaaactttctgctaaagataattctaatgaatttgagaaggtatttataaaagaatatctgtgaggctgtgtgttgcttgactggcagccaaaagaaatgttgcttggggaaaatggcacgaattaaacattgattgcccatcagtcttgtacttggggtctggggtagtctggaatacaggtagggagatcattcaagcttcacagagaggttcactagtacttataaatccaagcattgggagttgagaattgccagaaatagtcatgtaatgatattccatgttgtataggtgtttgcatttcttcctttctaaaaacacagtggttttggaaataataatatcctagaacagtggtcctcagctttttttggcactaaggacaagttttgtggaagacaatttttccctggatcttgaggggaggggaggatggtttcaggatgaaactgttcccctcggatcatcaggcattagattctcataaggagtgggcaacctagatcccttgcatgtgcagttcacaatatggtttgcgtttctatgagaatccaatgcccccactgatctgacaggaggtgaggctcaggtggtaatgctcactcacccaccgcccacctcctgctatgcagcccagttcctaacaggccacagactggtagcagtacatgacctggaggtttgggacacctgtcctagaacatcctggattaagcaattaaggatctctgcaaatcctagctccattgctcaactttgaaaagttgttggactgttttcagctttgggtacctcatttgtaaaataaagaaattgaattacaggcacttacaggtcctgcaattccccgtaactcagataaaaaatagatccctttctcccttcaggagaactcatgactttggtagcagctagagttagcatttgctcatgcttttattgtgtttagcaatcaatgggaagtgcatcaggtgaaatctctcaggcctgcatatgtctggtcaaagctcattcattgattttttttttttcctgctgaaacttgcacatatataaaaaacgaagacactaaatttaattttcaccagctcagtgtatagtattgtggctgctcatgttcctgaagagcgagttgttctcaaataataaactaagctgtataatctttaaaatatttgaccaggtgggaagcctttctgtgaggacaatgtgtttgtgcgtttggtgcttaagcttcaatcccctggccacagcttggatttatttgcaggggaaatctgctacgtaagaagacaaccactttgggcaacattatcttcatcatcagcatgcacgtgtggtaatgacctgttatgagcctgacttggaataactttcttcctcacagaatggtggatactccatatgtgtagaattactgagagtaattatctttgcaacagtaaggcgtgagggtaagaaatcaataaagcagaagggaaagatattaacatttatcgaccactttctgcatgacagcagaaggcggtcaataaatggcatactttattttaatcgtattaggtgattattgcagtattatcttaatttatgtgtgaagaaattgtggtccagcgaggttaagtcacttgctcagtgtccctcagtattaagtgataaagcagaggtatcaacctaggataccctacaaggtttggcttccatctggaagcactgagtacctgggcccagatatgagacagggtcccagcccagagatttgttggtttatcattccttcagcaaacacagcttacttccaagagtgtagaaattggggctgtgcttcatagcaagataataagcatcagaagggctgggtgtggtggcttatgcctgtaatcccagcactttgggaggccaaggcggttggatcatttgaggtcaggagttcaagaccagcctggccaacatggcgaaacctcatctctactaaaaatacaaaaattagctgggtgtggtggtgcacacttgtaatcccagctacttaggaggctgaggcaggagaatcgcttgaacccaggaggcggaggctgcagtgagcccagattgccccactgtactccagccagggagacagagtgagacaccatctcaaaaaaaaaaaaaaaaaaaaaaagccatcagaggagctacagtgatgctggtgaggcagacatttcctgactcatagcaggttacctttgtttcctcgttataatgagaaaaagttgccttccctggacttcctcctattcatcttttttttcctgtcctcttcttgcttaggatgccaaggctgtgacatttatttctgctctcttccctttgagatatgctgaagtcatttaaaaaaatgtcaggaataaaatgcactaaatgatgactgtcttagaaaagactccagttaagctgtgtgcatccagaaatgcaactgtgctgaccagtttctgcctcccttgccctactgataacatgatgggagatgaagtcgtttttcaaaagtgttctgggtccagagacgtttgctcgacacctgtgccctccattggtctaaaggcattagagtttttctcccacaatatttgtctttgttattttgaatttatgacaccctggttgttggtgtttttctttgcattcatacctgactcttgacctccaaaagaaccagtacatacattttactttaagctgggcatttttgtaatactatgcaaccttgaaaataatcgcagtgatattttgcttttttataaggccttctatccttctttgctcttgcatctctctttcccctttatgacagtatagcagaacatatttcattcttccctgagccctctgcagagcaattttgtaactgatttgagccatgtttttgatggagtatctgctctctggacctttccatctcctggttgcaactgtgaaccaccctgcctccaataatctacatccaaaatgctgagcaggagatttatggaatttgtttgaagatattccctgaactctctgaagctaactagttcctttgcaagtaagtggctggaaacctaaagatcttgtgaactgggttctagaagcatgggataacaaatgtaagatttcagactggaagttaaaagcgagttttcctcttgattcagtttctaaccagtcagctaaatggtctctgaatagttgtagctaatgagcaccatcccccaaacagtcaattgtcttgactattaaatacttaaatccatgtattttcgctggagtgtttattactatgtgttcttaggaccataattataaaatgttaagttaggacgacacagaatatttttctctgagtatttttgcctctttcatcagataagatgaaattcatttttattttattttacattattatgattattattttgagatggagtctcactctgttgctcaagctggagtgcagtgccacgatcttagctcactgcaacttctgcctcctgggttcaagtgattctcttgcctcagcctcccaagtagctaggattacaggtgcatgctaccatgcccggctaatttttgtatttttagtagagacagggttttgccatattggccaggctggttttgaactccttacctcaagtgatctgcccgccttggcctcccaaagtgctggaattacaggtatgagccaccgcacctggccgaaatgcatatatatatatacttttttaatggaatgcaatggaatattgtgaagtagtaaaacatgaataaactatagatacatacaacatgggtcagtcttactaatgactgtgagtgaaaaaggaagctccagagaaatacgcgtattatagcttggttataaaatttggaaacttgcaaacttcaacaatatactttttttttttttaaggaagaaaacagacaaaattcagaatagtggttatagttggggtgaggtgagcccatgagtaaatactggtaatgttgtaatttttggactaaatcatggattcgcaattcttcattatattattaaaactaagttttaaaagacccacaaatgggccagtgatgatagtttttccagaattgatagccatcaattctgatcatccaggatccttggaaataaattgcatggatgagctcattcatcacaaatctggggtctttaaagtttctgctgttcccagttctttggattcatagctatgatccttagagggcaacagatctctcccttctcatggcagaaataaaggtcagatgagaatgggagagccatcagatagagaccactgtggaggagtttgcgctttgggctgagcaaagagaagaccagaatcttttggtaccatctccttctgcatttgagatgaaacttagtcttttaaaatacatgcagccccagtcctctgtgttgccagtcacctgagctacctttgggggtagggttttgattaaatggcacgctttgctcatgagtaaccttcggggcacattttgttggtaagaaataaatgcatcactcatttgaatcagagctgcaagtgccatctgtgatgcactcctccttcccattatcacacaaatgtgtttctgtgtgactggttcctggattttgcaggctctcttgccttgcgccgattgctggctgagaggtctcagctcagcgttcaccacgtatcactatatttctattaatacttctgctcttcttggcaaaacagaagtggggcttcatttgaaatgatgggctggggagaggggaagggaaccatctcactcatagttattgacatcaagctaccatcatctcttgttcggataactatgagatttttctgctccctttatgcccccgccccaccccttcccagccactttctgtcctctgccagagtgatcttgtgaaggcttcaatcagaccagatcattctcctgcttaaaaatccccccgtcgtttcccgttgctcttagaacaacatccacactttttatcctgcagtagggggctctccatgctctagcccctgcctatgttcccctcctcatcatgcctttctgccctttgttcactatattctagtcaccctggccttctttctgctcctcagtcactccaagctcattccctctgcaagaccttggcatatgccatttcccctgtcaagaacgttcctgctctaggtcttcgcaaagcttacatgttctcattgttcaccgaacagtcttccctggccacccaatctaaagtagtccagccccacctcgaaggacactgtctcattgcaccttttattatcatcactgcatttaccattctctgaaattattctattcacttgtgtgtttatggctgtcctgattagaattaattttcataaagagaacaagaatcttgactggttcacccttcaattccttgtgcccacaacagtgactggcacatggaaagcattcagggaataaaagcacaatggaaaattaaaacatactcactgcatgcctgccacctatagaaccaaattaaatcactgccaatatgcatggggaaaaccttcccatttttctggaataatgttacaaaggatggaaaataagtgcacatcacctggatggcatttaataaacgctgtgacccagtagtgtacatttcagtgaatattgccaaaggaagtaggccaacatcaggtaatctgagttaactttcctgtacattgtgtattcgtttcctgatgatcaaaactggattaattagtctacaatgtatctttcctgttagatacgaagattatctgctctatccaatttgtgttttcttagctgagaaatcactgttgaattttaaaagcagcttgcctggtcctcatttcctggtcttctgatggaaatggtttatggaaaaaaaaatatttactagagtcagataattagaacattttatgtattttgcatatgctaatgcgtttgagttcctttgagggagagccgcatggcataaagcagaatgaaaaggatgattcaaatttcttcacccagcctcctcccctggccagatttagcacttcctatataccaccacctcacagcttagcttggctgggagctcctcaggtttccaaaggacggtccttccttctccctcccccaattgccatccctacaccagggtgccaactcccaagtgggctgacaggaagggagattggaaacagctttatagtagatttgatgctgttataagacacgttgtaagacatcaggtaaatatagcacatcagattttattaatcataagaattctttaaaagccttcagcagagccgagatcatgccactgcactccagcccgggtgacagagcaagactccatctcaaaaaaaaaaaaaaaaataaagccttcaacagtggctaaacacaaaaccagaatccctttagatttcttaaaatgcctttgtagttcttttgtaatatgggtccttgttggacaaagttagtaatttgttttttatatcctttacattaggggtttctaacccccaggccatggaccagtaccggtccctggcctgttagaagccgagtggcacagccggaggtgagcagcagttgagcgagcgttactgcctgagctccgtccacctcctgtcagatcagcagcagcattggagtctcacaggagcgtgaaccctattgtgaactgcacatgcgagggatctaggttacctgctccttatgagaatctaatgcctggtggtctgtccctgtctcccatcacccccagaaataaagtttctatgattacaataaatgtaacacacttgaattattcatcccaaaatggtctctcccgactccccactatccatggacaaatcgtattccataaaaccagtccctggtgccaaaaaggttggagactgcttcttttaatgatcatgttcacatacggacagtgaaaaggtgggtcttcttagaggttaaagggaaagtaggacagttgccacaaagctccctttttggagagtgcccagccagggagtgttactagggcccaccttggccttgctgatgtcttcagtggtgtccttgaagtcagcatgggattggcgcaggctcctgttggggcactcggtgaaggtcctccctcctccccagtagctctcatttccagggcccttattttcttttggccatctgggactgaagtcttgctcctggtgggctatctctgttgccctatcacctttagtgatttccactaaataaccctcttttaagcatttaggggaagagggagtagcatgaacgtttattgtgcagtggggtgagaaagtcagtaccagtttcaacacgccctccagctgccttcctccagggaggggacttcacactggctgtctccacagatctgcagtgcccttgccatagctccaactcctggccttctcccactccccgctgcctgctggcacatagagcccttgggccattctctgtgtggtattggcccctgcctttgcttatgctctctgctgtaagcagctaggcttagacttccctaagaggagtcccggacaccactgaggatgcattttcccttcctcacgtgaagagagcattaggtgcccttagctttggagggagtggagctttggagcctggagacaggggaccaggaccagattacccagcctccctagattctgctgaactcatctttcagtaaagaggccagatgagctgagctccacttctctctggctccatgttcctgtgacttttgactcatctgaggttgactttgagaaggcaatcccttttaaatatattggaatccatgtagtatgaccctatccactgtggaatcttactccattttactttaaagagaatgtaaatggtttggctgcacatcactatgaaaatggcctaagtaagcagaacggagaagctgccaggagagcagaggtggagagtggaaggggccaagccggttctaaatcgttttctgcaggctcctgtcctcagatgtactcacttcatgggaaccaaatcacatttaactgctctccagctcttaaaacaggataacttgagccatctgatatttgagaagaatacagcaacccagaagatgtattaatactctattctctaattttccagaataagtcagatcattgacaaatgacatacttgggctgtattaccttcctacagaaagactttcactaggtttagtaattagctatagcttcagccttttgttttgttttgttttgttttgttttgttttgtttttgagacagtctctctctctctgctgcccaggctggagtgtgaaggtgccatctcggctcactgtaacctccgcctcctgaattcaatcaattctcctgcctcagcctcccaggtagctgggattacaggtgcacgccaccacacccagctaagttttgtatttttagtaggtatggggtttcaccatgttggccagtctggtctcaactcctgacctcaagtgatccacccacttcggcctcccaaagtgagcttatgtctttttgaaggatggctatgggaaaagtccacttgaaggatgttttgtcatttatttacttactgattaattaagatgggaaagtcttgctatgttgcccaggctggtctctcgctctgtcatccaggctggagtgcaatggcacaatctcagctcactgcaacctccgcctcccgggttcaagtgatgctcatgcctcagcctcccaagtagctggaattacaggcacctgccaccacgcccagctaatttttgtatttttagtagaaatggggtttcaccaggttggccaggctggtctcgaactcctgacctcaggtgatccacctgcctcagccccccaaattgctgggattacaggcgtgaaccattgcgcctggcctcagctccctttagtttttaaagatagacttcctatcttataacagttttagatttacagagcagttgcaaagatagttcaaggagttcctgtattctctgcatccagtttcccctattattagcaccttaaaatagaatagtacattggttacaatgaacaaaccaatgttgataaagtatgtcaactgaagtccatacgtttttcatttttcctagtttttacctagtttcctttttctattccaagatcccataccatattacttatagttgttgggtctctggatcctccacagcaatttcttagacttgccttgtttccattatgaaacacttcagacataccaaaagtgtgtgtgtgtgtgtgtgtgtgtgtgtataaagaataccaatataaccagcattcagccctggaagcagaacatgaccaacatgattgaagcctcatgtatatccctcttgatctctttctccttccctcttcaaggacgaccaatatcttaaatttggtgcttttgtcccaggcatgttttgaaacgactatatgtagtgttgctttgcatattttattttatcgagacaggatctcactctgtcacccaggctggaatgcagtggtgtgatcatggctcactgcagcctctacctccccgggctcaagtgatcctcctacctcagcctcttgagtagctgggactaaaggtgcatgccaccacgcccacctaattttgaaaaaaattttctacatatgaggtttcacatgtcgaccagggtggtcttgaactcctgggttcaagtggtcctccctccttggcctcctaaagtgctggcactacagcagtgagccactgcccccagcctgctttgcacattttaaaacaatataagtattataagcattgctctacagtttgcttttttccccccacataacatgttttaatctgcattgctctaatgtatctagtttctaagtcagactctgttgtatgaatcccctctcttgttgatggatatctaggtgttttcctttctgttgctgtcatggtcattgcaaacagtgctgaacagacacctttacaagtcaccttatgcacgtgagcaagcattctacttggggagaggaattttggggtttcaaattttatccttaacaaagcagtttattcattcattcagtaaatattgattgactatgtaaaaactgagccaggttctagaggtaaacagaacagaaataatccttcatttatcatgagtttacaatctaattgggaaaatgaacattaaagaagtaattaaagatatgtatgtactatacagctgtatcataaaaataaagaacaatgtattgtgtgccatgaaaaaaatataaggcttattaagggatgtttcttaatgtttcttgtatcataaattacctaaagaatttctggacaggaaaatgctactctcctactgaatttatgtgctttctttatcgaacaatggaagcaatgtaaagcaaagtgtttcttttttgccttagctactaggagtagctctcatgtagatgctgtgcccagctgcagtgcctggaacagcccagctacatttagtatgtttatattttggctttttaaataaatggttttcatattgttctatgtcttgttttgcatgctgaatcattttgaatgtaaatgaggtatagctcttggagagaggacaagatatcattgataagtggttggtgacccccacttttcttttcagagacaaatgaccttgcttttacttggtcttgctgtatttatatagggatcttactgtatttgcatgcttgcttaatttcaatataaatttatgaaatttattatccatcaagagtcaatttgtcctctaaatatttcacttagatgatgattttttttaatcaccaccaacacatacacaaacagaactccttagcaattccatttggctgtactgctatctttaggaacatttatcttgctttaactcctctcttttttacagacatttagttttctgtgacattgtttactttcgttataccttaattatgggattctgataaccatggaggagtaggagagacaataaatggggttttgtgggtgattaaatgctaaagcaaagctgagatctttgataagcacaacagttgtttctgccagtatattccaaaggcaagactattcttgcaattacacaacaagcaaggggggagaaacacctcccacaaatcactctgatatgtttcttaaccactgtgcttttgaaagcctaatgctctttcttctgatgtttttttgactgtcagcctgagtagttggctcttccttggtacgaggctatttaaatgacaggtcctttctcagtgtgaatgtgtcagctatctaaatgagtggttgaaaatgtacctccgcatcagccatgtggaccacggcatggtctgaagaaaattatgtttgagcagctatgattgagctcaattttgcaaaagcttactgagttttaacaaataatttagccctatcaagcagaagtgcatttggctgcaggtaatagaaaactgaatcattggtggttttagcaagtaggttttctttttctcacatgacacagattggcaatactgtcagagacccagtttcttttgtgctttctgctctattttttgtagtctttcagcctttatcgttgggcttattgtctcagggttgcaaaatgactggtctgactgcagattttctaggagggaagtgcaaagtggtggtgctggccacagctttccttctttgtcaggacagcaaaagtttcatcggaactccccagtggacttgctctcttaattcaaaatggctgtaacagtgtcacgttggctgcacctgtttcaaagaaagttcagaaaattgggtatttcacagacacattaagatttcaaacaaagacgagagcattcacaaggaacagagagggaacgtatgtggatggggcaagtaactgccagtcatcagcctgttatgtactgtacacatagagttttgctgtgcagcagcaaatataaaaatgaatgtcatcaccatgaaagtggaaaaccgtatttcaatgtcatgcaaatgccataattgaaatgaaaagataggaaatgctggtgcattgtctacattaatgtatttggttgttgactttattgcataaaaagtatcagtggggacgagatagttttgctttgtttcagaagattttgcttttgtttttcccagctaagaagggaaccttaaaaataatgaggagggccgggtgcagtggctcacgcctgtaatcccagcacttttggaggccgaggcaggtggatcacttgagattaggagttcaagaccagcctggccaacatggtgaaaccccatctctactaaaaaatacaaaaaaaattagctgagtgcggtggcacgcacctgtaatcctagctacttgggaggctgagggagggagaattgcttgaacctgggaggtggaggttgcagtgagctgagattgcaccactgcactctgcactccagcctgggttacagagtgagactctgtcttaaaaaaaaaaaaagaaaagaaaaacacacagatgtatgaaatagagcttattaattctgtatatattcacagaaaacgcatacttttatgccttgattatctttaggtgatcatggggaacaggagcccaaagataattaacaactgtgctaaaacaacaaaacctcaattgggctacaaatgtcaatatcatgtacacaggtggaaaagactcttctttgatttcatatttttcttttatttccttggcatccctgttctggttatgtcttgctgtgtactctagacataggttttgtgggttgactgagctcagccgggtggttctcactggggtctcttatgccctggctcttaaatggcagctggggctcctacacatggcatctccatatggcttaggcttgtcacagtctggtggctgggttctgaggctgaagtttccaagagaccaggggggctgctgcaaagcttttaacctgagcttgcaagtcatgaagcatccactttccgttggttgtgctggacagcccagatgaaggggcaagttcccaaggacgtggatacctagaggcatggttcattagggaccaactttggagacaaacaaccacagtctccttccttctcttcccttggggattgaaagggttatcaaaagctggccagaaagagaagcaaagggtgaggataccgctgctgcagcacgtctgtagtagggaatgaacccagaatgtgaagagttgccattctagtaccctcgagtgtccttttcatgccattggaaacttgacaatagtaattgggagtgagttgaaatcttcagctttctacctttgtattgtcctttcagagcaaaaagaagtaaacattaacttaaaaaatgcttttgatattaatagttacaaacaaaaaacaaaacatgcaacaattccaagctcaaatcaaaaccaacactgagctttgaggtgcaatttctattctatgtgtgtggccatctcctcttgtgttagtggctgagcagagaatgctccattccaaaataaatagaattaattttcttaacagcatctttctttgtgccaagaacacagggttacaggaagcacatctgaatgtaccattggcaggttaaatcattctctttactttggtctttggtgggtttttatgtttgttgcttttcatctgaatgaatggcaatagagcaagttttaaaaatccttagggatctccagagattcctgtcttgctaagaaacaggaaggccgcaattagcagagaccaagaatgaagaggaggagaagggggcgggtgtctttgttgctgtaaactactagttttcaccattctgcaccttgggctgtgttgctgctgctacctggaacacccttcctccccctcctctgccgggaagactcccacttagcccagatgcagcccagctgctggcttctgcatgcagcccacctcttcttgctggacagggtggcgtcttgtcccccacacccacaattcctgtgcctatcactttgtctctgtattccttcctcagattgtagctccttagtggcagggaccagctcttagcctgatatcatcagccaagcaacgtgtaggatgcagaggtttggcaaaactttgaaagcgggaatgtatagtcaactatgtcgatgtctgggtcatttttccaatgtctggtagcaattgtgttaggtggcttatacctctcctggacccacacatagcaaattctaaaaataacaaactggaccatataagcttttccaaaagcctggggtgggggagatgttataatatcctgacatagctgtgctgttgttcatttcacctctgtcacctagagcaaccccctccatgttttccaaaaccgcccccatcctcggggtctggtttgggacccctgtcctcctggaggtcctctttgaaccctctggacccttctctcagagccctctggtaccttgatgtcacagcatttcctgtaatttcatttccctggcctcttggctaagataataggctcctgtccttgctttttctctgtcccctgaaaggggtgaagtcgtgtggacatgtggcaggtgccactattgtttatctgctgaacactagcactccccgtgccttcatgccatcaggcagggggcatttgttcttttgacggtgtggacaggggcagagtttagtggcattgttcttttttagcttaatgagcacgaactgtcagagcttggaccaaatttttcttgcagatatattttgattgacaggcacaggatttttggagataattgaaagagttgccaacatttatcaggagactgtacataaaaatacagagttccagtttccctcaaaaatttggaagttttggcaaaattgagtcccaattaccaaaaattgcttctaaccaagcagtaactattcccttcacacagaatgagcctcccttccctcatttcctgtaaaatggtactgcatgttctcctctttcatttgtgtcacctgcctcattggtgggtaagttgttctagaaaatgtctatcatatgtgctgctgtactgctaagtgcgtagagccctagtacccacagggcacacacaaacaaacctggtatacaaagaacttctgtgcggatttctttcttattgtgcacattttaaggggcatcagtctctgtccatgcatccttagaattgtatggctttttcatgatttgatttattcaacaaggatcgaacagtctgtttgtattgagtatttactatatattagttactgttctaagtataaactcattgatctcacaactctgagatgggtgcttttactatctccatcttacagatgagcagcagtttttttgttgttttttgaaatggagtctctctgtcacccaggctggagtgcagtggtgcgatctcggctccctgcaagctctgcctcctgggttcatgccattctcctgcctcagcctcccgagtagctgggactacaggtaccagcctccatgcccggctaattttttatatttttagtagagacggggtttcaccgtgttagccaggatggtctcgacctcctgacctggtgatctgcctgcctcggcctcccaaagtactgagatgacaggcatgagccaccgcaccctgcctagaagcagctttaataccaggtcacacagccaggaagtagactagctaatgtttcaccttaggcacaggtggagggagtcacacatctgtaagatttgttcccaggacaatatcattttctttaaatgtctgttttgggaggacttcaatgagctctcagatagaaacacccatttccagggagcattcttaccctagaaaaagcttgggacagttgtattcagacagctctgctgttgaccatgtaaggaactctctgccactcttcctcatagctttggcggggattatttgtctttagacttgttcctttttgtgaaagtgacagtagtgatagtcattagtagttagtagtcatggttacttttgttgagcacttacagtgccaaatgtagtaagcactttcaaactgtattactctccccgtttctacttgggaaactgagtattactgtgtgagtgatggggacttcttgaaagatcctaaacatgggaatgtcgtaatcaggttgctgtttcatggatttggttccgaaagccaagcagagagcgggtcaccagcacagtagtaagagtcaggaaaattggttgagactgttgtgtacaggggagagttgcttggggcttgaactaaagggacggtgaagagaggggtaggtttgagagagacttagaagatagtaatggcaaggcctggtaaaagacgggagtgatttccagttttacagtttggacggcagcatggataagaaagaatataaggggctgggtgtggtggctcaggcctgtaatcccagcacattgggaggcttaggtggccagatcacttgaggttaggagttcaagaccagcctggccaacatggtgaaacctcctctctcctaaattagctaggcgtggtggtgcacacctgtaatcccagctactcgggaggctgaggcaggagaatcgcttgaacctgggaggcagaggttacagtgagccaagattgcacgactgcactccagcctgggcaatagagcaagactctcaaaaacaaaaccaaaaaaaggtagaaagaaagactgtaagaaggctaagaaggcatcgtgcggacaggggagtgaagtgtcacaaactgtcagtttgatgtactctgtgactttcagttgaagatgtcacaagattacgacaaggagctcccagtgtcttcacgtagttttcccagcttactcagtaaatatttgttccctaaatgaattcatgatttccatagttactcagtaaatatttgttttctaaatgaatctatctgtaagcaactcaagtaatatcccctcctaccatttatcttaatgtttgaatttcatctccaaccacttaaatcatagtctctgggagatgggagctaggcattgacatttaaaaatgtatgttcggccaggcacagtgactcatgcctgtaatcccaatactttgggatgccaaggcaggtggattgtttgagttcaggagttcaagaccagcctgggcaacatgacaaaaccctgtctctaccaaaaatacaaacattagctgggcttagtggcatgcatctgtaatcccagctacttgggaggctgaggtgggaggatcacctgagcctgggaggatcatctgagcccaggaggttgaggctgcagtgagccgtgattatgctactgcactctaacttgggcagcagagtgagaccctgtctcaaaaacaaacaaacaaaaacctttgtgtccacagatattctaatttgtggccaggtctgacagccactgcttcagttttaatgaaacaacagatgaaacaggtctactgagatgttcttttactcatccatcaatttcatttttgagtgtctaccactgttttgagctccatgaaactcaaaagtaagcattgatgtgttcacctctgtgttcctagtaccagaactgtgcctggcacagaataggtgctcaatagatagttgtagaataaatgaatgttttatgattctgagcacttagagaatactgcgctctagtaacatacaaccatcagtgtctgtagctgtggcaggaggctttctgcttctgaggtctctctgtctggactgttgtgctattatcctctcatgtttcttcaaggcagaggggttgctgcctgggaaaggtgtacactttggagagtgaagtcagactttgctaagtgaacgcttggatacgtgttgtgcatctctgttcccaagtaccttctctgctatggactgaattgtgtatctccaaaacttgcatgttgaatctctacccccagtgtgatgttatttggaaatggggcctttggaagataatcaggcttagatgggtccacaaggctaaggccctcataggggaattactgcttttaaaagactaggacattctctgatcctttggaagtatatttcctttccatcctcttctctattacctgccttccacctgcatcattggagttggcttcttggtgttgacaaaccttacaatactcaggttgaagacaagagcagccgagaaggagcttttgtagggagtggttgtcagtgtctggtgctttaatatttccttccgttgggatttggaaaaggcagtcccacatagaaaattgttccagccgaggaacagcaagtctgtctgtcaatctctgggtatattgaagacatctctctgagtatattccaaatgtactcatcagtgacgtactgcttctccagaaggtccccttaggaagttgaaaaagattctaattcctaacacagtagctcctgctattttcctatgtatgtttttttctcgcttttatcttctgctttaccaaaatacatttacataaacaatattagtatgtgtacagaaaatatgaataaagaaataaagattaaaaaccttagaagaaatgaaaataaaaacttaagaattggaaaagaattctaaaatctcaaggttgaccaagctggagggtttttttgtgcatatttattgcagttctaccttgtgccaggttttagatactttcttttaatcacagaactttacaagatacgtattatctctattttatggattagaacatttaggctctgaaactcaagggcatgtagctgctacatggtagagtcaagattttaatttagcatgcctaactgtaaagcacctttccttggtctaaaggccagtgacagttcctaatgaaagttttcacacgtacacaatgaaacaagaaaatgaagacagtgtagaagatttttgataaagcaaaatacaattaactttaagaaacctgttcattattttaaaatacctatattggctaaagtttggcaatctaacgtcagacccctaatcattatatatatatttttttcttaaaagtctactcgttcgtgaaatcacaagttcacactcagggttcgtgatttaatggtggaacaaaacagaatatttaaagttgggaatgttccagaaaagctagatttacaagattgtcttaaggccccaaagaggaaacaaagatttggcttgctgatcagagttaaacattgtgtacaaaataccttaggaggaatttgagacctccgttatttcagacttaggaaatagccctttcttatctctcatataatggtacctgtctctcaggaagctaggcctcccttgcagtggtaatagctggcctgtggagccccttcacattgcattacggcaattccagtgcctccctttcccgttaggaatctaagcttgtactaccttttaaaatatcttcaagagtcaatatgtggatatctgagtgtcaaatctggcatgcactgtatttaagtatcacttaggaagaaaagcaaaaccctcagccccttgaaatgatttttaaattaactttttggtggaaaagtcccattttatctgtgcaacttaataccctttgtgcaattttagccaacttcttgaaaacacaggaggaaaacaacaactttcattatctcttttgctctgaatagcagcaatcatcaaaccaacatccaccaccttcttgttctcctgaacttacgtatttttgtatatgcaacaacttagggaaaaacataatggcaggaaagaaaaccttttcccctaagtaagaaaaatcacagaaaatcattagtgtgctaattaaggaacaaaaatcaaattgtgaaaggtttcttacccagattgaaatgaataggcctgggcttgttcccacagtggagacagggctcccggaagtatgctggaagcatgcaaggccacttgccgcctagactcagaaatgacacatcgtcacttccaccatgttccattgattaaagaaagccattcaggccagcccagattcaaagggtggaggaaacagaggttgcctataaaagaaggattttgaccatttttacaatttaccaaaggagtgacttggtcgaggatattaactaatttaaaggagttaatgtaggtgaagctcttagaatgcctagtgcatgacaattgttgttttgctattttttattattattactgtattctctctaggcgtttcccccaggagcttattgaacgtcctttaatcttttgttttgtttttaaaaatgatgttggaggaacaacggtgacttttcaggccctggaaatgctacatatgggatggtatcgtagaggtgtttctttgcctcccatgggcgcccccggttttgctctctccccctctaggtggcgctgtcggggatccccagctgtcccacgttgtcttgcttttcctttcctctctgtcaaaacgaattctcattcttgattcttaccactgcagtgtttaccaactttgagtgatatatttcccttttaaagaaaagcagtcttgtgaatttagttgttgttttatatttttattatgttacttaaatatgtacaaacataaagctatgtataaactaattatgcttgctcataacttttatgcatttataaaataaaggaaatgaaacttgaacagaacagatttaaaaattaaaacttcagaatttcaaaatagcagcattaacctaacatgacagatgatattatttttactaaaactacatccagacgcaaagccaccgtggcctttgatgcctcagttaccccacaccttctctgtttggactcctgcaagctcttcgaatacagtgtgctgtgaaattattatcaagttgattataaacacaaatatgagaactgaagttacctgacagtgcttggttataagatggctgtttaacttagtgctctcaaattttactgtgcaggtaactcaccagggatcttgttaaattgctcactttggtacagaggggcaggggtagggtacagaattctgtgttttaaataagctctcaggttatgcctgttggctgatctgggaatgacactttgagtacaaggatctgactatggttccatcatttgtttagattattaaacacacaaatatttaagaatcagtcgaaaacatgtttctggataggtccttggtctctagtctagtcactgcactaaaacatacaagcagttaggttgttagagcattatactagccctatgggaatcagatccagacaccaagcatgaagttgcatgtattgagtatcaggcatcagccagtaatatagggagggaatgatgattgtacaaagacctccctggacattccagatgcaactcacagatgatgactccttgaccagtgggacaggcctgatgtggttttgcctctaataaatcaaatctttccatttttacccaagtaaaattttatttgtactttccttatgatcaccactcacattttgcctggtcttacagtttaaaatgtggtacagctttctttttctatgttaatattctgagggcaaggatcatgttctattcctttttgtacttttcatacagcaggcatacagacatttgtggaattgaatgtattagctagataaatcttgagggtgccctctgctatttgcataaccaagtttttttctgaaaattccaggaattttgctctttctgttatatttcagactcgttattttatttactactgctgcttttttttcttcctaggaaagattcctaagatttaaatgactaaagcttagtctctgatatttgaacataaaccacatttttattgctcttggctctcaggtgcgctttgcttttaatttttatctgagaataaatgttgagaagattagaaacgcttatttagttgataatctgtgtgaccagaatttatcctttctaaatagttccatagcagtcttcgagagagaagttctggtagaagaggaggtagagtgagttgttctttaaaaaggaaatgcaagtttgtagagagatacccaggtgtgggctttatgcatgaaatatttttcctatgagaaaaaggaaaacagtgcctgaccttatcaataaaccattgtaagacgtcttcagcgtaggtcccaaggacattccaactgttcttttggactgagaaactctcaggtagtggttgggagaaaaagatccagaggtcgcagtgggatatttaacaaacatatgaatcagctgtatagcacatcagagaacagagagaccagacataaatgcataataaggcaatattctcatgatattgataagaactttttttctaagttctgttgatctgtctttctacccattcaatcattaatttaacattgtattgagaaattaaacacagactcaaactacacaaaataagcatagtttaatgcaaagattcccaaaatatggtctccagatcagcattgccttggaagttgtgaaaaaagcaaatgtttgcactccagtggagatttactaaatcagaaactatggaggtggggtgtttattttaacaggctcttccgaagcttcccatgcatgcttgagtttgagaaccagtggcttagcatgaactagtatgaggtggacactttgaaaccagcacctagctaaagaaatagacctgccagtcacttcagaagcccctccatgtgtcccttcccagccataattcctttctccttccaaattacccactctcttgagttttccagtaattactcccttgcctttttatagttgtgtcactgaattgcatatccctagccgcaatcatttagtcttttccatggatattaacttatctttcagtctatgcattcccccattgtcccctccttttccatacagtgtatctgatgaagaacttggactgttagacctgttggaggttctcagagtggattttgctggttgtgtactcatggtgcagtgtaacatgttcctctgaacttcctgagtatcagcagctggatataggggtttcatcaaatcttagtcctgtccttttgctaagactataggtgggactgcgttttttgtttttttcttttctttttttcatcaggaggcgcaggaagtctagttctcactgtattttgatgttaacagccatagatactcaatacttagatcgattgagagaagcataatggtgacagtctgtcatttcattttcatttattagctggaaagtcttagatggaataaatttagatcactatatggctaccttgtggtagatttcacacttgaaaagccggttgaatgctcagttttccttttatttacctaattttcaagatactgaattgcttccctgtcatgttcagaaggggaccaattaaagaaaaaaacaaaaaaaaaacatgaactactaggtttaaacgtagtggaagagtaatcaaaccgtagcaaatcatccctattgaagctcaaattgtcccatttttggccagtgggagcctcttcaacttggctcttgattccttttggtataactctagcactatttgattccttccttttttattacaggctcatcttgtgtatttcctgccccagaccaagagtcagccatttctctgagaatgcaccctgctcccccagttctttttgataggaaaaaaatgtcaaaaccacaaaccagattctcataactactgacttgattcttttttactgagtcttttcaatgggcaaaactgggaaatatccacttctatatctatatagctttttctatacctatacatagatgttatatgtatttaaatatatttaaagttaaaatacctcatgagtttatactgatatttccaattcaggactacagggttttaacgtcttctgtatggcatctatatcttctttttcctgcccaaacaatcttgattctcaaggacatagagtatgctagattagaatatgtcataattactcatttgcatgcttccacattacacacacaatattaatactaccaccaccaattatgattactaaaaagaattaaaacatttttgtgcatatgctattctcattttcctctattattttatagttatacctaatctgtttttatcaggtaatagttattaatgctatactctcttccatttaacccccatttaatgttcttagtttcatatatttgatggtcatcaccattttcacgtcaatgacatgacacttggttgtccaaagctcattctgtagtagtcgccttaggaagaagttatgggaacagaataccttgtgttcttacatgttgaaagaatgttttctctacttaatgttcatttttgcttggatataaaatccttggcttatattttctttcattgagtaccctagatacattagatcatatccttctggcataaaaccctgtcaaattctagtgataatccagtttttattttttcttacaagtcacattctctttttgcaagaagcccatagagattttttttctttaaagtcttgtcattttactagcatatgtcttgatgctgatagttatgggttgttattctcacataagtagtttctttttttgtatcttaggacagtttttcttgatttatagtttttaaaatttgttatgttttcttgttttactgtttctgccttctttagagactcctgttgtccttatgttgcatcttacttgtctgtcttcaaaatttatcaattcttgaaggcttcttatctttcttaagttcttttgatttttttaaaaaaatttaatttcccccttctacttttgaagttatttggttttattattcactcttaagtttcttctagttaagcctttttaagaacatttctaattcttttctaagctctgtcaccttatttctgaactttttctagttccaatttatattgttccttcatgtctagcgtgttttcttagtgtcttttggcaaatctggaaattgtatgttagaattgtgatctgattttggagccagttttcttggtgtgctttcattatctgtggaaatgttgttttattcgttttcctcttttatccttaagcaataatgtgtggaattttctctccatgcttttctgttgctcattttcctcacgttttagaaagagactttgttcagatggatttttctaacttcatagagctctgtcttctattgtttttatgtaattttttttaaaaaacttgctttgtaaatttttatgttgttttttccttttccactgttacctgaatcttctctttttttttctttctgttttgctcaattttatttttttcccagcagcttctctccagtgtggtaccttgttttgagagcaggtgctggctaattgtgtaacaatttgtgatttatccttacctatttgtatcttgatgtttgtgaggataccttgtctcccagttttgttgtaaatgtccattaatttttgaacattctgtttgatttcattgctctgtctttcgacatgtagggattctaggagttccaaaaactgtgtcactgctaccactgccatctcctcaggaattcctcagtttttcaaatgatgatttttgaaattttagagtctataacttgagagatatagcatttttggagctgggacaaaaaagtttttaacttaattatgggaagtaatgaaaagaattggcttctaaaatgcaatgcagagatgcataaatgtattctctttatcttgcccaattacagagcaaaatagatgacaatacagaaataaacatggtctggagtagaagtaggttaatccgcatgctttagattgacttacagtatatacactttatttcttcattcagtgaataaatttatatagtgccttacaatggacagatactgtacaacataaaaaatatgttgacccttgcctgtctggcctaccttgaaatgctgtgtataacaaaattacacacagaagacctcagatgtggcaaagtgaagtgagagggaagtgactttcccaataccacacagtactttgagaattagaccacaagcctggatatctgtaactcccaatccaagacttcttccaccccaatattcaatctcattactaagtgtcaagaaagtggatttgttaccaccaaaaaaagaaaactttctgacattgagtgtgtgctgttttttgaagaatgttgtgaattctctgttcttaaaaagtcagtagtgcagctttcaatgtagagttcttttgttcaggcttacacaactatcaccattcaccagataacttgctgtattccagacatcattggctgctttgtatacatattcttatttaaccctcaccacctggcaaagcattgtcctcatctctagtttacagaggaagagacttattttaactcagagtatgttgtccaaaattaccctgctaatagactggtgattctgtggaaacagacactttcttcttttatatgtaaagtgttctgggtaacaaataatacactctcttctcatcactgtgggcaccatggtctgggtgcctcattggcctctctatcccctcccaacacatacacagaagagaggagaggagagaagcatcctaaatgcttgactctctcggcagaaagtctactgtgtctaatggtcttgtaggagggaggcagcgacatctctctccctgccttcttcctttccattcccctctctactaaattagctccctgagcatcagagtgtaaatccagtttctcttacttgtgcaaacatggacattcttatgccactttgtgtgtaaaatttttacatgaagtctataacctgttgctttggtatgtaaggctgtagaatgagcaataacgaaaaccagaaatgtttgggggaaagaagtttttgtctgatcttctatattcattgacccagacaagtgtcacaaggaccatgagagtctggggagcctgggacattgcccacactctgctaatgaagaaactgaaccacacctacatctttgtctagtcacacctagcagcctctgaccttgctctccttgcctcactctgatccctctagaatccattgcacataccaaccaactcaggccctaaaactcttcttttgtgaggttactttccagtctttaacctattggctttttctcattgttcctcaaatcaaatctgaactccactgtctgcaagactctcccgttcttttcctgaccaccttggctgacagctcttggagaagagggcttagattgataataatctgtgatcctttccttccaccttgcctagctctgccagttcatggagtaacattttcttttccacagttactgtaaaaagaaatcgattctttttagctaaagtaaatgacatccaactctccttacatggaaaaaaggcactaaagtgctgacagataccatctcaggaatggatggatattcttgctgtttctcttccaggacaatcagaaacaaatttaactggtgaatggccattccatgtggaagggaagtggtaacatagggcactagattaacctagtgcacttctcagtaggattcatggtatttctatgtaatttccacttacaaattacacatctaatagaatcttaaatgggaagacaaggatgagtcatatgcccaatccacatttatgtcttcaaaatacgctttgaacaacaaagccacatatacatgttaaaaggcctagtaaacttctagaacactagaaaatcctgattgccaggatctgttagtcactccactccagacagggttttgacaaaatgccttttcccaacagaggttaccatcttcacaagaagaccacatttgtatatatgtggccagcagcattcgccagggtacgtacctcaaggaagcttcaaatggccattcagtgcgcactcaaaagggatcctcagaggagcattcagaccatttgcttaaatgattgtgtgctcattaaggtgggcagatctgcagtctcaactagagatctggtagttaatctgggtccaggatgtttcttaactaaacatgttaaaggagccggataggttgctctctactgccaatttatcggttttacttttctccttggctacagtgcaatttggctctttggtttaatccccttgagaagccagaatccattggcatgcggagctctgggtcttagagcaatatggctctaaaatgtacgaggtttattctgatggtccctgtcacattagcagatggtggcatttaccatgttgatgggagaggagtccttgtgctctcagccacagatggcccgggaggctgtcccagcagcagcacctcaccctctccaacacatgccatgtagttagttgttccctctctttgttcctataccacttacgtttgcatttctttcatgcagttcgttggtggtggttatagtcatctgttttgatgcgtgctccccatattaggctgctaaggttttaggggcaggtacctggcttctcctccagggattaagagatgcaacgctatgctcaaggtcacaaaggtgctgagtggcagcagggtaggattctaagcctcattcatcagtctccaaagttcaggcttttaattagaaggcctgtcatatcatagaaatcacaatggtcctcttagggcaaaataatgggtgtgaaatcgtggatggtccaacgataattacaataagaatcgtttatttgtttcttagaaactgaactaatcattttacaggcatcatttcagttagtcctcctaatagtcctatgcatgaggaatgtcatcaccattttcagatgagaaaattgagtgtcatagaggctaaatgacttgccaaccaggtcacacagctagtaagtagctccaagtctaacccagattgatgtgattccaaaaccctggtcttgggcatctgactgagaccccccaatgtatgggtgccttgctttatctaggctcagatcctggaggtcatttgttgttaccttgaatataagaaacacacagggggacaggcagactctgaaaatataaagttcattcccctgaatcaaatgcagaaaacagttctcttatgggttgtcccacttttcatttgaacttagtggggaccacgggaggggctgttgaaaatgaccagctctttcctctgccaggcttcctacacttacacacacacacacgcatgcacgcatgcatgcacacacatgcacacacacaccccacttcatgcttagacagtgataaagtgagtagctggggcaagccccccgacatgtggatgactatggtggtggtgatggtaggaatggtgccttatattagtgtaccttgtacgtttacacatatttatttgatctacctcaaggtaggtgaccaagtattatcagtccctttttcctcatgtaggaagaaactgagtgtcagagtaattgagatggagcagattcagactcaggactcctgtttcctgatggagtgcactttctgctaaagtaatagctttcaaactgtggtgggttgaggagccccagaagccatcataataagtgagggccaggggactcaaagacctacatcctgcttcaactggagcatctctgcttttatttgacgggtatagagggttctgcatgtggttttattttatagaagggtctgatgttctaacagtttgctactgctatgtaacaaaccactaccaaaagttagttaattattattgcccatgcctgtgtggcttggcagggctctgccagactgctctgctgcaggtggtggctgtggggcagctgggatggctctgttcctcaggcctgtcactctccttggacgggggatagatggtgcatgtcctgcacatctttcaggcttagacttggaactggtatactgtcacttccaaagcaagtcgcatggctgtgcccaaagtcaaggggtagggaagaacattgctcataatgaggctatggcaagggaatggacgcagagaggggtgaagaactggggacaataatgcaatctgcaagtccatgaaaaaattgtattatcactgctctgtttaaattaggctattaaagtccttcaagacttatttatccataaaatcaagaggaaatggctgttgtattgtaaaagacaaaggacttctacccagagataatcaggtctgaggactgttgcttctgaatggctgccagtttggattgtggtcagtgttctcatcttttcacagctttactcaggtagggtggatgtataagtgtgtgtgtcagacagagagagaggtgcaaaatagaagcacgcctctgtctatcagccttgtcagcttcgatccttgtttagtctgtgctttatcttctcccgtctgtcaatgatgtcccccaccatttactgcaggcgggtctatagatccagtctctcccctgccagtctctctttgtttgttgccctggtgtcactgcacctctgagctctaagtctttaccttctgaaagccattcctaggacaatcattaaaacctatggtagttgataatttctgaccctaggctggctaatttgccttcataaactgtcagattctgctaaggtcattgaatgctgtcatcttcataatgtggttcaagcaaaatggataagagaccaaacaaggagaaatctccctagaacacagtatgccagcattgctgtatctcaacaattaaaaaatggtgcgggagttacccagtagaatatttagtgaggtgtactctatgtggagttcataaatacaaatgcaaaatatttaatgcacagaatcagagttgcaaaataagatttaattctagaggattagggagacagaactgacttaaggctgtttttcccagtaagcttaattacttggatgacaatcattaaacattgcaagtcacctatcccaagtgatcgaagggcttttcaccaaatgtctgagtgagaaagtgattatcttatagaacaaacaagtatgataaagggaaacaatcagacaagtaattatgataaagaaaaacaagaaaaacggcacatccagcctgttttgtgggaagaatcacagaggcactatgtaagtacggctcctttatctaacagatcatttactaactatctggagtcaaagtcaagtttatctacatgctgaaatctatttccttctaataagattccatccacttggatctcagttatgtggcaatcttgacatggaacgtgtctcggaatatggaagggcatgagaaggcaccaaatcttcaaccctagcgctcgctcagggtttgattagagaagcagaatcacaggattattttacaggatttcttctctggatttgacttacgcagctgtgggctctaattaagcagacaatggaaagttgctgtgtctctctctgatgctgggacctgaggccagcagggtaggcagttgggaagggaaaatggacacgaagctggggaagcaaagacaaattagaacccatggggataagctggaatccatcaagatggactgaaacccacattggtctcttgctgcctttcaaggaacttccatgatggaggcgacttccaggagaagccgactgcccttctccatggaactcagcctgcatctgcccaggagtcagaggaggtgagggaggagatctgggaagggctggacaggcccatctgcttcctgccccctcagcctgctggtgagccagcagataacccacaaaagcctcaacagcccctggccccccatcaactttcaaaggcaccaatgcaaaagactatagctactgcttcagttccttcttccaaatgtcatatgaaatgcctcttaggggtctatactaacccagaactgtgcaggagagagaaatctgggaaacacagttccagcttagctaggttgacttgctataagtcaaccacacctagtctcactaagcccatttgtcatgtgtggcccactcagactgaaagaatctttgttggttcactgttttataagggccagcctttaccagtttgtccagctagggcactaagttcttagatgcagacatcagttctgtattccctgttaaggatctgcttccttaataggaatctttaaactcctgaatttgtaatgacacattcaaaagcattatttgagactaagcagtaatagtgtatggcaagctggacttacagtcctgtgtgatgtagagatacctaaacataaatgggcatggatattgtacacacatatgtgatgcaaataatatacaaatattgacataggatgatctagagttgataccagacagtcctcatcagtgcactgatgaaaccccagaagaaaagaggtttagccagcaagttaacccatgctgatgagcatctaccatgtggcaggtagcttctagaggtgcaggggatacaacagttaatggtacagtgtcagccgtgaggctcttacattgttttccaggttttctcaaccatgacatcattggcattttctgttgggtaattctctgttgtatgcatctgtcctgggcattttaggatgtttaacagtgttcctggcctttgcctactagatgctggtattcctccctctcttcatccccatccccgctgcagttgagatcataaaaaatgtcattaatcattgccaagtgtcacatggggcaaaatcatcctcagttgagaacctgtgtttcagaagagacagaaaaataccactgagatactttcagatgctaataggtgctcttaagaatataaagtaggctgggtgcagtggctcatgcctgtaaccctagcactttgggaggccgaggcaggcagatcacttgaggttaggagttcgaaaccagcctggccatcatggtgaaaccctgtctctactaaaaatacaaaaattaaccaggcttcatggtgggcacctgtcatcccagctacttgggaggctgaggcaggagaatcacttgaacctgggaggcggaggttgcagtgagctgagatcatgccactacactccagcctgggtgataaagcgagactccatctcaaaaaaaaaaaaaaaaaaaaaaaagagagtttaaagtagagtgatatggttacatgactaccaaggtggttgaggaagcccttgccgaggaagggcctttgatttgacatgcaggcagcccctcagagatctggggacaaaatgcatcaagcaaaatgaagagccagtgcccaggtcctggaggggaacaaatgtggcatgttgaaatagcaaaaaggctgggagacttgcagcatgggtgatatggtttgggtgtttgtcccctccaaatctcatattgaaatgtgattcccaacgttggaggtgggggctggtgggaggtgtttggatcatgagaggagatccctcatgaatgtcttggtgtcctccctgaggtcatgagttcacacagcatctggttgtttaaaagacctgggatctcccgttctctctcttgctccagctctccccatgtgatgcattggctcccccccacccttcacctttcaccatgattgtagcttcctgaggcctcaacagaagcagatattggcaccgtgctttgtgtacagcctgcagaactgtgagccaattaaacctcttttctttatagatgacccggtctcaggaattcctttataacaatgcaaaaggactaacacagcaggtgaggaagggaagagaggagggcatggggtagggaaggacagccacaacatgggggaccttgtgcatgggtcatggtgcacgatctacatttaactctggctactcagggcagtcatgggagagatgtgatcggggagtgatgcaatctgatttatgccttaaaaggaccacgctggctactatgtggtggatgcacaaacagctcttccccttctgcctcctttgccttgtgacccacaaggacccatgatacccacctgcagctggctgttgccatctattcggagttgtcaactaataacagacaatctcctctgccctgtgacccacagggacccatgatactcacctgcagctagctctttccatctatccaaagttatcaactaatagtagtctctgtgcctacaaatgattaaaattgggcttgaaaatatggcaccattatcatcagcatttcttgagcgctggccacttgtttctggtgctcgtgtgtgtacatgaacatccttgctgtgagtgctgggccccaccctcactgccatttaaaaaaaaaaacaacaaaaaacaggtgtctgcagcctctggtgaacatcagcttctccgtaaggctataatgggagacaccttcatagattttgagttcggctaaaataccctcctgtccagttactacctataatgctcttttcccttggatcagaaagccttttctctgtggattatttccctccatctataccccacattactaccccatgccttcataaggttttactctttactggcgttatgtccatttatatttgaattacacaagcatgaccattcatgctctttactcatagaagggcaccctgcccttcctggaaaaatgatttactttcatattggataccatttgaatatacccagctgtctgcgtggaaatagagaagtagacagaaagaagcctcctgctacagcctaggagcagaacagtaaacccaggtttccaaaatatctttctgaggtcattacagggtcatagccctggacagcactattcctaagtcatcctgaggcattctttgtgtgacaggcccaatggcatggcaatggatttcataatgaaaataatgaaacattgagataaaaagttaatttcttcctggaagagtctatttaataatgcaggaaaatgttacactttttagttatacttaattataaaatgctagaaaaataggagtggttttggtgttgaaagagttatttatctgagagaactatgaattatccagaatgcttctctaaagtttcctttttcccaaaattttattatttggcataatttcagtggaatcttccaaaagacattagtccattcttttgcttcagtgcatgtttttttggatagatattatctatttttgtgtagtgttgtaaggtttccaggatacgtaaaagttggaggatatatggttggtgcaaaataattccgtagagtaatgagattgaattgggggaggtggtttaaggaatacaaattcagtttgcctaaatagatgtaaaaaggaagggaaggaataacatctgaagctaaggaaggaaacttttgggctggagcatgactagataggagtcgggtagagctttttaacacagttgaagatagctgtggacgtagatcatgggcaaaactggtaatgtgaggatttaggaagcacgtttttaagctactgttgagtttcataggaaaccataccccactggtcataagagacattcaccaatagttttccatgggccttttgtgctagtggtagttttgttgggggcaggatttacaaaaatgaccatgcatttgaaaggtcaatgatgaaggtaagtttgagaatgaattttccatgaatgtcctgcaagttttattctttctgtgaacagcttgaattttcatttggtttgaagattaggaaaataacagtcatatatactcacagatcaaattcaagtactgattttagccatctatgagcaaaggccattcttggtgttagacatgaaacaaacgagagagaaagaaggaaagagagagagaaagatgtgatggactgccttggttctcataatttagaagtgagactataggtatatgcacaaggagctctgatgtgaaacatggatatcatatatgtcctaatggaaatgcacaaatatcctaatgggcttaggaagatttctagaaggatagggattccaatctggtttaaaagaaaagcctgaaaccttggcaaatgaagtcagcaaggatattccggtagcagaatgagcctgggcaaaggtgaggagtggagtgttgcctattttgttttgtgaggatgatagattcctgtaactggagctgcggaggaagtagatgtattggagattgtccttgaaagtatccagactgactcagacagcaattgtgaagttcttgctgatagatttgtactgtattttccatgcaatgcaagatccattagagggatttgagtaggagattgtcatggaatatttagaggatataattcagatttaaaccatggaatattttccttgatactattaaggaatgatagattctttgagctaaaaggagcactagagattatctattgaggtagtttccaaatattgttttagcacagtggaaaccttctttcaaatgacatcttacacaaatgccccagctacaaaacagatagaagagcagttcttgtggaatcatgatgggaagagtcttgatttgctgctttctgtttcttcattcctgtagcaatccctgaggtacctctgtagaaagcacaaaatcatggaacaacctgccgttttaaagatgagtaactcaaaagaaatgaaaacatattatgaaaccacacataccataacatcaccagcagccttattcataataactgaaaagcaggataccacccaaatgtttaacaggagaacggataaactgcgttgtgttcatacagtggaatagttctcagatgtgcaaagaacaacttactgattcatgcaatggcatacatgaatctcagaaatattaagtaaaagaagcatgacccttggatttcatttatatgatacacaagaacatgtaaaacgaatctagggggaaagaaattaggaagtgatggcctgggtggcagggaggagaactgattcaaaaggagcacaagagaactttctgggatgttggaaatcttctctatcttattttgcgggatggttacatttgtgtattccgttgtcaaaactcatcacgtggaacacctaaggtgtgtattttattgtatgttaattgtatcttaatgaataaaagttgagtttgaagattcttggagggagatttgctcagttcccatagctaggcatgagaaagactagcagctagaacttaggtttacaggattcctggtccagctcttttaaccgcatctctctccctcagagtcatcctcctcttcaccaacacagcatcaaggctggcttctccctccctggacatcctcttccctgctcaaaccccaccgtggctgtgaagtattaacttgacgacactgtgctctttgactcagcttttaaactttcctccagtgaaaccagaactggcaaacacagctacacttttcttgtaccatgctttacctgtattgccaacctgctgataaatggctccattccatagccttgagggtcttgaatagcttaaacattttatagttccatgggaatgagacaggggagaagacaccagtggcttccattgtaggcctgtctacactgaaggaatgccaactgcccacacacacttgttgttagatggcctggaggctcatctgcacagacgtgcagtttaactccattagggatcacagagtgatcacacactgtgctgtgctctttggtatatatatgaaaagcatcgctaagagaatgggagaggtggtgagagtttattgctgccttctttctcatggaagcattggacagcagggcagccctagtgaattgttgactgctccataagaatatcttgctcatttaacctcttctgtactaggtcttctgcctggagagtcctgggctacactgcccatccccagtatcccatgtattcatgtcagattcttgcagtctcctgaggatctttcaaggactggaactgcatcttcaccatctttgtgttcccagtgtctgcaacggtgccttattctagaaaagaacatcttaactgggagctgttttgccaggaccatcatcaaaaatgtctgaagatgtttttggttgtcaaaactggggacagggtgctactggcatctggtggataggggccagggatattgcttatcttcctacagtgtacaagacagttccccataacaaaaaattaccccacccaaaatgtcagtagtgccaagatcgagaagcccttctctagattatactttattgtatagaagataatagatcaaccacatcctcaaggctgggaccaatgctttgcattatgatgggtgtcttggtttcttttatttccactcttgattctctaagcatcatattcaagctctgagatgaggtgtatctgactgggtcaggtagccactgagcaaactggaataggcctttctgcagagtttgaacccaagtcaatgttgcctcgactcaagctcagatacctcatctaatcatcagtagccatagtaatagtagcccttagcacagaccactgatatctactgcttagaaggggtttgtgggggtagaaaatgaggttatattaagtttacttgcccaaagtcacacagccagtatgttttggagccagattcaaacccaggttgtctgaaggctccaaaagtcatcatttatcactgtatattttcttcttagctttcttgcatttcctttaatgttcccatctctccctagtgaaactgatttccctcaccaggaggttctctaggaattttggtccagggcttagattcttaaataagagcagggacatcaccatgtttgttatacgctgtcatttcacctcctctgttctgaatcagaatgaggccagcactctgggttctaagttatcgttttttttttttttttccattctatatactccctaagaatcttttttatgcttaaggtacaagtttaaatatggaaaaaaaaatctagattgaaatgaaaagccagacatttcctagttatatcactaattaactgtgttactagtgataagctgcttataaatctttcatcattaagataagattaccttctagatcttaacatttatgatcacagggataagttttttgttttgttttgtttgagacagagtctcactctaccacccaggctggagtgcagtgtcacaatctcagctcacttcaacctctgcctcctgggtttgagcgattctcatgcctcagcctcccaggtagctgggattataggtatgcaccaccacacctggctaattttgtattttttagtagagacacggttttgccatgctggccaggctggtctcgaattcctcctgcatcacctcccaaagtgctgggattacaggtgtgagtcacagtgtccagccaggatagttcctttttattgtaacatatccattttttcttcatttatacctccagtatccaacaagttaggatgcaggaattaagaaagaatcgtcctaaagtaggaaaggcaagatttgatgaagttggtagaaatcaagaagcacagttttgtaagctttgcttgggtgtggattgggaagctatttcttatttctccaagagtgtttagcttctcagacaatttctgcctcagtttccccatattttaatggggggaccaaacacagcatggtcatgcatgacatgtgaccgtaatgaaagtgtgactagcacattggaaacctggtgtggcagaaatcacacttagaatcaggtcaattaggagtcaccttagttttcttattgaaaattatgtgtaatgctgaaaaattaataagagagttccttaaaataacagactgaatttcgaagtttaggtgataattattttccgaagtctgacctgcccaagaccttatataagcacgttatggaaagcaagagtggtatatctttactaataaataagtatttctccaaactttgaaaaacattctgaagcttcaggttaaaaatatgtaaatggaaatgccctccacttgactgtatcacagctgttccctgtccctcatttgctgaaggactgagtacaccccaaactggtcagagcatgatgactttcagtaatgacctaaatgaccttaaaatatcagtaagtgacagagtattcgaagtcacagtctataacattcgcttagaatttccccttaagctgctggctgaagcactaattaagatctgaaatggaaggtaggtgacagatgctttgtgtcctgcagcagaggcacagaatgctgttctttcacttactgtttaataataataataacagccatttaatctgtttgctgatacagtctcctttgctttattatgttgtttattttgtgtgagctttcgatattagttataaaaatgtcactgtgtctgcagctgcatttttcattttagaaactcccagagatctcatcaatttaacctgccttgtacagttcgcaggaaaccactacaggcaaagataggcttaatcaaggttttttcttaataacgaacacaatacacaggaaagcagggcaacgaatgagcctttgattctaggtaaagacttattatgtgaaaatctatatttaaattaggggctttttgctaggattcttaactgcacaagacaaattactgtaggatgtctctaaacagcaagtgtgtcttaggcatttgaaatataatttaatctattaacagtttaccctagattttaagccattcattgttggcgaacacaatctagattctttaaaataaaaatagaaaagcatttgcagtaactggccattattatagctatagaaatcaaaggtatttcttgtataaattttgaattatatattgtttatctctccttaataactttcactatagaaagagctctctttcttgctcaatttacataaaagtatctggaacagttcagtgacaacagtgttggaaattaaggactgacttgagactgaagctccctccataactcccatgcccttctccagtactaagtagtataaaggccaaaagtcagataaacaacataagagaaggtggcagtgctagagatggggatgaggctgtttcatataatggaaggacaccagttgacattttccaaagattttccattataatcttttgcaaaggttctctttcactagttaacaaatataaaagatgccaactcccaccagactccagatgcttgtaatagaattagaaggccctccaacctttctttccaggggtcctgagggggacgtctttgttggcaccccaagcctgagtcactcctagcacctcaggaaagcatgtgttgtgtggcttcaaggataggcatcctaggagattttaccacctatccaggtgccctggctgggtgaaaactgtgcatcttatgcttcctcaatagtgctgtgagaatgctccactgccagtttgaggtatcaggtttgggttttcaggattgcaagactgctgtgctgtgcgtgtactggtgagttggctccctgcctttcccagcacccccatgcctccttcttcacatcccctttcaagtagaatagggaactgataacccaaccaggccccttattcccatcagatagcaagctaatcactgagacaacaagctttgcagtagagaaaagattttattcaccaggcagccaagcaaggagacaggagaatagatctcaaatctgcctcctcaaagatgaggtttaggaatatttatggaataaagaagcagtgtggtctattgtggggggaaaggtgattggaggtgggggaaaggtgattggaggtaagaaaaagggaggtaattggtgatctgcacagacatagtcaaaattcatggctcttcataggatgtatgttcatgaaatggcattgttagcatgatctgagggtggagtttttgtcctctgatgtcaaaagtcaaccaacagacattcatacaggcctagttgatgggttggtggtctcagccagtttgaactgggtaagaactgacctcaagttcctataaaacaatgtaagcaactgttaccatgatgacctatacattagagatgttacctatgaggaagctagtgagagtttagatacttttaggtatataggttttaagatcaactagaagtaagcaactaaaagcaagtgaggcaggttaagtttgtcaggcctaatcaggttagccctcgctttcagagtcatctgcccaagtacagtaaacagatccagctactacttagatactttgagaagtttagggttgggctctttcttcttagctttccccttcatagaggaaagtccacatttacttcacatgctaacttgtttgctgttagtagaaatctgcgggaagtttgccagagaagggtagcctttggggattggccaaccagctagcagggacctctgctgtgagtggcccatgctgtctgggcagctctgttaggtaaaggagaaagccatttggcttgtgtagactgcagctctgcaggaacctctccccaccatctctagccaccacctccagagtacagtaaattgtagacttagatttgctgtttccagcatagatgtcttacactttctagagggttccctctgctcacatagagccgttggttaagtggtggtgctcattttccatgccctgctggctagtccttggacattgtgagcatttttgtctccaatgccactgaattccttaaggccttttgggtgggtgctaaatatttaggcaactcttactaagaaaatagaaaacacttgagttctctgttttgcatgtggctatctttacatcagagccttggaagtggtcaactgtatgtagccaatttcatgaggctgttttaactgggaggacattgtcacctggctgggcttatacagctgagtcaataaggaaaacgcagcttttgttggcttgcttaccttttaaatcagtaagtaatgcacaaaatgggtccctcaccaccactacttcctttaaacctcatccccaactccacatcccatcatcatctctcatctcatctcgcagctttagctgatcccatggtggggaactggggaggcatgaggttgggggtatatgtgtgtatcatatattacttgggagaaaaaaaattgttttaggttttattacaaagcacccaagttaaaagagcagtgttaaaattgtcttatcaaaatatcccgtaccattgcattttcctgtttaaagagactgccataaactctaggggctacccaagtgaggagacgagattatgattaacaatcaaagtgatggggaaagttataaaaataggaaaaaaatatttagatataaagtcactgacctatgaaaccaccttgcaaatggtaggcaaaagaagtagtattactgaaaaagtatgaattgttacctttactctgaaattagtatgtaaaggagcactttgtttactgcactaaatctttgtctccagtttttaaattatgagatttatattgcctaagtatagactgaatacattttaatatttaattgttttttctcaaactatggtttgaaaaacaagataattcttaagctgggtttcattactttgaaaactaacagtgttttctaagagaacacgttactgatttaaaaatgtaaagtaataaaaatagtattcacataaagtttcagtagagttttagcacagaacacaattaaccagggcttaaaaaaaaccatttaattttgaggcaattgtagttatttcttgcagttgcaagaaataacacagagttctagcgttagcatttaccctgttccctcaatggtactatcttgtaaagctatagtacaatatcccaaccagaatattgacattttatagttaagatacaggacagttccattaacacaaagatcctctgttacccctttataactacaacccctcattcccatccctgacccctggcaactcctaatttgttctctgtttctataacttatcacttaaagaatgccacataaatgggatcatataatatgtaacctttgagatttttttttccctcagcataattgcccaagattcatccaagttgttgcacgtatcaagggcttgttcctttttattactgagtagcgttctgtggtatggatagaccacagtttaaacatttgaatgacatctgtgctgtttccaaatttttgcttattataaaaaagcaagcaggacttttaaaaaacacacttatagaaatgcttatggctgtgtcttattacagaatatttataaggagagtaagattaaagagttagagtcacttaggattaaaacaaatgttataaactatgacagtccagctcaaagtagcttgatttcataaatatattctctttatggtatttcataaatgccataaatcaaagtagcttgatttcataaatgtattctcttttgattaaataatcaaacttaagtaaattattggccagtgtccacaatagaatttgtaaatagttacattgtgttcatgtttgcatttctgttctcaacctgaatgactgctcaatatagtacactatattcacttttattaagcactgctctcacatctcattgtgtttgttgaacctggaaatgtgatagcatttgattgtgttgattttttttttttagctgccaagacgaattgttagatgtttttaaaacattatatacccttatgcccttggtgtctctgatgaagcagattcattaaataaacactcacttatgaatagcagagccagcacagtcatagtggatgaagtttataggttattgacggacggtaggaaatcagttgaaagatgcccggaaacatgtggttatgttggtaggaagtagaaaacgcctgcctggagtccttcagatcccacaacgtatgcgtgtgcatcttctcaggctccgtattagccctggtacgcacagagacacacagcgaccagcctattagttgcctggcagatgccgtcagtactggtcattttgtgaatgcttttaatatgattcacagaatgtctgtagtcagtcacgttttagcactgacagtaaaatgtcacctcttcagcagttttcttttaaaaaaggtgtaaagcctcttaaaaatttttgctttaaactcctatcgatcgtttagaaatcttattagcttgctttgggctttcttttagagttggagaaattaaaatttagagaccaggttgggctgagaaaactgcgtggagaaggggaacttgagttgaatcttacttacaccagacagtagggacactaaagaaggcaatactgctggaagataaaagttgacagctttatgaaagaaggaaacaagtgaatgagataattcggctgagagctcccggaaagcaagaattctttttcatctgtgccctcagtccctagttggagtacagcccaaagtaaggttcaataaatatttgtttaatgaataaacaaatggatgaacaaactgaaataagtgttgatatttgttatgaaatatgcctttctcagactgttccacacacctcaccctggctgtgccaagtttctatggctgcacaacaaactactccaacacttagtggcttataacagcagatggaggttcacaggcttccactggacagttctccttgacatctgttctgcagtcagaaggcaactggaactgaggtttccggtggctccgcttgactacagggatgttgggctgtctccttctcagggcctctgctctttgtgtggcttttccagcagagccgctgaacttctaacatagtgtggctcagggcttccaaaaagcacaaagggagaagcttccaggcctcccaaaggctaagacctggaactgtcactgtgttgctccctcttttagttaagcagacaagggggccagaccagattcaaagggagggaaaagaaaccccacctcatgatgaggcaccactgttttcccatcgataactggtatcaacccagcatcctacagctcaattcagttctgacactcaccatcccgacttagtacagaccctacaggttaagggctcagtccccttagactgcccccacttcagatgccagctgaaagtggaatatgcccaagttacccacacttcttcctggctgactacaaatgtgggggttgggagaacccccaggtttggcaattcactagaatgactcacagaactaaggaaagtgctatacttacaattacagtttattataaatgatacaattgaacaaccagctgagaatttatgtagggtgagggccagaagggtcttgagtgcaggaacttctgtccccatgaatgggacatatcactgtcctggtacatcatattttcaccaaccagaaagttcctgaaccccattgttcaagagtgaacaatgcaggcttcattgcacaggcatgattgaggaaataattggccattgatggttaactcaatctccagtccctgtcatttccccagaggtcagggacaaggttgaaagttcctctaattatgtatccatgtggctggcaccttcctggaaactatctaagggcacaccttgagtcaccttgatagcataaagatacagctcaaaggggttcattatgaacaacaaaagatgttcctgtcactcaggaatttcaaatggtttttgaagctctgtgcctcgggaactagggacaaagacaaaatagattttgctgttctatcacagggttgatgacaaagaatgtgtggccatctttaatctgtgacactggtcctctgcagactcaagcaaaatagatgaaattttacaaaggactgttttcctatcatttgcttagaaaattaccctacatgtttatcccactttcccctagagcaggtttctggaaagctaatgctatgtcttacgtatacataaacggatgaatgagacaaagtttgttgcattggtatgtgtgttggggggataggagggtgatgggagagcctcctggaatagtcttagagttggacactgtttccccttgtgactccttttgcagctactgccttgatcccctcttgtgcctgctaggctctgccttggggaaagctcaactcttctgtttccctacacttgaccgactgtctccatcgttgccttgcccatcttgtgttgtgtccacccaaacctgactcagatctactagttttcatctttcgctcacggactattctcttgagccagattcctagtcccctaactcaatcatcttattctggcttctccagtgttctttcaacccaatcttgctaaaaagctattttaatgcccgactgtggatttttggcatcgttatctcagcaggcctagcttggaggttcctctgggatttcctgctggagtcttctttttaggatttcccagtctacttgggatacttaaggaaaattatcaccttgtcttaggaagaatcttattatctcaaatcaaatatttaaaattgcaatgctcccttatctggaattttattttgtaagggacattttctgataagctgccaatgacagcctatgatatgaaattctgtatgtccctttgggttcaacagtaaccttaatgggatagttttgtctccctgtctcacctcaggtaacagaaattgtcaagtgcaaagaaacttttgtatccttcccacatccagagctagcttggagtttgaccttaggcaacaaccaactaactgtgccttgaagataactctctggggagttaattaggatagactgaataattcaaggggcagttttggtgaattaaattgggaaaagattttcgagtgttaaaggttgaagcattcccttcctattatttcagctcttacctctactttctcaatatacattaaagaaaagcaaatctgttcaatagatttgagataatctattaatttagaatgcttactagaagcccaccatggggctaggctccacaaagtttgaattgtggttatactgtcggttgttttttaaaaatgtacagcaaaatcctaggcgatcttcatgaactactccagaggccaccatcctagaaatctaaactcagctctcctttaagattagtcattttcttatccaaacaccacagagctttttacatagctttattacagtgcttcagatattgtcttgtaattatttgtttctcaacctgtcttacctattggacctgattaatttagaggtgggaggctgctggcttcatttccttatccaatcatttaaattaagcatctgacaggtaccaggcactatatttggttctagtgttccaaaggaagtagacaatcctcattttgtatgtattcttcttcttcttcttttttttttttttttaggtggagtctcactctgttgcccaggctggagcgcagtgacatgatctcggctcactgaaacctccacctcctgggttcaggtgattctccttgaactcggcctcccacgtagctgggactacaggcatacgccaccatgcccggctagcttttctatttttagtagagacagggtttcaccatgttggccaggccagtctcaaactcctgacctcaagtgatccacccaccttggcctcccaaagtgctgggattacacacatgagccaccacgcctggccccattttatatacatgctgtatgtttgttgcatgtgtcaatcattttgaagttgcatttccacttcacacactctttttttttaaacggataattaggaaattcagccattttgaagttacttgactctggttatggttgttttctaagctctgttaacacacctggtcaaaagtttggaagtcagacatgttttgtttgtcgtttttttttttttttctctgtcagacatggcctgcaccataagcttctgaaaaactctttgaggccagagacttggcttcattgatcttagtatctttggcaatgttttgttcgtagggaagattcagtaaaaggacatttggcatcagactaaaggaaatgtgttccattagatgtttaaatcacggtggtttattttcaaagccatagttttgtagtgtttctttacaacgtgattgaatttaaatgcactgggatgacttcctccaagaagaaggaaactggggggccgagaagatgtggcaaaagcagaaacatgtccatctctcattgggtagggacatcattcatttatttgttcccgtatcattttgcagattccttttcaacctgtacactggctgtctttctctcatccccaagtttcaagatctctggtggtatttcttttccatatcctttacctaccttgccttgctcctccacattcccaattccttcaatttttttttcctctctaatctgctgttttatggatgtcaagatatactctagttactcagctcttaccttagaattgagacttcagagtttcccactaagttccctttgcgatacacaggaaagggaacattaagaggagcacactgagactttaagcaggaaaatcggtaaacgctgaccatactgaacaattaagtctactattacttactggttttcttcttcagagcataaaccgggcttccctttccccagacttggctactgtcccctggcttgcaataacccctggctcctcaaaactctatgccttatacatatgcctttccaagtactcttgccatttggaggatgggaagatactatgtcagagaatcccaggatctgattggatggatataattgtgactgcctcttcctccactgtcaggtaagtctctgaatgtgcctggctgctctgctttctctgagtgccttctgccatgagccaagcttttctgtcaccataagcaatccactcatctcttcaagcagggacacgcatctacgtgattggtggccagatcaaatttctgccttctagaaggcatctttcatatccagtctttcacccttaccagtaatgttatggtctagacttcattgacatggttcctccatggaagatcataatactgtttcccaacccagacatagcatctttctcaacacagaactctaggcaactgctttcattgattggagttgtcattcaaattcaaaatgaagcctacttggcatccctagcagctagtcttctcttgcctagatcattcctcttcatttatttctagccacttgcctcaaccccctcgagtttaaccattgccagttttgattggaaaacctatttattgaacatctctggtgatttttctgctgtacccagttacctctgaatgtgttgcccatctctggaagaagaggtattcctatatacacaccccacattcactgagggcttctctgtggttagttcataactctctttcatatgtggtagccaatgctccattaattaggaatgatgttgaccattctttcttctaaagtctgcacatattccttctggagttgtctgtcatgatagtgtcacacttcaacaatgttgaggctcctggtaaattctacagaaacatttccattttcctttgttttatgtacagaaatatagttattaattaggtccttgggcacaaaaatggaggcaggcatgtgccatttaacatgtgtgttagggttctccagagaaacagagctaataggagagagaaagagagatagacagataagaggagacttattatgggaattggctcatgtgatgatgaaagctgagaaactccataatctgcagtctgcaagctggagaaccagaagagctggtggtttaactcagtctgaaggcctgagaaccaggggagttgatggtgtaactaactcccaagaaccaggagctccaatatcccaggggaggaggaggtggatgtccttgctcaagaagagagagagtgaattccccctttccccatctttttgtcatattcaccttttcattgtattcaggcaggccctcaacagattgggtggtgtccgcccacattggtgagggcagatgtacttgactcagtctaccaattcaaatgccagtttcttctgaatacaccctgaaagactcatccagaaataaagttttaatagacatttgggtatcccttaacccagttcaactgacacataaaattaaccatcacaatatgcttcacatatgtttttaaaatagcttaattttttgtctataagtcttgtacatgggtagtggttgagttagtatcttatcccttgagtttgccaaccccttggatagggtcagtgtcttgggttctctgaatggcatttaacacatggtcacaaaaaccttggtctgaagaactttataatgataaagttcaaggtactttggtgtcttgaggaactccctggactgtgaggcagagactcgcttggctctagtcctggtgctggatctaactggctgccattgtggggctcccctaaagataaaggaactcagtttcctcatctgtgaaatgtgaggatggaattcatcaccatgtcccctcccagctctaaacttctctgagtcttgtttttccctgctctgtatcctccactttctggcatgttttttatatttactattataaatgtgtccctattttataagttgttacagcacgagagagaggtaaggaatagttaacaaaattgtattctgagtagcctaatattcttttttttttcctgctaaacttctttttcctcaccttctcctaacatttttgtgggggtgggtggactggtgggtgactgtagtgatattgatattcagagaggagtgaaaaatgcaaaattgcaaggttaacaacagatggttatatggtgccattttaggagtgttattaaaagaacaaatctattttcctgaatagtaggatgtcttaagtgtttaggcttaaatctactgttgaaatagaaaaagaggaggaagaggaggaggagaggaggaggggaaggaggaggagggggaggaaaagtcaaggaaacacttagaacatttttgcatgatctcaattttcttcttgttccaaggtttttaatttggacagtggtatgtgcttcagattgaatgcaaggaaatttgttgcaccatttgcctgacagttatcattttccttgacgaaaagtttttctgaatcttgctttgctggagctacctcttcccttgccctgaataacctcacttgcttaagtcatcgatgcagtggactgacaccacctttctcttaaggaattaccctgttctctgggtaggtctaatttacactcccactatcacccaaagaagagacactctctatattgataactagaaagaaggaactgagactgttgtccaaggacatcttatctttagcatagagcgaatatgtggtttatggtaggtgttcaacaaacttaaaaaaaaaaacttgtattagtctgctctcatgctgctgaataaagacatatcgaagactgggtaatttaaaaggaaagaggtttaatggattcacagttccacatggctggggaggcctcacagtcatgacagaaggcaaaagtcacgtcttatatggcagcaggcaagagagaatgagagccaagtaaaaggagaaaccccttataaaaccgtaagatttcacgagacttactcatttccatgagaacagtattggggaaatcactccccatgactcagttacctcccactgggtccctcccacaagacgtgggaattatgagagctacaattcaagatgagatttgggtagggacacagccaaaccatatcaaaacttaatcaaaaataattgaaatgtcaggaaatagagaaacttattgagcttttttagggaagtggtctttgaacctgttttgctctgcccactggagtatgctgtccatcaaattgttagttcagtgaattatggtacaaacactcagttacattaatatgactattttcttgtatgctaatttgagaacctactccctggagatatgttatcccatgtaatttccaagtgaaatggagagaggatgccttagactgttacttctcatgtttttcattccaatcttcctcagtgcccctctctataatcccaatcctatacatttttaaacaaaggaaagccactcagatcacagtagctcatggacattggtgagaaacgtgaggaaatgtagaggatccccaaattctcacacataaactaaggtgcagccactgggtatcaagcaaggtttcctcactggtttaatgactccagttttccacattgacatttgtgctgggagccttacatatatgattttgtaaaaccctttctgcagcccttcatggtaggtagcagaatatttaaccctattgtaagagacaggagaaaccaaactgctttttctattctcacccgccattctacacagttctccagcagaatcccactggatgtcctatagtttggcccggttctaacactgtctacctggagatagcctcagatctcacaggtaaagggctcagccccacaagactgcccttcacttaaaatgccaatcgcaagtcccagattgtggtctgtacttctgagcaactggccataaattgggggttcccccaggccctttgtcatgtttgattaatttgctagagtggctcacagaactcagggaaatgctttacttgctactgcccatttatcacaaaggattttttaaagatacaagtggacagccagatgaagagatagatgcatagaacatggtttggaagcatcctgagtgcaggagcttctgtccccatggaattggggaacactaccctttgggcacatggatgacatgcatgtgtttttgttcacaaactgagaagctctctgaacccagtccttttgggtttttatggaggcttcatcacataggcacaattgtttaaatcatttacataaatatgattgatcaactcttccctctcagatgttgaaggtgggactgagagtcccagccctctaatcatatggttggttcccctggcaaccaacccccatcctgaggctatccaggagcccccagccacaagtcaccctaatactatacaaaaggacgcttattttggagattccaagggttttaggagttgtgtgccagggatgaagaccaaatatatcttattataaatcacaatatcacacctattataaagcactacatataaagtttacactccaagaataaaagatacaaatatggaatcttcaaatgccaagggcctactggatactgtgaatgacaatataagctacatcacctgttattgaaaaccagaatgcaagtgtaaacttgaccagggaacctgcggagatggagaagtttgacacctctccagcagcatcatagaaatgaacatcatgagcgcattgagggggagggttaatgtcttcatcgttcttcctctggtagaattatatttgcatccttcctggtggaaacttgatacttcactgtagtgcacctgtacctgtttttttttttttttttttttttttactttcttggagggagagttcttctatctcagaagatagaagaaatagctggaaactctatattcctgtgccctagcacaggagaccaggggtctccaactggtctgtggccttttaggaactggaccacacagcaggaggtgagcagtgggcgagtaagcaaagcttcatctgtatttacagtgactccccatcactcatatttccacctgagttctgcgtcctatcagatcagcagcagcattagattctcattggagcacaagccctgttgtgaactgcatatgtgaggaatctaggatgtgtgctccttatgagaatctaatgcctgatgatctgtcactgtctcccatcacccccagatgggactgtctacagatgggactgtctagttgcagaaaaacaagctcagggctaccaccgatttgatactatggtgagtatgtaatgataataaagcgtacaataaatgtaatgtatttgaatcagcccaaagtcacccccaccgacccacccagtccatggaaaaattgtcttccatgaaaccagtccctgctgccaaaaaagttggggactgttgccctagcaggtagagcaagggtatttcacttaggcttgaccaatcgaatgccttcattctggattttggatctgggagaagtcttgcagagacgaagcaacatttgagaagggttttaaggctagtttgagtttagtgtgctggtcctggctgccatgcattgagcagatagttcctgtggtaagacctgctgcccaagccacccttggtttctgcctagttttctaacacttctgtcaattctccattcttgaatagtcttctaatataggccttttctgctttaggtagccagacagaactgttccttgcaaccagtgactgtctaattcagtcacttaatgttttgtagctttgttcagttactgggcacaacccactttctgctcaggcggcttggagacagccatgggccatatgaatcgctattattttaactttcatagtaagaacttgctccatgtgggaaagcataattattttggtttctgagtttaataagcagaaagcaaagaagaaaaaaaatactgtttgcactgagcattaaaatataaggaagtaaagttgtttatagatagagtttcagctaagcaccaaaggtttatttatattttttgccatttatattttctgcctagttctgcctaggaaccagggaaatccatggcaaggagaaaataaagcatcaaagaggatgaaaatgttgaataaagtattagaacccagaacacttaaatctttaacatccatagtaagagtccttcacattactcaggcagactttttttttttccacctcttggtattctgtgcctacacttgcatgtttaaataacgatttaaaaatcacatgagaaatgatcaggctttctttttcccacttgactctcagttatttcaattctttgagacttgttaaagaaaccgtttagtgttgtaaatgccaccaagtctctacctagtagagattagaaatcctctcaccaattccaagttaaaaaggtcctgacatattttgatggaattggcccatgttctcatttaccagtgaccagctcatctccatgctatgatgctccccaggaaatgtgcatggtttttgtagaaggtggcgagaagcttcatgggcaccagcatccacaacccacttcttgaaaaacaaaatcagatttatatttagctgaccacctggcaagatctcctgtaggaagagaaggaactatacccctattactatttcagcttttattcacaaagtctttatatttgaaaaatgctttataatcattttaattagtggtttctcaccaaagccctggatgtggtattattggcaccattttctgagaagaccgtgtgccattgagatggaattgacacaagatgttaatgggttagaagctggtactagaatcagaatgataggccataggactcagcaagccatgctatttactgtcatcttagagggctaggtagggtggagggaaggagttgatgactgattgttataagtgaaaagggcagcagtgacccaaaacaccattgcaaatgttaacagaggcctgttacagagttaaagctgggttttccaaaacaacacatctgagtaaaagcgcccttggtacattagccagtatggagccagcacctgagatcacactgtgtttgcccctttctgcaatggctattggtgctggttgcttgtcttggcctaagagttttcagctgggcttttgagcaagctgcatcttgaatctgaggatgcgggcaagccaggcacagaactgtgagggtccttgcaatgggctgctggtgttcctgtcattcataagcttggacttggtccccactgtgtttgatttgggagaggttctttgaccatacaactcttaccgtgtaaatgtgctacaatccttgtcaagacatagcaaactatatttgaacattgttttaccatttactgttgtgtgcatgtgggccatattttcctagtcagatggtgagttctgtgagggcaaaggctgagtcattctctatttacattttaagtaggcatccagagacttggttatattctgagtctgtattattgatcaaagccctcacctggagtttctggggccattcactgacccagaatctggtgacattgacacagggagggaataacatccagctacagatggttaacacaggtctttagtgccccaatccccattttgctgactcatctatgcctcaagaactccaatcttcatgcagattctgttgcccttgagtactcagttctgtctcttctgcatacctctgtggagccttggatcctgtcagactcttcgtgttgctgaagttctcagtcctctctctcagccgagtgtaatagtgccccagtgggcactgtagggacagaactgagtttcttcttttcttttaggagttgattctctccgggtaatatctggagctctctaaagtttcagagagaaatacgttccttataaaccttgtggttgtcatgctggtgactccttgagcctgtcctgtgctggaccgtgaggaaggacacaaggccatccagactcctggactcacagtgatttcttgtcctccccaaagatgcctttgcctggtgcactctttaatagcccatcacttcttgctggctgtgtccccagctgagttcctccaggatatggcatcaactctgaacacatctctgtatattccctcttaggaccataagattcatgttaaacttagtgccagaaataaccttgggtagccatgttccttatggttccttagattacattcctagattacacattttacattaaaaaaaaaaaaacaaaacccaaagcacctagaaccgtgctggattcttgataaatgcttgtatccattaaatacatattgaagtaacttctactccagtgacccctctcttgaggcttactgtttacctcctcactttggggagctacccagccaggaccttctgagagagaaaagtggtatatttagtagtcaccagatagttactgttaacggtgctgagttcttaaaaaaacctgttaattgtactagcttaagactaaagtatatgttcctctcctcgtagagtgatgatgatggttttataaatactggttggatagcactgtaattaatgggcacaccagcttttattttggtaacaatgtattcttataccacatttaagaggtttctctttcctgtggtcataaagtgattaaaaaaaaaaaagagaggagagagatgacatcctttttaataaggcatcccaagcagtctaagtacctatgaattataaatgaaaacttttcagtgattaaaataaatataccaatgcagtccccttctctgcgtcattgcttcgccaggcctgcatgaaaatcactcagaggaagtcccaaggggccctgagatcatttgcatctgttccatgtgtttctctgatttatatcagagtgcatcaagggcagtggccttccagctggtttgggaagagggattcttttatccagaggaggcatcagctgatggtcagttagggctctggagtgcagctccatgtaaacaactagcctttgtagtaatggccatataatataacctagtccatgttttgttccctcaagaaccaatttacaacatttaatgttcaaggatggttccattcctttctttgtttacacaggtgaggctttatttagtagtgggaagtgaagggcagatggtttaaggggttcttaatgctgcaggagaggcccataaactgaagtatccaagaaaatccattctaaataagaggcaaacagagtctcagatggatataaattagtattattcttaggaatccttccttcccatttctcagacttatagcaaagctcttactgatatcagtggccattgtgcaagtgggtagcagggaaatcaccctcaatgaccaaatggaagtacatgaggaaaaagatggagaatcctggataaagaagacaactggctgggctccatggctcacatctataatcccagcgctttgggaggctgatgcgggtggatcacttgatgttaggtgtttgagaccagcctgaccaacatgacaaaaccccatctctactaaaaataaaatacgtaaattagtcaggcgtggtggtgggcgtctgtaatcccagctgctcgggaggctgatgcaggagaatcgcttgaacccaagaggcagaggttgcagtgagccaagattgcaccactgcactccagcctgggcaacagagtgagactccatctcaaaaaaaaacacaaaaaactgtctttttctagccctatttatttcaccctacactccatttaccttttatttgttgttaattaaataacattaatttttgttgtaggattatacgtaagaaactattggccttttgctgattgtgctggaatttaaaagttgtagggattgtgggccattgttctaaaatggctcattttgccaaacatgattaatggcttttggggtgcagtttatgtcaaggcaaaattagtggacacttcagcaaactggaatgtggttctgagctaaggggatattcacttagccattcctagacctttcttctatcagaacacgtctttaaggttgaatatccaacattttcaaacattttagtcttaaattctacctttagagtattattgatggtctgattagataatgaaataaattttctctcagcaatgtctgtaataaaacataatgcaggaaagatagcatttaataaaatatttgtttaatgttaataatatttattaccatcagattagaatcaagttaacatcaaattagtaagagatatgtcagtcacaggacttgtagggatgcgagaaaaagaccaccagagaaactgaagaaacaactggaatcatctttgaagaatttcaaactcatcattgagacattggcgagactgggaaaattatttctgaatcttgaaagaatgatgccccaagaccagatcatttaaccattatgtgtctggagagccatcatgcttcctggtatatttactgtggaaaaccctgactctcaaaaattaaaggaaaattacaactgtaataaattggcctgaattgcatggattcataagaccactctctttccatttcttcctacttaatgttgttttcacatagtgatcacttagcagagtttgggaataataactggcaaaaaagctaaaattcttagtccctaaaggaaaagtttgcaaacttattatttaatgttttaaaacccctttcccccgatgaatgttaccctgtccctaggagaagcttctctttcatgagttcatagatcaacagtggaaagatgattgtatttttgagccttgaggttcaactttttctcttctaagtcttttattctgcaagagcccttttgaatgatttaaaatggcattctccatttattcgtatttatcgaaaatctatttggagcaaggtattacatttaaagacagagaagaaatggttcatccactcagctaatatttattgtgtgtacactatgtagctacaagctgggaacagagtggagagcaaaagaagacaccattcctgctcttctacagttgagtctggtagaggagacattcatgattcattttttttttttttttgaagcggtataaccacccagtgggttcacattgcctgctgccttcacagagccaatgtatcgagacaggggaattgcagtgaagaaagagtaattcacacagagccagctgtgcaggaatgagagttttattattactgaaatcagtctcctgaagcattcagggatcagagtttttaaagataatttggcaggtaggggctcaggaagcgaggagtgatgattggtcaggttggagatggaatcatagaggggtcgaagtgagtttttcttgctgtctatgttcctgggtggaatggcagaattggttgagccacattactggtctgggtggtgtcagctgatccatggagtgcagagtctgcaaaatatctcaagaactgatgttaggttttacaatagtgatgttatccccaggagcaatttggggaggttcagactcttggagccagaggctgcatgacccctaaactgtaatttctaatcttgtagctaatttgttagtactgcaaaggcagactggtccctaggcaagaagggggtctacgtgggaaagggctgctagcaattttgcttcagagtcaaaccatggacagaattccttcccaaagttagttcagcctacgcccaagaatgaacaaggacagcttaaaggatagaaacaagatggagtaggttaggtctgatttctttcaccatcataatttcctcagttaaaattttgtaaaggtggtttcaatggagcctcactctgttgcccaggttggagcgtactggttccatctcagcttactgcaacctctacctcctgggttcaagcgattcttgtgtctcagcctcccaagtaggtaggattacaggcatctgccaccacactgggctaatttttttgtggatttttagtagagatggggtttcaccatgttggccaggctgatctcaaacttctgacctcaagtgatccacctgccttggcctcccaaaatgctgggattacaggtgtgaaccaccacgcccagccatgaatctttagattactcaagtaaatgtaaaattataagtgtggtaaatgacaggagatgtatagtagaggaatctcatctgtctagggataaagggctcccctgtggaagtgatatttaagggaagattaaaggattaagaacaattaatttgggaagggatggtgtcttagtctgttctctgttacctgagactgagtaatttattttaaaaactcagaaatttattttttacggttccagaggctaagaagtccaaagttaatgggctgtcatttggcaagaaccttcttgctctatcatctcatggtggagggcaggaaagcaagagagcacacatgccacagagagcaacagagggccaaactcacttttataacaagcccagtcttatgatacaaacctactctcacaataatgacatcaatccattcatgagggctctgccctcatgacctaaccacctctaagttctacctctcaacactcttgcattgggggttaagtttccaactcatgaacttcagaggacacattcaaatcatagcattctgcctctggtattcaaaattcacattcttctcacatgtaaaatatatttatttcataccaattgctctaaaaatcttaactcattccaacatcagcttaaaagtccaaagtccatagtctcatctaaatcagatatgtgtgagactcaaggcatgattcaccctgaggcaaattcccctccagctgtgagcctgtgaaattaaacaatttatctatttttgatacaatggtgagacaggcataggatagccattcttattccaaaatggagaaataggcaagaaaaaaagagtaactagtcccaagtgagttcaaaacccaacaggaaaaacaacataaagtcgtaaatctggagaataatctccacacccttaatattgtctcccaaacatgcttttttcattctttacatggccaggctgaaaattttcaaaacttttactttcttcttcccttttagttacaaatttgtctttaaatcatttccttcttattttactgtaagtggctgaaagaagccatgcagcaccttcaactttgctacttaggcatttgctacttagcctagttcatcactcttaagttctgccttccataaagtcctaggacatagacacaattccaccaagtttgtaactgtatcacaaggatggcctttactccagtttccaatacactgttcctcagatccatctgagacttcatcaggatggccattactgtccatgtttctaccaacatactgatcatgacgtcttaagtaacctctaggaaatcccagtttctctgcagttcttttcttcctctgagttctcaccagaatcacccttaatgccccattcatgacaatctatgcttcttaaaatcttgctcctccaaattcttccagcctctacctattactaaattccaaagcttcttccgtgttttcaggtatttgttactgtaataaaccctcttctcgataccaattttttgtcttagtttattttgtgctgtttataacagaataccagagactgggtaatttataaagaaaagaaagccagcgtctggcaagaaccttcttgctgcatgatcctgtggcagaaggcagaagggcaagagaacatgtgcacaagagagaacaaaagagggccgaactcacttttataacaaaccactcttgcaataatgacattaatctattcatgagccctcatgacctaattgcctgttaaaggtcccacttcccaacactgttgcatggggattaggtttccagcacataaactttggagaacacattcaaatcgtagcacatggggtacagaattatattgcagatacagacagcagctcatgccaatgctgtgtggtaagagaaagcacagggctattgaaagaatgaacaagggtaagggcactggcacccagagggcaaggaagagtacaggtgggatgaatccagagtgggaggtggagactaccaccaggctatgcaggaccttataaccactttaaaaatttgagaagtctgggtgcagtggctcatgcctgtaatcccagcactttgggaggccaaggcgggcagatcacgaagtcaggagattgagaccatcctggctaacatggtgaaaccccatctctactaaaaatacaaaaaattagctgggcatggtggcaggcgtctgtagtcccagctattcaggagactaaggcaggagaatggcatgaacctgggaggcagagcttgcagtgagccgagattgcaccactgcactccagcctgggtgacagagcaagactccatctaaaaaaaaaaaaaaaaaaaaaaaaaattgagagataggagggtcacttgaggccaggagttcaagaccagcctgggcaacatagcaagaacccatctctacaaaaaaatagaaaaaaattatttgggtatggtgatgcaaacctgtagtctcagctactcaggaggctgagggtgggaagatcacttgtgtccatgagttcgaggctgcagtaagctggtattgtgccactgcactccagcctgggcaacagagtgagaccctgtcttttaaaaaaatgagggttttattcaaagaacaatggaaaatcattgatgggttttaagcagtaaacatgaagggaacacatttgtggtttgcaaagattgctttagtgcctttggagaggagtggtagtaagatcatccagggtgctattgttcccaggtgaaagatgcaataattcaggtggaccccttaaagaaagagatatggatgagttctagagatgtggaagaggcagaatcaatagaacttggtattgattgaatatggtgtgggggcagggttattagcatggcccctagatttctagcctgctgagtaggatgaatggtcacaccattcactgagatagaaagctgagataaaacaagatttaggaggaaagttgacttttactttggacaggttgaattcaaagtatagtatggtgtcataaagtaagctgttgttacatagcctaaaaatgagtggatttttaaaaggtcaagatgggcagaagtagagcattccagttatctaacattgcatgataaagtcccaacagttatggcttaaaacaacatttactgtgctcattaatctgaattttggcaaggcttggtggatagcttatctccgcaccacttggtgtcagctgggggagcctgaggctggggttggaatcataagacagcttgctcactcaaatgtatggcagttgatgctggctgttggccgaacttgagcaggggttgtggctggagcacctactcgtgtcctttacatgtggctgcttagcttcttcagagcttggtctgctgggtttcaaggtgagtgtcacaagaataaagtgagagccagacagagactatcacctttcatgacctcgcctcagaagtcatctagcatcacttccatggcattctgttcattagacatggcccagccatattcagggtaaggggaattagagttcactcttcaatggggggagtgttgaagaatttgacaacatgttttaaaaccaccacatggcggggcagagaagaaatcagttatcattccagctggaaggaacaggttgaaacgggaaggtagaaattatattcaatagaagtggagtggttgctgttggctggcctggagcatgtatgaagggttatgaacagtgtgaaatataggttaaaggaacgtttgggaccaaattatggtggagcccaaatttcctgaaacccattattttgaatctggaaacaaattgtcagagaggaatacaaatcagatttattaaataaagataaaaagtagaagcaaacagtgactggcatgggataggaataattctacttgctgataaaataattcatgccaattttggggtgtctagtctacagatttggggtcatatatctccaaatttaaattgtagacatattcaaatgtctttagttgggctttgtaccttatgccagtcaaaaacatgagtcaaaaaaatcatgcctgtatggttcccttcggaggtatctctcctttatcctttagcagattaagataagaatcttggtctttttgatcctggctgtggcttcaaatttttcccatcttactattgggctacccaaaaggactgcatcagacaagactggtgagttgaatagtgttcctcccaaattcacgtctacctggaacctcagaatgttactttatatggaaataggaactttgtagatgtaattagttaaggttcttgagatgaaatcatcctggatttagggtgggccctgaatccaattattgttgtcattaagaaattgagaaggcacagagacaaagcaaagaagcccatggggagatgcagaagctgaccttggagttatgcatctagaaccaaggaatgccaggagcaccagaagctggaagaggcaagaaaggattcttccctagagccttcagagggagcgtgaccctgtcaacaccttgattccagacttcgggcctctaaaactcagagagaataaatttctgttttaagccacgtagtttgtggcaacttcttatggcagtcctaggaaattatacacgaagttagagccaggcatgatgtattagtccattctcacactgctataaaaaattacctgagactgggtaatttgtaaagaaaagaggatccccaggctctatggaaagcatgcctggggagacttcaggaaacttacaatcatggcagaaggttaaggggaagcaggcacgtcttacatagcccaagcagaaggaagagaaattgctgcgaggtgctacatacttctaaacaaccagatctcgtaagaactcactcactgccaagagaacagcaagggggaaatccacccctaccacccagtcacctcccaccaggccctcctccacattgatccaatcacctcctaccaggcccctctttcaaccttggggattacaatttgacatgagatttgggtagggacgcaaatccaatccatgtcacgtggaaaatatgggtgttggtttgccagatgccaaacagaaacaacatttgatctgttgataattgtgtatcctctttatcaggtctatcttaaggaaatcagagagtagagcatattttcttcatggaatggtgagacacatattagcctgagacaggagctaaggagagtgagtggtgggctccaccaaagtgccttcatacaactacactggtaggtgatcagaacaaagggacacgtagaacgaagacccgggtgtgtaacccaaatgcctaacaaagtccattcaatgtatgaggtgttgctgctgtgtgctgaaggaggaaacctgggtcttagtctctgttatggtaaatagagaagaaatcaagccttcctacgacaataggggatttttaatgaagtaaaggagacagaagaaatgtcccaaaggagaatgaagtatgtcaaaaacagattgcgcatgtaattactttctcaggccttcctgacattatcagcaggacttgtgttttgatgaaaaaacttaattaaaacttaatttttttaagtggaaaatattcagcatggttacaggaagactgaaatcagggcactgtgtaattttaattgccttcgagagatgcacttcacgtgaagactagcatgggggaaaaaagctagaggcacaaagtctgaggggagtggccacgctgaatctctagctgtgtgcttgggcgccattttccccactcttacagttgacgggatggcatctcaggtttcacgtgtaggggaggagagtgggtctgttctggagtgtgccggtcaggccatacttggcatacacattgtagaaagtgtcttgatttttattctcctaaaaagggtaaaaagagattgaggagattacatatcccatgaggcagcagtttttaaatgccactctctggatcagttctatcagaaccatctggttctgattcatttaatctgttttaggacctgtgcacagtgtttctattttaaaaataaacctgtcctactcattcttggagtcaggtgtgggaactacaggtttttaatggaagaaacatgaacttgaaaatgagtaaatatgggctacgtcctttacttcccaaggagatttgggttgactgcttagtttcctccatcaaatggggataatatgcttatttgatggggttttgtgaaaataaaagataacacaggtaaagtgactgacacatacagttaagtggtctaaaaatgataaaactgtagaagaagagttggatcaggctgcttgctaaattgggaagggataaggtagtgttcttcagatatttcaagggcagctgcatgagagagagagagagagagagagagtgtgtgtgtgtgtgtgtgtgtgtgtgcgcatgcagcctttagaggtcagactcaagtccagcaggtagaagttatagggagataaatttcaacgcaacagaaagtggaactgtctagtgaatggtccagggatgtcatcagtttgctccagagggtagtacgttccaaatcactggagcaattaaagcagctgccatattttgaggatgtacagggctgtggggcagcaattgaatgagaccacttggttcagctctgtaatagggtttctggcttcctgtggggctgtggctgacatacagttgttttgtaaactaacaacacttgaagaaggttttagcagaaaacgtttaccagtaagatatgtcaggtcaagtacactgttttaggtattctttactggggacattcttgtgaccttcatcccaggcctttcagaaaagggatggggcatatttagaagttattaatgactgagaagctcctctggcacttcaggggagggaactagagctataaaatgtcctgtgattgttctaggactttctccttagtttagctaacatctgggtccttgtcacacggctatgaaatattaggcttacagacactttgaagggtgagaaaaatggaatttattgggtaaaaaggaaaaaaagggaaacagggatgctctgcagagccagattcctgctagtgtgcttcctgcctcacagactgaatcccaggtaccacccaggaagaggaggggccaggctcctccccactgcaaatggcatgaacttcccaagacccctcccccagtgtgcaggccacttggaggttctctggtgacccctttatatttggctgtctcattatgaatgggacaggagtgcgaaattatcccacttcaaatgtcacttgctctctgttgggaaaccctatacctcactgaagcccagatgatctccctgaaccagcctttgagggtcctttttggagccctttggaaacctggtattggatgggttgggttacagggctgctcagcctgacagcctcgcattatctggtgaccacagagtttaaagcagaacattgggaagaaggtagactgggccagttgcacaaagcagagtgtgaagagtgatgggagatgaaggctgtttgcctgcttttcactggggaccagatttggatggatgctggtccaatatgagtgacacagttaacttatcagtgagatccctcattcttctcatcagtgagatagctgggtattgggggaacctgcccccagtatttcaatgtaggttctttctattttccataatatcagctggctgagaaataaagagaaagagtacaaagagaggaattttacacctgggccgccgggggtgacatcacatatcggtaggaccttgatgcctgcccaagccttgaaaccagcaagtttttattaaggatttcaaaaggggagggggtgtacgaccagggagtaggtacaaagatcacatgcttcaaagggcaaaaggtagaacaaagatcatatgcttctggggaaacagaacaaagggcaaaaggcagaactcctgataagggtctatgttcagtggtgcacgtattatcttgataaacatcttaaacaacagaaaacagagttcgagagcagagaactggtctgaccaaaaatttaccagggtggagtttcccaatcctagtaagcctgaagttactgcaggagaccagggcgtatctcagtccttatctcaaccgcataggacagacattcccagagcggccgtttatagacctcgccccaggaatgcattcgtttcctagcgtattaatattaatattccttgctaggaaaataatttagtgatatctctcctacttgcacaaccgtttataggctctcggcaagaagaaaaatatgtctctttttgcctgaccccgcaggcagtcagaccttatggttgtcttcccttgttccctaaaagtcgctgttattctgttctttttcaaggtacactgatttcatattgttcaaacacacgttttacaatcaatttgtgcagttaacacaattatcacagtgatcctgaggtgatgtacctcctcagcttatgaagataacggtattaagagattaaagtaaagacaggtatgaattataaaagtattaatttgggaactgatacatgtccatattaaaatgaaatcttcacaatttatgttcctctgctgtggctccagccagtccctctgtttggggggggtccctgacttccaacagctggggaccacttaatcagggtaagggcagtagtttgtgttcacagtttgatctccctgcatggtgctaaccaggctgcatggggatctaatgtctgactttggccacggcatcaggctccagccaactgacgtgaaagcaagtttccaaatcgtctctttctaaatagataaatgatactcagtgttcctttagccttccttattttttgcaaatgcctgtccccagtggttctgttgtttgctctgattgccgttttccccagtaagtgggaaaaccccacatcttttccccatcagtattccctaatgaggcttgttccctcaaggggaccttgatgagttacaacagcatgaccatgttcccaagcagcatgctaagaaaaacaatccccagtgatgccctgcaggcaccatttaggagcgggcggtaatgaatccctgagagaattcagtcctccgtatgaaggtgatccagagtgaagtaaacaatttcaccgttaggtggttcaccctgcatgcctcattgctggctttctggaaagccagtaaataaggcagaaaaaatgtatcattccctccagagtgcagggtcccctgtcacccacacaggactcctgcctgtcactttgagtcacagctgggctttctggaacccggattcttgtctctggttagctcaggtcttgcagccatgccaaatccaaactgtgacattgtctgaacagtagggcatcctgttccctggtttggctgagctctgcggagcagaacagtggccgaggttaacatcagataatttcctccaccattcctgagtaccctgagggcttgttacctggaatcaaagacttgtcagaactcaagatgaccttaaaggccagcttattcaacctcccacccaggatatgacttccagaactaaccacccacaatgcagattagtaatatcatacgtggttactcaatgcaattgtgtcatttcaggagaaatgacctgttaccaaagtgtcatgaaacccacattaatgagctgggctgtagtggaggtttactttgatttctgaccttaattattagtggtttggattctttacgtttatgatggattttctgattaccaattatgattcactgtaagccatttttaaaaatatgacatgaagctctgacccacttttaacaacacagtggcaaatgccaaacaattggcaatttccccttctaatatcagctgtttgaatcatcacatctactgtggtggctggggaccactttatcttcattctctggcttcagtattcttttctggtattgtcattactgacctaggtgcatatctgtactaggctgggacctcagctctatgccagtgagaaaatgaggttcaactgggaaaacggcctggagcagttgctctcaggcttgtctgcagattagaatcacctgtagacttttaaaaaatactgacacttgggttccgctcttggaaattctaatggatctggggtgcagcctgggcatctggaattttacagtctacctgagtaattccaatgagcaggtgggtggccttgcaaaccggggtctgaaggggctggtcagcaaggagtatgggcaaaatagtgctggctggctgggcgcagtggcttacgcctgtgatcccagcatttgggaggctgaggcaggaggatcatgaggtcaagagttcgagaacagcctggccaacatggtgaaaccttgtctctactaaagatacaaaaaattagctgggcgtggtggcacgggcctgtaatcccagctacttgggaagctgaggcaggagaatcacttgaacccaggaggcagaggttgcagtgagccaagatcccacttggctgccactgcactccagcctgggtgacagggtgagactccatctcaaaaaaaaaaaaaaaaaaaaaaaaatagtggtggccaaggggtgtttataaaacagagttgtgatacatgttcatacattcacctttgaggtctgatttggtggtagcaggagtttcaggggaaatgtttactgatcaggttgatgagtgtccagggacaagatgtgtctgctaagagttagattgatggcaaagattgggcagattgatagttctctagcaaataagatgagatctgctatttcagcaggaaacaagtaaggaagttgaacaaaaagctagtggtatgggccatgtccacaagctgtggttaaaggcaaaggctgaagcctgattggcgtgcccacactgggctgggcactgtcagggacagccaggctgactccagagcctgccttctggttggcttctcccggcttaagtctggccctgcaggaaaaccgacaggagttttcatgccaaccaagactgagacaatcagagactggcaggtttggaaccaggaggtctggatggggaggttggctctgaatctgttgtcattatcaggtgagtcattaggaccacctggaaaagtgaagctgttcttcaccttctcttcttgtgaaagtgattcaatctcccaaacccaggttgatcataccctttaggtctaatataggaagtgttgaattaggtgatgtctctaaagaactctctctgggttccttagagaaaaatagcatttgaacattgtgcctcagcaggaaagaagatgcaatttaagtcctgcaccaaggcattcagggctcacctcaaagtggactcctaggaacaagaagcaaatgattccgtggagagggttagatgtctggccaatggaaacggggatgtagttcaggttttctagccccagaagttcagaacctttgggttcctcggtggacatgtctgttactcgcttgaaactagggaaagtctcttgtgtagaaaacctgttgcatgtcccttgactaccagtagcagcagaggtgctatgtgtggctgaagaattttcctcctttttctgagagatgatttcccaggtttccttctccacaattctgtgggcgtgtactgctgtgataagatgtttgttctctggcttataaattacaagatattttcaggaccacttggaagaaattggaacattttcctggaggcagtgggggagctgctggaggttttcggacaggcgggccacatgctgagagaggtattttgggaaaatgcacttggcagtcatgtgtgggtgaggataataatattaatacttaaccactggcttgttgggaagagtaaggggaacaatgtaagtgagtgtaaagatgcaggaccaccattcctttgttcattctttttttttctttttctttttttatactttacattctgggatacatgtgcagaacgtgcaggtttgttacataggtatacatgtgccatggtggtttgctgcacccatcaacctgccatctacattaggtatttctcctaatgctatccctcccttagccccgcactttgtccattcttttagtttctctgagacctggtgccccaaggataccatcttctcctgaccagtgtatcagtttgcgagagttgccataaaaaaatagcacagactgggtggcttcaacaacagaaatatattttctcatagttctgtaggtgggaagcctgagaatgaaaggcatcggtagggctggtccctcctcagggccgcgagggcagggtctattccaggccttcctccttggcttgtagatggtcaccctcttccctgtctcttcatgtcatcatctctctttgtgtccgaatttcttcttctcgtgaggacaccagtcatattggattagggcccaccctaatgactgcattttaacttaattacctctgaaaagatcctgtctccaaagatggtcatatgtgagatactggggttaggacttccacatataattttttgaggggatacaattcagtccataacagccagtctttttgaagactttctcttttgggggctttacacttaggtaattacaggatattttaaggggtatttcaagacccagcaacccccttctccacccaccatctcccccaaattatgttcgtcacctcctggtacctgttatatcatcactagaattgcttggttgaatcaagtaatgtttcaagataatttccgtaaacatgcactctttttatgtaagaggggtaataatagagccagtgaaatactggatgaattcatttaccaaactacgtaaaagtactgatatatgacaactacttagggaacctaagatttgggacatagagcagcctatttagaatatccggtataacattgcagggaatagcaagggctctagagctttccgcctgggttgaaatctcagctccacccttttctttctgtgtggcattcagcaagttacttaacccacctgtgattcttccttcatctgaacaagcagcataacaatagcatttacctcatgattctttagaaggtgaatgagctaatacctaatatagtgcttagagtagtgtcttgtctgtggttggctttcaataaatgttagctgctattgttgttgttaaactatttaacaaactacgaagcacattcctatctgctttcttctttgcccttgtaacagccctgtggagtagaaggagttagttacattttacagatgaagagactgaggctctaagacattatgcgaaccatctcagggcatatggcagtgttattcagaacatctatcggtaaagaacaagaattccaaaaatataggattttccccaggaaggagggccagagtgtgggctactgtgggatggcctccgggcagagtgtgagggtaggcgctccaaagagtaaggcatctggagaagagaaacaatgaaagaggcaaacgctggatgagaaggacctcaaagcagaactttgcctctcggcctctcagtcaattgtgatctgactgacatccagattgtgatcttgttcaggtggctgaactttgaacccttcttggccatttgatgctaaaggcagtctttgaatgtgatgttttcctagatcgtactggtggaatttagttgcctcagatttcccagtcatgtgccagcactgccaagtgatctccatgtgtgggttttatgatgtgtttccagtgctccacatatggcctgtgatttttttttcctatggctcctaatgaaacactcagaacactgcactgaatagaagtttctccctattctccagagtggggatccttattgcatcgtcaagcatggacaccaaaaataaatggggagaaatctctattctcttagtgatgaggcactcttggaggaagatattattaacatgactacgtcttgccaatttgaaactttgcaaatatctgtaaggttgaccagtttttataatttcaagattttaagttcaacttaaggtactttacaaaattatttttatcataataaattacagttctttacacctgtgtcttttaccgattagattgtgagctactttatgggtgagcaccagtatctacttaactttgtactaaatggctcaatattgcctggaaaatagtaggtgcccaataaatagtaaatgttgttcgatcaaatcataaatgtagatataagctaaacctcttccctgggcaactggaaatgcccatgttatgtcttaaaacacattgaattcaggtgggagaataaaaatgattttaacaaatccagtgtgctttttgaaggcagaactacaattacttcttttttccctcataatcaaatcaacctgtgaaattggaagccaataaatatgtaaaaaagtcatcaaatgtcataggagaggactactatttgattcacacgtgatctttgtcgtttaattgcgtgtggcaagaatgaatggaagtgatattaagtggagaaaaactcagtcccattggtgagttatttaccttgaccactgtgatgggctgaattgtgttcccctaaaattcctatgttgaagtcctaacccccagtatctcagaatgtgactgtatttggagatacagtctttcaaaaggtgattaagttaaagtgaaaatgaggcctttgggatgggtcctaatccaatatggttgttgtctttacaagaagaaaacatttggccacatggagagatacaagggatgcacatgcatggaggaaagaacatgtgaagacatttacaagccataaaaagagccctttcagagactaaccgtgctgacaccttgactttgaacttccagccctccaggactgtgagaaaataaatttctgttgcttaagtcacacagtctgtggtattttattatgatagccctaccaaactaatacaaccacctactttttagaatttgtagaatccaagcacttaagattacaaaaatgcatgtttattgtggcactattcacaatagtgaagacttggaaccaatccaaatgcacatcaatgatagactggataaagaaaatgtggcacatatacaccatggaatgctatgcagccataaaagaggatgagttcgtgtcctttgcagagacttggatgaagctggaaaccatcattctcagcaaactaacacgagaacagaaaaccaaacaccgcatgttctcactcataagttgaacaatgagaacacatgagcacaaggaggggaacatcacataccagggcctgttgggggctggggagctacaggagggatagcattagaagaaatacctaatgtagatgacgggttgatgggtgcaccaaaccaccatggcacgtgtatacctatgtaagaaacctgcatgttctgcacatgtatcccagaactttaaagtataataataaaaaaaagcaataaagaggaggtgatggtaataggcacagacttttgcttgcgttgaggaaatattctaagtttcacaatggggtgtggaagaatctgtgcgaatctccttctgacctctcgtggtaccatttcctcattactcagtgatgaccccagagccagtcttggatgaggcggggtggaattttccacacaggtgccatgagctagggggctcaaaacagacactgtggtgaggttattactgaaatattctgtttctatgaagtttctaacgtaattctgggccctctttctacaaccttagcaagttgctgaactacaggagtgcggagtaacaatgcctttcatgtcaattctgtttacagccaggcttgcttgcattaaactggacacatccatcaactagagtgctggataacagatgagaaaaagctaagtttgagttgtcttttatattgtataatggtgcttctattttctttgttttcttcttgttcttaagttctgtgggaaacccacgggaagaggagtctatccagggtatttgacttcaaatcatttcatctcttctgttcttcctctcatctagtcctctgtgttcttgtaatatacgcaagggcaagattaatagtagaacagaattctgctatgaaatttaagtgatgtgaattctttctcaaaattccaagaatgaaaactttgactatgatatagccaataatttgcacttgtttgcatttgacattgctcatttacattaactagcgtaaaatacctaattagtacagcagaaaaaaaaaaactatatgaggaaaaaaagaaatgattgctcttttactcactggagggaaaggttggatttatttcagctctgtgtttagaaaaatacctttgctgggcttcttggagtgtgaaaagagtggaccctgacccacctctattccctgctgggccatctggaaggattttcacaacaaagataaggctaaaccactctgcaaaatgaaaccagaggaatttcatgagttctggggagtagaaagaagtagggtgagctctgacaaggatgatggggttgggcatgtgatgtctggagttggggctaaggaggccagtccaggagatggtccctgaggtaggatgggagtggggccaggcaactgtaagacagcgatgtctcatgttattgagctttgctatttcgtaacctctatctgccacactttctaaaacctttgcataactactgggtatctaccgagaggaaaagaagtcattatacgaaaaagatacttgtatatgcatatttatggcagcacaattcgcaattgcaaaaatatgtaaccagtccaaatgcccatcaatcaatgagtggataaagacactgtgagatacacatatatatatacacacacacacatatatatacatatacatatgtgtgtatatatatatgatggaacaccacacagccataaaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaataaaaaattaaaaaataataaaaataaaataaaatctttataagactactgtacctgttagagcctcctttctgggaaattaaaactctaattgtttccacattagcttatgaggtggttggtaaaagagaatgactacaggaaatgaaatgccaatgaggttgataattcagtgggaccaacaagtcacagtcaaccagtgatggagatggtaaacctactaggaatccacagaaattttgaggcaggtaccggactctcaagagtgtgtgagattggtgaggctttggcctgagccattgaaaataaatgcataaatagcaacacttagcagaccggaaaacatgggggaaaacccagacaagagacacttgggatttgtcagtaaaaaatggagttgtgaggctgggtgcagtggctcacgcctgtaatcccagtactttgggaggctgaggtgggcggatcacgaggtcaggcgttcgagaccagcctggccaacgtggtgaaaccccatctccactaaaaatacaaaaattagccaggtgtggtggcactcacctgtaatcgcaactactcaggaggctgaggtaggagaatcacttgaatctgggaggcaatggttgcagtgagccaagattgcaccactgcactccagcctgggcaacagagtgagactccatctcaaaaaaaaaaaaaaaaatgcagttgtggaagctttgaaatccctgctgtgaggttatggaaggagaatgtttctgttcaagtatgaatcttttttgggaggggtggcaagaggaaggtatgcaaagggaatggtgaataaaatgaaaaggttcgactttttggtggttagtcacctaagaaggttttgtgggggaaataatgtgttttagccagcaaggggattgtttaacctgccctctaccagtctgccgtgcctcacccacttgtctacagctgtcctgttagttgtagcattttgttttcttttatgcaaagggattttcttatgacactcaaggagaacccaggagagggaaggcatctctgccttccagggacaaagtttcagaactgtactgctctacagtggtaaaaagacaacaaagtctttgatttgcaggttgcttgtttcacttaccctgtgaagtggagctcagttggaatatttcatctggccactctttagatgttcacggcagccctgcctggccagccatgaggtcgggcggagaaaggaagcaaggatgagtgaggagggagagaaatggccctggagtttgttgttggagatcttctctgtgtcaaacatcttaagggaatcacctcatggaatcttcgccacaacccattgatatggggattattttccattttataatgaggaaatgaaaccttagaataacagcaagaagctcagacaactatgaagtggcagggtgcagttatgtgactcaaaaccagtgttattttcagaagtgggaaatgtcatgactttgccctcccctccccttctctctcttccttcctttttgttggctatcttgagctgaatggtgataacgcttaactagtggaggtacattttgaataaacagcgactgacttaaatttataatcataattttattctagagttttaacaaatggtaaaacatttagagttatttttccgcagacttgacaaaggtgatgcctgactgtgcctgccgtcatttttttctatttataaaatcagggtaaatttgcaaacttctaaagaagcagacatggcttcagcaaccagtcagggtggaggtgagaccaggaaggttggagctcatgaaaggtcctcctcttctgtctaaggggcacttacttcattggtagctcagctgatactttgggaattccaagaaagagccaggaaccctgctaggaatagagaagcaaagaatccagggctctcactttgaattgctcaccacgtctagaacatgagtcaggcacagacacagaaaagtcagcataatgcgtatgtgcagtgattatgagatgcccatgcagcgtctttacaccagccagggatgcaaggaagaatctccggagaacatctacccaacaggtggatttgcttgtggggaacagaatctgtcaaggagaaacaaagcagtgcagtagttgcatcatcatgaggaaggatgatgtgcagagttagtttcctaagtggcatcgcctataatgagcagcgtgttctcctaccaccttagctgcaagcagttatgctgtatagccaacatctttctcctagctcacaattcaaaagcacattgctgggattccttgggggctttgcgtttatttgttgtggtctagtggtttattctggcaaaatacactgcatggatttttacagtttgctttgtgcttggacatctttccacccaagcaaaatgtttacaaatgccagcacgtcgttttctgaaaatattgctgaaaagaacaaatgtgttgtgatgtgccatgtgtttgaagagaccaggcaaccaaacactaagattgcctcttcctgtcagtgtttttgctcggaatcattctttattgtgcctgtttctccagaactctgtaatccaaaatggtcctgttctctgtggacatgtgtttattctgcaagttaaaaccctttcaagcaattcttgctgtgttaaatataacaatgcactgataaaattctgtcatacattctagaaaatacctttgtataaagtactcatattactgaatttaccaaaacagcataggtaacagattctaagatatcttagagttaattgataatatgtatctgaatgttgtaaaatttatctttcctatgcaaatcccttcaaaccatcccttctagtcccatttttgagacacacacacacacacacacacacacacacacacacacacacacagactgactttgttattccttactggtttttactgatggtcatagacgtctttcttctctgctacttccattatcttcctgccttcaaaatctccactttagttgcagttttgttttactatatttcttatttttaaaaatatataggtaaatagaaattgaaaagctcccattttttgttagattcatgaattcctttatgtaattatttttccaaaattaatcctgaatacagactagtaaatttatatgacaaagaaaatttctatgacaaagcaaaattaatgctgaatacagactagaacatttatatgacaaagaaaatagggaactgtgttgtttcacatactcaggagcttctgaattcaggaattttctagatggagaagatctcattatatggtgacaccagctagccaggtgtactactgaggtctgtctgtgttagactttagaaatagaccaaggatggagggaggtttgagaaatctaagtaaggaagcataggagaccttcttgtttgaggtcaaagaataattggaaggagtggttccatctcacaatttgaaaatgttctaaggaacaaaacgtacttttttatagacctattgatctcagaagatataacacagctggtggagggtaatgatcaatcgccagactaccaccattctattttcttctctgtcaaacgtactcactatattgtgagtgttttcactgcctaatttttcatggcaatttttgaggactggtagctgaactaatttaattctcattctctcacttgttcaccaaatcatttcatgtgtgtttttgccaggtattgttttaaatattgggcactattttcggttcagtaattcaacctattttaatcccttactagcccagttgtaaatttcaaataagtcattttttttcataccagttccctgctttcgagtctctgatgaggctacgctcaagtattacccaggattaggtcctatctgaaagctcaactggggaaggatccacatttgagcttgtttatgcagttgttggtagaattcagttcccttaggacggttggactggggggcctcagctcctagctgactgtgggccagagatcacccttggttccttgacagatgggcctgcccattagggcaaattgaagcatctaagtcagtgagggagagactctactggcaagacagaagtcacaattatatataatggaatcactgaagtgacatctcattatctttgtcatattccattggttagaagcaagttacagcacccacccacatacattcaggagggtgtgtattacacaagcacgtaaacaccaagagatgggatctttggagaccatcatagactctttcctccataccatctgaacatttaatattaatgtagtctgtatttctacataacagttctctgaaaggaaactttgctgtgtgccagataatactttttgatcttcttattttacctttccttaccccacccatgattattactatcaaagctttagggcataacatagtgctaaaatagaacacttactccaaaaatttaattaacaagcaacatgaaataaaaggccatttgcatattgtaggcaaataaaaacattatcaccaggagaagtgagtcagaatatatcaaatataatagctaatattaaatagctgggggtgagagttggaataatgagcagcctctgtacagagggcatgtcaatcaattactctggccctattggagcacctgcctagaagtccttgctgtgcctggttaacccatcagttgctgaatagtggggaggtctctggtggggattctgggaagaggggctgagcagtaattgcggagaaccctaggggatcccagcagtcactatttactaagacatttttattacctaatactctatggctaaatagttaaaagaattaaaaattctcaaatgctttcaaggttggagccagttcatggggtcaggagagctatctccaggcctgcattctactccccttctttttccatccctgccccatccctttcaggcagcacctggtgcacactcaggtgacccagcctacatgtcgaggatccacgtaaacacccctcaaacagatggtcccccgcaggcctcggaatgtggcaaggtctaccattaggaatgtaggctcaggaaaggctccttcaggccctgagagtggacgtggaatcctgatggcggggaatcccagggtcctgtgacccagagcatggtctagaactgtgctgggcagcacagcagccgcacattggctccagagcactggtcgagatgttccttaaatgtaaagtacacaaccaatttcgaagacttaatacaaaaaataaagggcgtaagatatctcatcaataatttttatgttgattatgtgctgacacggtagtgttttggatatactattgggttaaataaaatatataattaaattagttctaactgtttttttctaatatagctactaacaagtttaaagttctatgtgtagcttccatttgtggctcccataacatttctgtggaacagcactgctctagaagggagaagtacggctctgctaggacacatctcctgctaccttggaccccttgccctgtgaggaggaggagctagagcagagccctctaaagcgtggagtcccaggcaggagcctttcttgccccagggtggttttgctttaaggtgatatttatagtctatttggtctcactctgtcatggctaaatgactccaaatctctctcctttgcctacttctgggttttgcccaaggcaagaaaatagtcttcctcaccttccacctgcccacccccactgccactgccaccaccaccgcttttgaatcaatataaccaggcacagaaagtaaaattgttctgtattgacatgtatctttcaagaagctgttattctttgggtgaaacagaatctaatcactaagcaatttttctacagagagagggagacttttcactccccttccccttggtttgtagagtacattcatctttgataattgattcttcgggtggagtaatgatgtaggctcaggaatacgttttttgattcaaagggtataaaaagtgctatgtgtgttaggggttaatgtaagctctgtggaattacaatacggatgtcttctaaagaaaattcactaatctaatctctagagaaggaaacttttagagagtcccttatgactcccttaagaaattattgtggatagtatgttgctgtatgatggctttaagaatttatggtgaatgcttcagaccatggctttagtgtttcaacagaaacagtggcttacttagggtggtggtgcatcttgctcttgaataaatctgatctgagcttacaagtaggaaggagtaatgatttagatgtctgaaatctctttagtttattgtttcttttcttatcgtggcagagagtgactgttaaaactttttcctcctgggcacgtagctggcctacatttcccagcatcccttacagatggctgtggccatgtgactgagactggccaatgggatgctagtggaggtgatatattcttgtccaatcatctactctttctccttttcttctgcctatgagatgcagagtataggggcacatgggcaccacctgagaactctttaggaatgcagaatctttaaccttctcctaggtgtagggaatcagaatctgcattttaccaagattcccaggtaatacctatgctcattaacatttgagaaatattgccctttgagatgacagagccagtagatggaaagatcttgggtccctgccttgtggcttagaggagagccacccaggagtgtggcttcttgaagcagcctgtttagattggtacataaacaggaagtccaattttatcatgatgaggtcactgagattttggagttgtttgttatagcagttagtcttccctggataatatactcacaaagtatttaaacaatgccatgtacctacaatgtatccccttcttaccaataaattctgccaaccaaaatgatcatattgtacctacaatgtccaaaatgtttaatacagactgaggtagaccttataaatggtattggtgaagcctagtggacaattttaagaaatcaccaacattacaaaacgttgactggcaaacttgcgttcaccctatatatgctctgtaaatgttcctagctccctcacttttttgtctttttcttcttcaacggcctccttcacttttcagtagcagcaagattaagaggtgaaaactgccattactccagtgaatgggtgaggtcactgatttgcacaattcctatgagagcccaattaaaagaagatacagagataagcatgtacgttttcatctctcttaactccattatcttattgtcatttggctatgatttatttaggtcaacattgatttctgtagcttatttagatagctagaatgataaaaatatctttttgttatcacaaggagtacaattatttacatatttacctattcatccattcattcttagtatacagaacagtccaatcaggaacaatctgtagtacctatgacaggtacagaaaagcccttaaagattagcctctaaggtgttaatgggagagatttactgatttatatttttccctatggatctggagatacagggtattaacaagatggatgagttattgggggtgcatttgtatgtctcagggtgcatgctgtctctgataattgctgtctgtgtttgattgggcagagccagtatcttaaaaccttcactagaatttcctatattgagacatctaaagttaagaaatctaggtaatttttgcttatcggtttaaattgtgcatagaactaaattattaaataaccagcatgtctaagccttacccttttctttaattacacacatatccatgcatgcacacacatacatgcacacacatacatgcacacgtgctgaggaggaaaaaaaagctgaagggattttgtctgtgcatacatgcgtacatatgcacagacacacacaagaggcacatgtacacatgtatggacctgtgcatgaacacacaaatcccatcaacttctttttttcagccagtcattatagagaggaatgacagcttttatttgctgcaaaaattcaagtggaagaacgtcatatacaagaactaccagcctagtggtagagaaaagaggattctttgaagctctttttagtcagtctgtactagcaatagtccagtgtttcccaacttgagggtgccctcaaggcgttgaaaacataaggtaccactgtgatcgaggttttaccaaattttaactttccttcacttctcacctaaaatatcttgagggtgatctgtgctcagatttgttttaagggttggggggagtattcaccttctgaagtaaaagaaggaacaatttgtcctctgtctggcttctatcatgaaacttcataacccaagagcacatcttgacttcagctttgttatttttagtggtagaggagaggaaacagtaatctgcaaagtgtgagttcaattaccctgacctttcatattgaaatctgaattcttaataagtgttttatgtgcattttatcatttaacccttacaacaaccctatgagataggtagtgttattataccactttgctgaggaggcaactgagacacagaaattaagtaacttgcccagcatttcttgggattctaacctaggccatctggctccagaagctgaactcttaaccacactgctctcctgcagggtcgatgagcttgccatgcctcttggtcattccctaaggtgtggcattttgtgattcgggatctggctaactcatttaaatatggaagtttcacaaagattcaggctgctcagggatacaaaatggctcattggcagggtggggcttccaaggaaatcgatttcattcctttcctaatgggctgcgctagtttgcaaaaatcaagaactgtgacgatttaagatgcatctgaactcttttagatttccatagaacctcactcagcagtcctttcgagatgatgtcatagttcttttgtgtaatctagtaatgccttttaggggaggaagccggtgtattttacaaatgttatcttatccttacaacacccttgaagcttagtaagtgatattagttactgtttgggggattacaaaaattaggttgtggtttttaatgtttatttttatagcaatgagaagtggtacacacacacccatacttatatgcatatttgtaaacatgtgttatgtatattattatatacacgtatgcatcctccccccagcattgatgtgtgtaattcaggtggtatttggttgactccctcctaatattttgcaactgccactaattgtgatggttgttgcactttaaaatgttaaacttttagaatatgtgagaagtgagcaatttggcattggatctagcactgtgtcctcaagtccctttcatgtgctcagtggatttttattgagtgccaattgtgtgccaggcagtggcattacaacagtgaccgaaacaaagtcactccacttgaggacctgaatgtctagtcaaggagctagagagaaaacaaatatatcctctgtcaggtgggggtaaagcgcttctgatgacaaataatgttggctgagctatggtgacatttcagcagaggactgcacgagctctcccaggcttttcttgctctaaagcagtagttctgaaccaggggtgagtttgcagtaactggagatatttttctgccctacctggggcagggctgctgccaggatttcccattcagagtgatttgagaggatctcagtccacctgtaaagaggaaaataccctcttagatttgtagggccacagcctcttttgctgtgcctggaacatactggcagacacctttcctgctggggattttgcaaaatctggggacgtttttggtggttatgcttcggggaagggtgctgctagcatctagtgtgtgaggctggaagtgctgctaacatcctgcagtgtacagggcagctgcccacaacagaatgatctggctcagaatgtcagtagtgccaaagtggataaacctctagaaccacactccccaggggttcagtagactttcccgagtgggcatggaaaggtaaactcaactccctttctgcacgacccctttttctggcccatgagagcctatgctgtggccagtcgctgtgacagaatggttttctgcagggcatccatgctcacagcaggatcagatgccatcttcatgctttgacttgccaaggacattcaccaataaaatgcgcgttcagggagacagctgtcatgacacaacacgtttttcccatgacacacatttcttccgtccctctccaataacctcgactcttgaatgggtgagggacatttcctcaagagctgtttatctgggctttggggctgtcttgtgaattctatttaaaaatactcaaagtccctgagatctttggatctaaataacatactggaaccttcccgtcccctcctctccttggggctatggtaccaacagaagatgaaagctttatttcattttcaaaagtattttatatttctttattttgtaccctcttgataattgatcctcagctgccaggatttcccattcagagtgattcgagaggatgcccaggccacctgtaaagaggataatacactcttagatgtgtagggacacagcctcttatgctgtgcctggaacacactggcagacccctttcctgctccgagtatgcggtaagggggcaagaagctgtatggtggcttctccctggagaagcagcttcagccccttgtgctcctgcactcctgtgctttaagggcgagaacacattggattctttttttttgaggtggggtttcactcttgttgcccaggctcaagtgcaaggcacgatctcagctcactgcgacctctgcctcccaggttcaagcaattctcctgcctcagcctcctgagtagctgggattacaggcataggccaccatgcccagctaattttgtagagatggggtttctccatgttggtcaggctggtctcgaactcctgacctcaggtgatctgcccgccttggccacccaaagtgctgggattacagttatgagccactgcgcccggtgaccacatctgatgctgaaccaaaggcagctcttgggaggtggctctgagcctcccagccgcaaggtaggggagctcaaagatgttttaggagtaagcttgacaagagggtatcaggaaaaattgtttttctttgaatctccccggaatatatcatgtaattcacctcttgaggggtcctagaaagaccacttgccatcccaatatctagccagtcctggagtggacccagtcagagtgcatgaactgtgatacaaggcctatgtcttggtttttttcacctcctgcaagctaggagcctcccaactacccacagattggaagggacttggtgcagggatatggcttcgggtgacaacccacctatcagagctattcaaccattgaacagcatggctgtcagtctgaggtcgcagtgatgtcaggaggtggcagttttggcagctgacagccctcacagatgcccttgtgcagaatgaacctatcaagcattttctctactggctatgaaatggaaagtgaggcaagacattcagttgctgcacaggaaggaaagcagtcagggtggttgcctgagcgtccaggtcccagacaggtctgttctccatggaatacattaagggattgatttacctgtcttggagctgcttcacattgcagtagagggactgtgccgagtgtcatgcaatggccagttatcttgcagaacttgtttgtttctgcaattattaaaagttttcctggcagtttttttgttttgaccgagagtctttcctccaaaaatcattctctccatcctctcagaaccctggataattctctcctgtttgtcgtttgcataccatgtacctggaactcttatgttctggttaagtattctagcataagagagaggaagcaaaataagtcagcagaggatactttcagcatactgtgacttttagaatgttcagttagtgatactaacgtttcatagcctgtaccaataatcaacttttctttcccctgaagacaaagtagcatggttgtgacctatctatactgacttgttttcttcatgcatgcattcaacaaatcttaattgagtgcatgttatgttctaggcgtggggctgggctgaccctctgggaaatgacaagatgaaatgagacacattcctcctttcaagaaagtttgtgtggaatgtagaagatcattcattggttgaggagattgtaaactatcctggaacacagtggtttaggatgaaacaaagcagtgcacaaatgaacgctctagtcagtgaggctccattagaggttcctcaagggtggggactgcgttgagtgtcacgagactcctagggtcagcacagtgcccagcggctggtacgtgctttctaagtatcagctgaaatgctacagcagcacggcctagtggggagggagagagaaagggaggaagagaggggaagggattgaggaaactgacctagattatgggcagtgctggtcccccactctcagcccatgtggcttgggagaatgagcctgtctcttgatgctgtgaactatcaccaagagatcccctaccttgctccccaagttcaccaccaggcttctctccatctcagagcttattgaaaggacatggaatcctctggagggagttctccattgaaaacaaagacaataaattccaagtggcaaatctcataggtggccctgagtccctgtgatttttccagtccaccccttagttgaagtaaggcaaaatttgttttggggtttcataacagtgatgtaagtgcattgctttgaagcagtttttgagggagaggggaaaagcctgagttttggagaactacatttgtggaacccaagaaagtgatacatcttccctcctcccacccctcattgggggagatgacatggggcatacttccctatgtgctttagggggtctctacagaaagggggaaatgggattttgctccttgagtttgctgagggtaggacctgcagacttgctgtggtgccttcagagcaagagggaaagaacacagaaatagataccaccaaaagggatgaggatttcagatggcacacagagcctgctgagcgcatagccatgcaccgctgtgctgtgccttttcctctgacatccctttgcccacatataggagacaatccccttacaaagagccaagagcaagcctgaaggcttctgggagtccagtcggcttggaagtgagggaggaagctgggaaagagtgagcttaggtccgtgaacagtgatgagttcatgaaaatatttgaatctacctgaatagaaagattattttaaactagggaaaatttattttaaactggaagaggctgaaaatataaagtccactaatcttgtctgtctccatgagcttttacacatacgcacatgtgcacacacacgctcgcccatgtaatgttcacttaggtcaagatacagaccaacccaccaccccagaaggagctcttgtgcccctttccaatctctccccaagataaccattattctgacttccatcaattaatcaattttgcctattctttaacttaacataaatgaaatgatatgtgtacttttttgtgtctgactttcttctcctcaatataacgtttatgaaatttatccaagattttgcatgtatcatttttttaatgctgtgtataattccacagcatgaataaaccacaatttgtttatccattcacctgttgatggaaatttgagttatttctaatttttgtttttttcaaatgaaactgccgtgaacatcttgtgcatatcttttggtggacataggcacccatgtctctcagatggataagattcgaattataggttccataggccacatataggtaggcctatttgtatctttatatttgatttgttctattcttctgcccatgacaaaggtagtaaacagggtgtctttgagcagggaggctgaaaatgctctcttgtgagcagggtaagtagatggcttgtgctggtgcagaaaggcaggatgctggagaaatcccaggggaagcatggcaccagtccaaccagagactagggaagactcattaagaataactttttactacatgtaggtccagggaaagctgacatgggaataatgattaaaaggaatcaagtaaaggggcagagaggtagatttaagtaatggaaagatttttggtctgctttctagttttgtcctctagcacaatacgaaataattggctgtgggtatattacaggatcccttagatcttattgtctcatttataaaatataaaggctgtacagggtagttcctaaatggcctttgagctttcatcttctcataattgcatcaataatggcttagttgtaaatgaccaattctagtaataggagaaaatcgcatggaaattactgagaaaagcccagtttacttcatgctgttatcttaacatccacaactacatgtcgagagaatacgaaaatgtgttcttaggcttttccttgttcaaccagtctagccatgtgccattggtccttcaagggcagtggctgagcctcttttcttcctcccccactttttgctccctaccagacaaccttctcccataggtgctagtctgtttcctccctgactcgcattcctgcagccaatgcacctgctggtctgctggctgttgtttctcactcactgaaaaccagatctcaggatggacataggttggtggaccattttcttccagtcattcattcattcacttacagattaactccagttacagtcactgtagctagcatcacatacactaagctatctctcatactcttccagacattgcctaaggctgtggccacccagcccctgccctactgggtggagcccacacttgtgatatctcagagtgcttcctccaaccaaagaacccagccttctgcaggagggacacccctttccccctcagacagtcctgattctggcatattaccagaggccagtctttcctgatctcctcctatcctgagacgttctaggcctccttgagttccagttcgctctttcaagagctgcaccaaaacatctttacaacttgtgtttattatttgctgaagtttagctatcttaataaagaattatacttgtgatgaagtcagggccaggtcagtttgtctttctattcttggttcttagcttgttatctggtatatacaaaatgtttcatgaaaattcttcgtattgaagaaagggaagggttttgccaaaagccctactcaaggctgggaggtactgacgcattactgacacctagggataggctacctaaattgcagggtcatggactatgacaaaacagagtgttagtagtgaacatctcaggtaataccacataactttttaaaggggaaaggtcttcctaatttctataaatagttcaaactttcagacttagaatagtcctgcacttgtggcagtgccctcatagatccagaaagaactgatgttatctgatcttggggaaagtccccgccttgggtttgtaaatatccttactgacggtttctagacatttatgcacgacgttttgtcatgtgggatccagcacatatttctgacctggcgaaaactaagaatatctcaatcataaaaataaccagaaaatcataaaacagaaatctggcccaagattttctctggaaaagtaagaagctgctttgaaaggtgaaaatagaccagtgagcccccgcattggaacagattattccaaaaattgtgagcaaaggtctttttctgtattgtgcaagttaatctcctttgcccctttttgtggctgaaatgcatgcctaatctgcatatgagtgcctgccccaggtgggatggggcatgctgggattcctaaaattcagctggcttgcttgaagagggctatcaggctagatttcatgtctcaacaatttctagccggtctccctgagctggcaagcaccgctcagtttataatagtgcctggcacatggtaggtccagtgtttattaaactaacagatattcccaacaggtgtgggcagcagtgctgctaattagcagtaacatagccgcatggcagggacaggaaaggggagccttctgtgtgtccctactatatgcaatgtatgactccaatctcaaaagaagcagagaatactcagccaaatatttgcattgattcctgccaacaccatttttttgtgatttgtatgttcccttccccaccccccaccccctgtactgttaacttcatatttgaagggggttatacttttaggttatttgtgaattgagtcagctcatgtaacagtgattctcaaagtgtggtcccaaaaccagtgggatgggcatcacctgggaacttgttacaaatgcagattattgggtcccaccccagacctactgaatcaaaaatcctggaggtgggtccagcaatcagtgttataatgagcctaccagatgattctaatgcacattgaagtttgaaaaccaccattgtttaaggatcacaacaaatccaacagcactgtcagaagaacaactccttattctaatgggtcaggtgctttctgtgttggctgtcctgcagagcatctctagtgatagttgtattttcaggattagaggtgcaaaactaatgggagtttaagaaggaagtttgagcctttactgctgggagaatcacaagccaagtttatttctcttccattatttgtatggtagctaaaactgccaaggactactgtgatccattgaaacatcagtgtatcacatctcttcttacatctgagctggcattttgggtgtagtgcttcagtaacagttgtattcccaagcaaataaaatcttagccaccagaaatcttgagttggactagacaaaggcacctctccagatagcagctgttgttggaattgaatataagagatgcttaatcaatgtttgtgtaattgaatagaatgggaaatgaatggctcactccaaactttatacaagacagatgaaggcaacttcgatcttaacctttatgatacatagcattttgtactacccttgagaaaatctcagtctcgggttatcatagactcaattggctatcatgggaaattctgtctcagtgatgctccatatctatttaattgaggtttattatcaatttgaaaaatggaaaattcacctcacatattttaaatagccaagatagccagagtgtatgttgtggtttcaatatgtccccaagagttcttgtgttaggagcttggttgcctttgcagtagtgttgagacgtggggcccttgggaggtgattgaatcgatgctgttatcatgggaatgagtttgctatcttgggagtggggtcctgatataaatgatacatttggctgccattttctcttgtttcatgtgcttgcttccaccttcccccttccaccatgggacaatcctctccagatgcctgtgccatgctcttggacttcccagcctccagaactgtgagaaataaatttctttataaattactgagcattctattatagcagcacagactaagacagtgtaagaaagctcttatattataactctctccttctatttgtattcaggttttctcttaattctggaaagtttgggcagcagctgggaatgggaatttattataagacatcccttcagtgtctctacagaattgctttaattaaagtactttgttttatttgtccccatttaattataattcacatcagagaaagctattgttaaaatattttggttagttcagtgtggggaatgggattttccatcccttgaccttcatgactcagtaaggagcagataaaataattttctttgctgggtgattattatgcctcagggacaagtcatatttaagacctgatagtttgattcaagctctcataattgctgtgcagacagtgttcaaagccaaagtcttcctgatcataaggtgctgagaggacattcattttttgccatcattcagagctctgcaagagagcaaattgcttgttacttaaatgtgttacctttgaagaataaaaatctgaattgacactgctgttatttgagccttcaggtgtagggacttggagcacctatgtataccatggaatgtggcttaacaggactaaactgattccttctgcataatgtgctatatactgatttgcactgtatggagtaaaacctcttcaaccatatttgaaagattgatatttactctaaaaagcctataccttgatgatatggtaaaataatcaggttctctataaccttgaatactagtaagctgtttctttgccttcctaataacatgagggtttttagtttttgtttttaaccagcatttgagtacctactatgtgcctaatagagtcagagtgactcacattaaaattaactagagttaccaaaaatttgtccttcttacacaaatatgcaatgacaacagaatgattatcagtaataaatgtatgtgcacttgcagattactaagtgactgatttaccacaaaaaaggaaaggaacattacttagatttgttgctgtccactccttgtttttcattatggttcagtttggattttcaccacaattcagacatgaaaactattctttccataatgaaatcaggtgtgaggttttttttctcattcttttctttagaaaatgtatagcttaggccaggcgcagtggctcacgcctgtaatcccagcactttgggaggccgaggtgggcggatcatgcggtcaagagatcgagactatcctggctaacatggtgaaaccccatctctactaaaaatacaaacacattagccgggcctggtggcacacgcctgtagtcctagctactcagtggtacatgcctgtagtcccagctactcgggaggctgaggcaggagaatcgcttgaacccgggaggcggaggttgctgtgagtcgagatcgtgccaagagagactccatctcaaaaaaaaaaaaaaaaaaagcaagcaagaaagtaagaaagaatagcttatattttctattaactccaaccaagcaaaatttaaaatgctaggttgcactccttgcactccgtagtgcaacccaatagcaccatggctttttaattccctgagagagagatggtggacagggtgttctgggaaactgctgacagtaacatctgtccataccgaaagtcaagtgaaaacttggttcacatgagagcaaatgaaaatatgatgtttttaaagaggctgggaaaaagtcagagaagtgctcccactattttagatgagctcagcagcaagtttctagtaggtaagagggaaaatccattgtggggaaatgtgccaatgactgtttttggttaaaggtttgaatgggcacgatttagcagaactttacaaagctgtgtcttgaagagctttggaaaaacatttagtgttgttgtcgttgatgattttttttcatactctctgttgttcaggttatatgtgactgaaagaaagaatgatgtagtttcagttacttccatgacccaccccgggctagcacctccttcagccacatggtaaggtcccagaaacatttgatagagaccacatgaaagtagatgcttatgcagatgtgacttttgaaatacattcttcctggctttcagatgtgctattaattgcaggtttaaaagcccttttttgtttgatctgataaggtaggcttactttatgtcaccttaaaatgaggttaagccaagaattgcaagatataaagtattcaatgactactctccatttctgctgggaaaaagaccatctgcttaggtaattgcattgtaatactcaaacctggctgaattgcttctgtccctgcaaacgtctcttctgtcttttacattcacagtcatatatctctcctgcatgtagatccaagacccagtgtagccttttgtataatttgtaggattaatagactctgggtctggcctagtacttatattgtaggtctataaattatcataataacataggtataattgcaggtagagttttatatctgggtctgcagtggtttgatcattgactcactgagaacaattattaatcttcaactccaaggtaggacacacagttccaattggtacataaatagtacatacatttacattacagcagggggacattgtctttgaaagaacatgaataatacgttaaacctggaagctgggagggggacatacagtaagtgggaaaagagatattgcagaaagtttaaaaacagagaagaagaaaataaaataaataccaaagcaagcatgctgatatcttaaattaggtgcaaggaattctttttccttctgtgcctcagagctgcctctatgtggccatatgtgccttgagggggaaggagtatagtaagctttgggaatgatgattcttcatcttgcaggatgtagttgctcgtgttggctcaactcagggtaaatattctagatgattgatgtatgaaatcctaatagtatgccatttaggagtttgtttaccatcagtctccacattcagactttttcttgtgggtttgaatgttctgtagtttctgtaatattgaattcaaaggtttgcttttgattggactttcctaattaaaagcaaatttattgtccctacaccttgcctctacttagcccaatctcacacaccctgtgaggctttttcccagatgttatttctccttcttgaagcttcttataggcagaaactggacctcattcatctttttatcttttacagtgctctcgcaaatatttattgaataaataaatgacataatttatacagtctgtgaggcttacaaataccttctttaagctattagtaaaacaaaagtactggcacaaagtgatttcttgttcatataacagaagtattttactttcaaacacacacacacacacacacacacacacacacacacacacacagaaagagggagagaaagagagagaagcccaacccaacaaaccacttaagggaaaccatgaaaatggtatctttgttgagagttaatgagtttatagttaatttatgctttccctggaatacatattatactcattatgtacaagtaaactatgactgtttttacacctatcacagatattccagatcttaaaatgctctgtttgaaataaaaggcagaaggggggacttgggcatattcccttatagttattcttgtgtctcttatggaatagatgcaaaaaagtctaatttgcctttctgtcacttggcaaagtttattatttgcttaagcacaagaagataaatgttttatcctactggcaaaaagtattgtttgcacaaatgtaaaattctgttaaatgtatttatatgtattgtcttagtcagggttctctagagggacaggactaataggatagatagatgtacatatgaaagggagtttattaaggagtattgactcacatcatcacaaggtcaagtcccacagtaggccatctgcaagctgaggagcaaggaagccagtccgagtcccaaaacctcaaaagtagggaagccaacagtgtgcccgaaggcccaagagcccctggcaaaccactggtgtaaatccaagagtccaaaagccgaagaacttggagtctgatgttcaagggcaggaagcatccagcgtgggagaaaaataaagaccagaagactcggcaagtctagtccttccatgttcttctgcttgctttattctggctgtgctggcagttgattagatggtgcccacccagattgagagtgggtctgcctctcccagtccactgactcaaatgttaatctcctttggcaagaacctcacagacacccccagtgacaatactttgcattcttcaatctaatcaaggtgacactcagtattaaccatcacatgtatgtttctatttgagtgtttctgtaaatgacatgctttagtttttgacaagtcaaatcctaccaaaataccctcatagaaaactcttgatgagagtaatggttatatccaagtcctctcaataacaaatttatttcaatcaatatttaatatcacaaaataacagtatgacaaatgaaggatagaatgtggttaactagtgtagagtgtgaattatttggactggattgtgaagtagatgtaactgatactcatggatgaacttgcagtaattatagataataaaaaattaccagccaagtgctgtggctcatgcctgtaatcccaacactttgggaggctgaggtgagcggattactgagcccaggagttccaaaccagcctgggcaacatggggagaccccatctctacaaaaaatgtaaaaagccaggtgtggtagtgtgtacttttatgtaatcccagctactcaggaggctgaaattggaggattgcttgagcttgagtcaaggccgcaatgagctcaggccactgtacttgagcctgggtgacaaagaccctgtctcaaaaaaaattataatgcgtacataattttttcacacatcaaccactttcctaacaagtcattgatcctcaaaataatcctgtgagtattattctcttctatgtaaatggaggaactgagtatctaataggtgattgccacatctaggcagctggcgtggagggtgttgaagatttgagtccggtgcctttgaccccaaagcctatggctggagatgcctgccaaggcaaaactgcccttaccaaagcagattttatcagctgatcccatttctctctcactaaactgagtccatgaatccttctcaatgtagacaaaatctatctgctatcctgacctatgttatttctaagtgtattttgctgggcattaacgcagatggaatacagccgagtttgcgtaagttctgtatagtacaccaccaagcaccttaacaggagcctgcaaattgccgttgagggaggtaacttttagcatctgaggctttgatgtgtttatcttctccaggaattttgttttgcctcctttgggaggggagaggtcttctgctaagcatctacttcctttatttcttactgcacaagaacttcggtctaattggccaactttgagtgtgctgaggtgacctatttctgtctgggataataaaaacattccagatgactgacgccttttactggggacaatttgacctgattctaaccctcctgctctgcctgccaaggaagatgattactacaggccttagtaccgacctctatttacttcatctactttttttttttcattttcttgcaaaaatagcaggcttgtccaagtgcctagctactatggcaataagtgctatttaaacagatgccgatgccgaatacatgtgtcccagcttaaatgagtcagtgggagcagttgtaggatctgattgcataaatgcatgggaataatgtctgtctctggggcaacagaacttcttttgagcccttgagaggaccagttcagttgcagaaaggctgatgtaatgatcacacaccttcaggtgaaagggtcagtttctccctgaatggaaagtgtcaaaaaatggccatttagactttctgctttgtaactagagcaaatgcctcaagaaagagaaaatgaacaggaaagccctcaaaagctttaaagggcttagaaaatgtaaagccattattgttggttattcaaatatccctctgattcaaatagatgcattgattttttaaaaaaatctacagttaacatcaagaaacttgagcctcagtaaatgagcactgccttatagaatattgctgaatatgtcttgaataagttgagaaagcacttggctgtgtataactactcatgtaaaatgctattggcacaaagatgacatttttttcaaagatgcctctatcatgtggctacaagtagattgtgctgattctattcctctacaaagctcagggtcacaggtggtctattagtagttgttggttgttagctctgccataagaagatggcatggttccttaggttagatgcattcagagttggtggtggacttgagtgtctacttatgcgcagagattttcagtcttttatttccatcttgacagtagacagagaagcaggggacaggcttgaaatttcagtcaaatatcaatccagcatgaaggaggacaccctgattttaaacacccactaatatttccttggaaaaaaaaagagcctaacacatctctggctccagctcttctctcctcccctcccttccctcagcccccaattctcttttcttttcctgtcttcagaatatgtgaaatgggggaaatcataaaacagtcaatcttcattattcacagtttccatatttgtgaattcactacttgctaaaatgtcttcgtaacggcaaaatcaatgctcactgtgcttttgtggttatttgcagacatgtgtggaacagtgaaaaactggagttgttccccatgcatgtttctagttgaagttaaaccaggtgacagccctttttgtttcagccctcatactgtaaacaactctcctttttgtggtcagcttagtgccacattttaaaacatttttctgcttttttttttggtgattttactatttgaaatggtccaaggatagtgccagcctactgtccagtgttcctaagtgcaagaaggctgtgatgtgccttgggaagaaatatgagtgttagataagcttcgtccaggcctgagttgtagtgctgttgctgtgagtccaatgttagtgaatcaacaatatatactcaataaacagtctttaagtagaaacacatgttaaacaaagttatgtatttatcagttgatgaaaatgtgaccagaggctcacagacacctagccctgtatctctccccagagcaatgcttcagtatttgctcagaaccaccacaagtaatgagaacaggctaacctaccccttggagttgacgtgaggatctcatgagctaatgcccctaaaatgcatggtgccttacagtgtgccccataggtgctaactatagcagttatcatcatcatcatcatcatcatcatcaatgaaaatacgggagaagaaaaaattaccaataatcccactattgtacctcaacaactctcttcattttgggtattcccttcagtcattgtttcgttgcattcacatctttgtataactgcattaaactgcatacaattttgaatatttctttgctatcattctgtcatgtgcatcaccctgtgttgcgacacagcctccatttctgtggtcttcttgatggaaagcggtaaaaactttgttcctgggctcatgtaagagcagctctcttcaagcatagggatgacttcattgctcacgacaccaatatgccttaaaattctgtgattaattgtaaaaaagaactctctctgaacactacagagaaaactctcacagagcagagaaatttattatgtgatcttcttctctccagaggaaaatggtgtgttttaagtcagaaggtttgggtcattattcagtagaacgaggtgctcgagggattacaaaagaagagtaactctaatctttgtgagagtgatggcctaatacaggtgttagcaaacatttcccgtacaggctcagatagtaaatgtgttagaccttgtgggccatatgatctccattgcagccactcaactctgccattgtagccaaaactatggataatattaatggataatattaaacaattgagtgtggctgtgttcctataaaaccttatttacaaataaggcacaattccaaacaaaatagatctgaacaccaaagtgggcagttcgtttattgctttattcttccacaaaacttctagtatgttaggccttgtcctggttggcagtaacatcagcaagagtagcaaaacatttttctatgcctcatgaagtttatagtctgaagggggagagagcgatcttaataaaataattgtataaatgaatatataattgcatgtgttgataaatactgcaaaggaagaaaacagtgggaaataggactgtgtcagatattcaggcacgaagtttagggaaggggctgcactttgaggtggccgccagacactcattgaaataagagggccttgatcattgtgcagtaagtgatttttattaacaagaacttagtcattacatacctagctgtaagtagatgctagctctgaagaatagattttcggtggtcagtttggcattcaaccaggaccaaaagagaatcccctcattcgctgacttggggctggatttatgagtgtcgtcactccctttgtattttctttttttgtcttattggtctttctaggcagaaatgaataccacatggttgagacacgcataagattcaggtccatcaggtcttgagcatctttctggtaacttaaacataagccaggatccacatatctaacggctacatgggatatagggcctcgttcataaaaacgcatacccatacttcttaatatgcccttgcctgttcctctttagttctctcaccccctgcaaatattcttcctttttaaaccctcagtttcttcaccaaactttcccagacaacctatccccaaggactttctttatccctctttgccagccaacctgtgtaccccttttcttctggaggtgcactgaggacttttccctcctgcctgatcatctgggcctctctgggctacccgggccttgcagcttcatggttcctccctgagcctctctccctagggagggaagcacaaggaactcactggagtgggcagttctgttcacaccctggtaaatgaaatcctctgcctcattacactctgcagacaatttcagcatccagtcatgcttatttcttgaaggaaaaggactgtttttccaccatttgggtctatgactccactggggattaaggaaagagacaacattgtggaatgtgtgtgtgtgtgttgttggagacagcttttgcttgggctggtatcatgtctactccaggattttctgaagtgactgtgggacaggaagaggcccattggtggctacttagcaacaccaggcccttcacgggcagtggaaagtcactggggtaatgccccagaccctcaccctcaacaggctacacctggacagagacagggcacccttatggggctttcagggatgagatgtgttcatccacaaataagggagaagcacagagacttctacaagtatgtagaggagaatctaggagatacaatgcaagggctgagaatttgggatatacacttattactgttggtgtggtcctagccttacaacaggttgtgcagcccaccaaagcatggattacagtgttaacatgcagaaattcctgattgtacctcttttccagctgttcaatcctacatgaggcctttcaaaacccctgtgatttcttacgattagagatgtaggctgtcccatctagtaaatttgtcaaaccactactgggtatcaggtagaaatagagttccctttcatcactagcaatatgtttcttttctcaatggtttgctctcctttgctcattttccatggaaggtcttcattactcctgtattttaaaagctatcttgtcaatattattccaagcgaatttctcagtatattttaaaagggaaaactaataatgtgatcctcttgcttaaaaccctttacagcttcccaagagtgttagaattaatggggctggtactagcatgcaaaatttaagggaatgtcaaaaaagtcagtagtcaagataaataatatttaatgcactattttaaaaatgttcttggcaaactttcgtccacacctgcgtttgtaaatgaggtttcaactcacaccgtgcatgtgacttgagaggccactgcagcacggccaggcctcagtgcactctctggcctcaacgtaactcccttgaccttccatgttgtattagtcctttctcatgctgctaataaagacataccccagattgggtaatttataaaggaaaaaggtttaatggactcacagttccacatggctggggaggcctcacaatcacggcagaagatgaaggaagagcaaagggacatcttacatggcagcaggcatgtgcaggggaactgctctttataaaaccatcagatctcatgatctgtgacttagtcactatcacgagaacagcatgggcaagacccgcctccatgattaaattacttcccactggttgcctcccacagcacatgggaattatgggaactacagttcaaaatgagatttgggtggggacacaagccaaactgtatcatgtaaccaaatatgttaagctccatccatgctgactttggtggtcatgtccatcccgggcctttatatgggttgtcccctttcttcacatctctgctgagctggcccctgctcatccttcagaactcgatcaagtgctccttccctcttgttggccaccctgagccccaaggtgggatcaggctcctctgctaggtgtcctcagggtggtgcgtgggggtcgttagtgtttgtccttagaatacctggcaagcagacatgcacgtgggtcattttgtttattaacaccaaactcctccagttgattataagctccatgagggcaggactgaatttgtcattcttatcgcacagtggcttacatgtcagtcatcactgaacagttaatggtcatttgatctgatatgcttctggtataatttcatgatatcagatctggagacatgaagtcattgttttcctggtggggagtgtgacaccaccatcttgttcaccatttgcagagttctttcctgtcttcgggcaagtagattaggttatatcgttatctctgtttatagctgtctcaaataaatcctttagaagagggagaaagatggtacaaagaaaaaagaagccaaggaggaaagtgactctcagagatgctaatgactttcccaggaaggctgtcacacagcaagaactcagatatgggttttacaactcagaaactcatcctgttctaggccccaacctcactctctcaggagaaggtcctggaggagattcccctctcactttccagaaaaaggacaaagggaattaggaatcttttcttaacattaacgccttgccaatttctagacctcccctcctgctcctcccttaagacatcctatttgcacgtctctgctcttagaggctattgggtttaagcgccacaataaataaaaggcaataaaataaataaaggcaataaaagatatctcctggtaggatataattttctttctttcgttcactgtctcagagttattttatccttttcaccacgagggactcaattggaactggctctcttattagccttcaggttcaactggcttccatggaggcattgtctcctcatagacctgttcacttgacagaccttcacagaagtttcatcagtataaggacccaaaacaccatctaaatggcttcatccagccatggcagatgccctttgctgctgggttgggtttttttttttttttctttcttttttttttgagatggagtctcactctgtcactcaggctggagtgcagtggcacaatctcagctcactgcaacctccgcctcctgagtttcaagtgattctcctgcctcagcctcccaagtagctgggactacagacatgcaccaccacacctggctaatttttgtgtttttagtagaggtggggtttcgccatgttggccaggctggtctcgaactcctgacctcaggtgatccacctgccttggcctcccaaagttctgggatttcaggcatgagccactgtgcctggccctgctggttttacttctgcctgaaacccactggggtgaaaggacaggccttggaaatgttgcattagtagcaactgctccctctaatgggaggacacatcccttccccatagtcagtgcaggagtcacagaagcttgagcacgacctcaggaatcggcttccattcattcattcaacccatatttactgagccccagtgtgtgccgggtacttctggacccttgggatatgaggtgaacagctcacagatccctgccctcctggagtttacattcttatgagagaaacggtcaatgaatgagtagtcaaataagttttacttccagtaatatgtggtatggagaaaaagaaatgaaggagaacagagataaagtttggtgatggtggaaggtggcagacagggtagccaaggaaagccttgcaaacgaggtgacatttgagcagagacatgacatgaagttctgggagaaaagtttatcaggcaaggtatatggctggtagaaaactctgagtccaaggcaaagtgactatccacaatcagccagaggtcaccatggctgggaagcatggcaggaagtgggaccagggatgcatgcaaaggccaaaacaggagggagttcatgctgctcatatctgttctggaaggacactggagaaatgtgtgtgaagaggaacatgaactgacttatgctttaaagggaccattctgaccgtcatgtgcaatgaatggagttgaggggctagtcaggagtagggcagagagatcaggtgagaggctcctagaataatccaagtaaaagatggaggtgactggattggggtgttggcagtggaggtggtgaggaacggtcggtcagatcgtcatgtattttgaaggcggagttcattcaccattgttgctgtaccagttgtgggctaggaaagaaagcagtgtgggtcaagcatcactcattcattcattgacacatacttgttgaatacctatcatgaacctgcccttgttctgggtgatggctataccggtaaacagaatagtcaaagcttcctgcccttgtggaacttacactttattattttatttttatttattttgttgaaacgaggccttgctctgttgcccaggctggagtgcactaatgcaatcatagctcactgcagtctcaagctccttgggctcaagtgatcctctggccccagcctcccacgtagctggaactacaggtgatgccaccacacctggctagtttttgtagagacagggtctcactatgttgcccaggctgatcttgaactcctggcctcaaatgatcctcccaccttggccttccaaagtgctgggattacaggcgtgagctactgtgcccggcctggtttacattttagaaaaagaaacagaaaataaaggtaaaaaaacaataagtgaattataatacatgttcagaagatatttgttatggtaaaaagaaaaaaatagagcagaagagggaccctggggcaggggagcagctgcaattttaactagggcaaccaaggtgggtgttcttaaaaggtcgccaggttttgggccctaagtagttagatggaagctaatactactatttaatgagaggtctataaagattacacaaataggctgggtgcagtggctcacacctgtcaatcccagagctttgggaggccgaggcaggcggatcgcttgaggtcaggagttcaagaccagcctggccaacatagcgaaaccccgtgtctgctaaaaatacaaaaattagctaggtgtggtgacacacacctgtaatcacagttactcaggaggctaaggcaggaaaatcgcttgagcccagaagtcagaggttgcagtgagccgagatcgcaccactgcactccggcctgggcgacagagtgaaactccatctcaaaaaaaaaaaagaataaagaaataaaagtgggaagaggagcaggctggaggttagggtggggtaaacaagctgttgtcatacttgagtccttgagtattgaatttgagctgtctcttagtgacaataccaagtagatagttggatattcaaatctggggcttaggcagaggccagggctatgtatatacatttcaaagtatcagagtctagaaggtctttaaagccataagaccagatgaggtctacaaggatgagagtggagagagaaaaaagagggcccagggccaggggctactgagtcctcagagtagagagaagaaaagaggaattagcaaaggagatgcagaaggaatagccaggaaagtgggagaaaaatgaggcgcttgaacgaagagctgaagaggtagaaagcaagtcacagcgctcaaagcagcaggtgagatggtgagtgggttgggaaagtgactaggagaactttttataagcgacttcctgagcagcaagtgatcaagttaccctgttgttagctatttgacggtggtgtgtagagtcacagaaaggtggcctctccctgtgtgcccacggaaacaccagggctgagccctttgcgtttgccagtgttcatgtgttcacttaagaattaatattattctccaaggcaaggcagtgggtacagatcgcagaagagtcaataccacacacaagattttgaacttaaatttataggcaatggggatttagataaagtttttcagcaggagagtgacatatgtaacctgttccatgtaaatagtttggggagcagaagggaggatgagttggaggaaggagaggtgatagggaggccattttagtagtggagccatgaaatgggggagggggagactgaaccaaaggagatgcagcgagaattcgaaagcagagatgcgagagacacggagaaggtggacatacagcctctggtacgtgattgtgggagggtacaatgagaggaacattgaagaccactcttggggttctatcttgtgtgactgggggatggagcccactgtgggtttttgctgggagatggagaggagaggctgtcagattaaccagtttatggattaattattaagaaacagcagggacctgggatttcccctcctcactgattagttagctggtaattaggcagtggctgagaatgctactgtctgtcccccatcgggtgggaggagcagagctgagcctccccacagttgctgtggtgcatggagtggggacctagaatcactgctatcacgtgacatgccccctgttcctcctgggaacccaactctgaaggggtcttcttgacatccgattttctccttccagagctcttctgaagttcttgcctaatgaagaaaaagcaagaaaagggaaaatatgtgtaccacagaattttccttctctctggtggtgttttgcaaaaatgccatggcaactttcctcttcaaatacttgggatttgtttctcttgcatctgtcaagtgcacatcaaagttgaattttccactttggaattatgatttgtattctgcttctcccatctgggcttctgttctcctgaaaactgcctattctactgtgaaatgagcattccccaaggctgatgtagccgcttcatgctaagtgttgatgggaaacctgaagctgagttgggcaaatgtttttgagatctgtaaattccccagagacttaaattgcttgaattattgagggacattttgacctcttgttggaccaatgagaatgaaagaaaagattggttaaatagaagaaatgttcagaatccccctcagccctccaaattccaaatattttcttttttctttctttttgtttcttttgagacggagtcttgctctgttgcccaggctggagtgcagtggcacaatcttggctcacttctacctctgtctcctgggttcaagccattctcctgcctcagtctcctgagtagctgggattacaggtgcacgccaccatgcctggctgatttttgtatttttaatagagatggggttttactgtgttagccaggctagtctcaaactcctgacataaagtgatctgcctgccttggcctcccaaagtgctgggattacaggcatgagccactgcacccggccaaatgttttctagttaagttcatatacccatgccagagtgcctagctcacacttcattataaatgtctgcctcaaacagaagtcctgggtccatgtttccactgtcctgcgagggatacacaagaacacttggcaaacgaagaagggaaggcctggggctacagtgggtagggagtaccagagacccaggggacaatatatgggttaaatgaggactttatttaatagtatttttaaaaattaaaattgtgacaaaatttaggaatcagtaattatttaaaaatccaaatattctgcttctcttgaaaaatcagaagacatggcatctcggggcccaaatttctatttggcagttttcagctggaggtcagctggtgtccccctaaactcaaggcatgtggtccccagtgggtcacgcccaccagaatcctctgctgtcttgatagctctgaggtccttcagggatcactggggaatgatgttctcctagaagactttctggatcctccaggtccaggttagatgctaaccaatgctcttaaagtagctatagcaacttttattaatatagataatattttatatttttcatattatataatttttgttattatattttaattgcttcctgacttatctcagtcctcttcagtataatttagtctccataagaataagtacttgttgtgtttgttattaatctccaacatcttggctgggcgcagcggctcacacctgtaatcccagcattttgagaggctgaggtgggtggatcccttgagctcaggaatttaagaccagcctggtcaacatggcgaaaccccatctctacaaaaaataagctgggtgcgatgctgtgcacgtgtagtcccagctactcaggaggctgaagtgggaggctcacttgagcctcagaagtccaggcttcagtgagccaaaattatgccactgcactccagcctggcgacagagcaaaaccttgtctaaaaataaaaaattaacaaatctccaacatcttgcataaggcccaggccataagcagacattcaaataaattaatttactaaataaggacaatagactaaataatccctggggtccattttagttgtactattctattgctctgatgtttctctttaaagaaacagattcatgggttttctattagagtaagacactgtatttgtctctacacatacctgagtaagaatgctttgggttagatccctcttttttggttcgtaaaactagagaagagaacagatggaaaggaccttgaagttcagcttcctaatttgcaggtggagaaacaggctcagagaagatacgtggacttccttcgagtcatatagttgtaacccaggttaggacatgtgcctccagggcagagtccacctgccttggtctctagtctgaaggaacaaatgaccagtgtggtagataagaacaaagtatattcaaagcctataaaagaaaagagacagagagaggaaagtggtactagctgacaaatgtcaccttagtggcaaaaacagtaaataccgtagaggtttataggacagaaattacttcagaaacgtaacaaggtttaagcaatccagtgtttattagcaatggttctctgactggggtgtccaaatgcattctaaggggactttgagttccctttgaaaacagtgaatgtacaatttcagggattttcatcatttctgtgagggagtatgacactttcctggccattgaaggggagaagggaattgatttgtaaatgatgtgtatacacaaagtgaaggcccagtgatggaatggtgatggtttgcagtagtttggggctgtggcaattagtgacattttgtttttacattataaacagtgatgtaattggagtgaaatgccattatccactgcgtcattttaatgcagtcaattgttactggcttcgtatttagtttttacacttatgttggtgtcagaattatagaagagttgtaagcaaaagcactttgcatctagttgtgttagttttgtgtacattgatgcaacattgcaatgaaagtaatctaaaacaatgccaacagtccaagagattttatctttcttttagaaagagtctatgcattattcaagcttgttgtgaatgctgacttcctatagcacttgcatttaagttatgagaagttattggcatgagagataatttaagtggcatgagctcatctgctgtcactgcatgaattacttgggaggaacttggtgtgggagatgtgatatgctctcccctcagtaggtggctgttcccacaggcaattctagattctaagataattctgactattgttttattgactttagaaccagatcctttgtaagatgttatgatgtacagggtctaagtggtggaaggatgtgtctttcctttaatgtgatataagccagagttcagcaaactatggcccatggaccaaacacagcccacagtctgtttttgttaataaaattgtattggaatttaggcacactcatttatatacagatggtctgtggctgctttcacactataaatccttagtccaatcatttcgatagagatcctatggcttgcagagtccaaagtctttattatctgacagtgccctaggacccagggtctaaatataaccatttctgcactgtgctttcagcttctgtgtattttatttgtttctctaaagtgacctaattaatctgtcctattgggataattagggaattctagatggttgttgctttgtggaagattccgtgatttctctaataagggaatctagtctattctcaacatagattcctactttcttaaaataggatgctagaagctagcaagatgctgtttgattcaggagccccacctgccagagctagcctcaggctgcactgtgaatgagccacttgtgtttccacccgtccgccctgcttttcggaacccgcttccttcatcatgtctttgcgtcactgccttttcactccatcctgcctctcagtaacatcagtgaaggctctgatatctcacttttaccaccatttaagttcacttcatttgtccacttcttgcttcttccaagggtgtttgcacttgaagctttttgtccccactgtgtataggaagctttgccttccctgaaaggtttgaccaactcagaggagtggagggagaagggatgagggggcagcacaggacggggagtggtagggacagggctgtccctggaaacacacagtcctcctcagtgactgcacggctcattgcacctcattcctgggttgctgtacagatcagagtctacctcacctcaaaagccccacagtatttgttaaatgtctgggggattccagatacttaacaaataatctttcaatgtggtcgacttatttagggaacaaacacaaaaagactcacacaaaaggcatgggagtcaaatgctctttgggatacttgactggagagggctttctacttacacgtgcctagggaaatagtcaaaggatgaggggggttggtatgatttagggacagttcctagaaggagatacttactcctgaatgtgctctgcttaaaaaaaaaaaaaaaaaaaaaaaaaagaagaagaaaagaaaagaaattgtgttgggcgtaaccacagccttcttagccagcctgagttggcattgctcaccctctgaggattaggtcagccacagtgagctttctcaaggaagtggtgccttggggagcccgcgttggaaagcaatagcagatggctgccgtgggatgtatatggtcctgcttttttaatatgtggagaaaagagacctgcgctctctgtatgttcacatatatcaggatcattatatgttaattgcttattatggcaactgatgatttgcctcctgtttcttatgtgttctgtcagttaacatttattgggcacctactatatgtcgatagaatctgcacagtggcaggtaaagttttccctgtctttaaagagctcaagtctgataagaatgacaactcatgaataattgcaatctaggatggagaaacgggggaattctcccttagaattatatccccctcattgacttcacactaaattcgactttttaaattcagcagtgattatctaaagcctgagctgttcagattgttaaataacagtactctaagttaatctacaagaatcttaattaaagaagtgaatttgggtatgttcaaattataactcagctgaaaaacagtttctctactatgcattcccctcaccaatcccacttcccaaataaactgactgaggtgggataaaagggtccagactagaggatggcaaactccagccccaaggtcaagttacacctgccacctgtttctataaatagttctcctggaacacagaaatgcccactcatttacataatgtctatcatctgtggctgctttcaagctacaaggcagaggtgagcagctgggacagaggttgtgtgtggccagcaaagcctaaaatatttactttttgtatcacaggaaaaaaaaattgccaacccttggtctagagtaaactgaacacccataaaaagtaaaaacaacattattcaccacctctgactggcaaaatgacttaagaaccagcacactggtacattttaatagcagttaaatctagacacatttggatttaaattgaaatccaatatcctcctcttcatgatgaagtattaacatggttagctagctaagaaatatttgaccctcacgtacttaaaatatctcttgttttggtgtttgtgtacacaaattagggaatacaaattatgttcatgaagtaagtcatcttcaccaacggaaagaaatattctccaaatcgctgagaccatgcatcaaccctactgcacagttagaagaagggccacattaattacccgaggatacagaatctcttaggaagaggagtggccacagagaacaagagcatatatagtgcatttcagagaagtttctcctgccctccagattcccctgtggacctactctgagtccattctgcaagggggcatttctgcatttgagcagctcccgttcttacccattacacatccctgtgtatagggggcttcaggaagaacttacacaaccaatcgatggcctcagtttaatataacatttaaaaatatctcgctctcctgattctgtagccaaactcagaatcatcaaggccacttcctctcccaggagagtaagcaaacttactgcccagatgtcccccaaagtgtctttgccttcaactttgctgcaggctggaaaggctgtttctctacaaggactggagatgcaaacccttggaggggagggtcctggggagggcaggcacgtgttaaaaagggcagtagatgaaagcaaatgtggctgcaattgtccgcttctgcttgaacagcaagtctgtcccatgctataacagggattctgtaggatggatcctgttttttgttttgttttgttttgttttttgaggcggagtctcgctctgtcgcccaggctggagtgcagtggcgccatctctgctcactgcaagctccgcaggagaatggttcacgccattctcctgcctcagcctcctgaatagctgagactacaggcgcccgccaccacacccggctaattttttgtattttttagtggagacagggtttcaccgtgttagccaggatggtctcgatctcctgacctcatgatctgcccgcctcggcctcccaaagtgctgggattataggcgtgagccactgcaccctgccctgatcctgttttttagagaaagtagattgttaatccgtcactttatgtattgtctctaagatagcatctatcatgtatataggcacaaatgcatactggagtgaattcataaattaatagatgaattaagacctcagactctggagacaagcaaaattgagtttaaatcccatctttgccagttaatagctgttagttatctatcgctgtataacaaattgtcccaaatttagtggcttaagttattatctcacagcactgtgggtaaaggatctgggtttggctttgctgggtaccaaggctgcagtcatctcaaagcttggccaggtggggaaggacctgctttcaagctcacacatgtggttgttggctggcctcaaatccgtcatggctgttggctgacctcaaatccatcatggctgttggctagagacatcagttccttgccacctgggcctctccaaagggctgctcacaacatggtggctggcttcccccagagaggggaatctgagagaaagatccaagatggaagctacagtgtttttgttttcactgggaatgtgggcaaggcattgaaaaagatttttgtgtgagtgataaaatatacacaacattatttgctattgtaacctttctttctttctttttttttttttttttttttgagacagagtcatgctgtgtcacccaggctggagtgcagtgatacttccttggctcactgcaacctccacctctcgagttcaagagattcttctgcctcagcctcccaagtagctgggactataagtgtgcaccaccacacctggctaattttttgtatttttagtagacggggttttgccatgttggccaggctggtctcaaactcctgacctccagtgatctgcccacctcggcctcccaaagtgctggggttacaggcatgagccaccacacctggcctattgtaaccacttttaggtgtgcaattaggtggcattaagtatattcactgtgttttacaaccatcaccactatttatttctaaaacttttcatcaccccaaacagaaacttgaagctacagtgtttttgcaacctaatctcagaagcaacataccaccattctgttatattctgtttcttggaagcaagtcaccaaacatagcccacaattccagggggagggtatcttgaaggacaagaagaccaggaggaagacatcctagaaggcagtcccagaagctgcctgccatacaggctatgtgaccttaggcaggtagtaacctgcctcagtttcaacctttgtaaaacaaggatgatatcttagtctgttcaggctgctataacaaaataccataaactgggtggcttatggacaacaggattttatgtctcacagttctagaggctggaaagtccaaaggcaaggcagagtctgtctggtgagggcctgcatcctcacaggtggcaccttcttgctgtgtcttcacatgatgaaaggggcaaggggtctctctcaggcttctttttaagggcacttatttcattcatgagggctctgttcccatgagctaatcacctcccaaaagccctacctcctaatgccatggcctaggggttaggatttcaacatatgaatttcggagggacagaaacattcagacctagcagatgattttgcctgcctcatagtgctgtacttatatccagggggagcacccccaagtttctactctttaatataagattaaatagatggccccaagccatgatgtttggccaccatggactccaggcagggttttcctgcacggcttctcagatcttcatggtgcttcagcagagatcacatctttagatctctgacagcatgagcagatagagggcagagcagaggcagaactgtggcaatacaaaatatgattcctacatcttcttcccagtacaatctttatggggagcagagcttcctgtaaggaaggagaagcctcccctggacagtgttgagctcccatgtcctcatcatatctcctctgggagtggatccacccctccctcagttgctcacattcaccaccaagatactatccttgtacccattatggtttattctctttcttccatgcacattcccagtatcactttaatgtgtccgccctctttcctggtgagctgtcctgtgcagtgaataagaaacagttacttcccctggagggcttgcatatgactatgcaacgtgcaagcaggctgcttttaaaactattatttaaaatttttcaaaatggtagtatctctttccatccttgtcccctctcacaggtcaaacctaaacaattcagggtctcattccaaacaccagctcatggatgtgttctgagccatcatatattccagccatatctttatacttctgtggtcctgtggaatagtaccaatccagatccttaattagctgaaaattaattcagatgattgcatatttaagccaaagaaataaattaatattgtgtgcaaaggtttctggtgatgagtattttggaaggactgttaaacacatttgaaataaaaatagtttactggctaaggctcagaaaaaaacaaaaattattactgatcagtgttttctaaagtgtgttctgcagaccgaaatgctgtttatttgcccactgaccaaaattacattgataatctgtactaatctcatcagggttgatgagaatatggtaaaacagtcatggactgttttctgctgggagtataaattggacatgcctctaggcaagcaattttgtactatttatcagaatttaaaatgtatatgccctttggcccagcaactctacttctagaagttaatcttaaatcattcttgcacatatatacaaggggctttattgcagtactgttcatagtaagaaaacgttggaaacaacttaaatgtatgtctataatagaccaggtaaatcaattataatatgcctctactcttgaatattgtacaacagtcaaaataatgagcaggcttggtacaggggcttatgcctgtaatcccagaacttcgggaggccaagatgggaggatcttttgaggccaggagttcaagaccagcctggtcaacacagtgagacccccatctctaaaaaaataaacagcccacctgtatgtattcacatggaaagatggacatagtattttgttacctggaagaagcaagtcgtagagcaatattttaatataattacttctataggaaaagatatatacatatggtattatatatataatttctgtgtgtatgcacaatattgtgtgtgtgtgtcacacacacacagcatgttttcatgctgctaatacctgagactgggcaatttacaaaagaaagaggtttaattgaacttacagttccacatcgctggggaggcctcacagtcatggcgggaggaaaggaggagcaagtcacttcttacatggatggcagcaggcagaaaaagagagtttgtccagggaaacacccatttttaaaaccattagatctcatgagactcattcgctatcatgagaacaatgcaggaaagacccatcccataattcaatcatctcccactgggttcctcccatgacacttgggaattgtaggagttacaattcaagatgagatttgagtggggacacagccaaaccatgtcatatatgtatatatataaaatacatgtacaaccacatagatttgtttggaaggatacacaccaaactgttaatagtggttattcttcctcttgagaaagaaatagaattttctagagggtaggagggttgcttcctgctttgctgtgtatccttgcatattgtttgaattttttataattagtatacattgcttctgtaatttatgaaacaatttaaacatctcttaaactcatagacataacatatttatttttaagcaaattaagaaaaagaaccatgtaatctctctgcccaaatgtaattactattaatcttccatacctttttctatagatgtattgtttgtttttaaaaaatgtaatttttccatttagaccattttgtaatctgctgcttttatttcacaatatgggataaatgtgattattccctgcatatttatgtgccagtagatattcagttatatttctaatgacttcaatgttatggtttttaggtatatgagattactggaaactaggcatttgaaatgggcaaggtaaattcctagtgcaatatcctgttacctggcttcttgctttcatcttgttcatccgtacatctagattgtccaccctttatgcctaatctctgtcattgtcttgaataaaattttccatggctgcccattgccctcaagataaatttctagtttccttagatagattgcaaggcccctcactttccagttcatgtttcctctggcacatctttggccaacacctttatcttcaactcccatcaacagctcacctcacccaggcttattctcactctgccttccggtttcagctccaatgactccatttctgattcagttacttctctgtttctcagagcatcttccacttcttccatctcttgtttttgccacccaataggcactctcccttttcctgacaaaacagttcattgtgtgtgagagacttcgggcaaggttattaagctgtccacgcttcaggcttatcatgattcatcatctattaataggacaataatagtaccgacctcctgagattgttaattggaggaagtgaatgaatatctctcagtggattagaagtgcctggggcataataagggctctatgtgtttgaggctgcagttgctgtaattggaatcatctctcttttactcagtccacctagtttggttgaagttggttctaccctctgctctaggggttgctaaggtaatcagtaaatctcatccttctagatcctgtgatgggttcagaagagaacacaaaacccgatttgagccagtgagagtcactatgaagactttactttctgaaggagagaaactctctatctctaggcatgtgcataatgcatgctaggcttactgctattggagctgagacattgcagatggaagcccatcagagcatggaaccaacacagagggaaacacagctgagcaaagagagagaagtcctgtcctggtgatactgggatgagcctttcatgaagcgatgcctgaccagctcttcctccaattcctcagtcgtttgagccaaaatacttccttgttgcttaaaccactaagggttaggttttctgtcacttacaacccagagtttcaagagatatataccatgtcttaccaacatcataccttagtataatggtctttctattgatctctctgctgcatgagaccttaaggtctgtgaggacaggcctgggtcctatttccctttgtatctccagcttccaacatagtgcttgactatattagatgcaagtatttgttgaatgaaaaaatgtctcagaggctaccttgactatttcagcataacttgttcaatgctactggtttatccaggtctaaaagtctgctaatcgtatcagcaaggcataataggatgggaaaagaattaatattattgaatgcctgtcagtaactaggtaatgtatatgatactttacatcatgtcttttaatcagaaagcataattgctttctcccttcctgctatcccatgataggtctattactatacttccaagtcagtaaaataagaataatgaaataagaatatcaatgaaataagaatatcaatgaaataagaacaaaagtcagatgtggtggcacacacctgtaatcccagaactttgggaggctaaggcaggtggattgcttgagctcaggagttcaagatcagcctggacaaaggtgaaaacccatttctacaaaaattagctgggtatggtggcacacgactgtggtcccagatacttgggaggctgaggtgggaggattgcttgagcctagaaggttaaggctgcagtgagctatgattgtgccactgcactccagcctaggtgacagagtgagaccctatctcaaaatatataatatatgcgtacgtttagtatctaacaagaaaaatgaaaggcagataaaaagtatacatattctattctttaaaaggcaataatcatttgaatcttttgagttcaaaatgctgtgttttataaatttataaatgtgtctataaatttttctttctatttcttctacttcttcttagcattgaagtgagcaattttattaaaatctgccattttggtagtaaaacatttaaattcaaagtcaccttaagtgagtgatgtgcttgttgccagccacttaattagctgggggatgtgacacagttgtctacatgcaggacaatttcaaggtcactggtggaaaccctctcacctccccatgctgccagcttattgtcccatacatggtaacattcagatttgggactagatggccaggagaaaagcactgagtagcctcactccagaaggattttttgtgcttggctccctgacttctcctttcgttcagggagcatgcagtggtgagaacacctaaatcatgatccttgtcctccatctataactaattcgtattgttttaggttagtttctcagagcataagaatgaagactgtagtatggcccggctctttcttaagaaagcactcttgatgaaacaatctacataagtagactgaccagttaaatatggttattaatcattcagttttatctgcgtaatggtcttatcaaaactaattattgccatattaggtagatatttagagagcacccttttatggaccaaactctttgcagaatacagatactcaggaagaggatctcttgtcttgaaggagctgaaaattgagttgagttatcccagaatcgcttttttcctttagagttggaattttgacagatggagaaaattatctaataaagtgttcaaaaacttggttggcccgtgtgggttgaggattaatccgttagagccacaggcagattgagcacactattcttagctcagaagaagcaagttattcagagaaggatgagagatggcacattccctctagttcctttttgctgctagagaggtgagcttccaggggctcctagttcaggttgcttgtatttttttcacctacatttggtctccacaagccttcctttcatcgtcagatttgtccaaaatttaacacctgtgtgtgtctaatcaaggaaggacatgatatcacattatgagtgtatttaggtgagaagtcattgaggaaaataatgtttgtcatttgaaagaaagaagagtgttttatttttgagtcacttcaggtctttgtcctgaagaacagattcactcttgtttaaactctgtctcagtgagaatgtttgcggggatgggaggtagcacttcccattgcatctaatcatctagaaaacaagagactacaccttaacagtgcaaatccttttggaattgatctacctggtcttctgctttttcctttctccactctgctttgtcctgaattcccagaaatgccatcttaaaactcttctaaaactgctggctactctttcccctgtttttttctaccagtttttttgtttttgtttttgtttttttttaaaccatcatataaagagacagcttccaaatggtactctgtaattgagcaataaacaacaaacttttgtctgtatgtatccatactaccagtcaaaatacttaataacaaaatatcaataaaaaatggccaatgtgacatttttcatcttgtgtcaaaatcagaaccctttgttttaccatttgcttttaaatctggggggtacataaattcctgagaaaatactaagcatatacatcaaagaaattcagacaaatatatgtgaacagagcaggtcactgacactaatcttggccataacctagagttattcagaaaagatgtccagagacaaatcttggaggttttgaagaatcagaaagataagaggaaaatctggatacagaggtatcacagaagccaaggaaagtgttttaaaaaggaagacgaggtcaacagtgtcaggtgcagctaaaatattaagtataaagaggactgaaaaatatgtcttgaatttagagacttgaaggttattagtgaccttaacaagcattgtttttggggagttatgcagctagaagtcaaactggtaggttgaggaaggagtggaagctaaggcagttgagctgtgggtacggacacttccttcagattagctgtaaagacagtagtaatagaacagtggctgtaggaggataggggactgaggactaggaaataatttattttagatgggagatatttgaataggttcaaagcttattggaaggattcagctgaagacagaagtccggtaacaagagagaaaatataatagaatagataatgttaagttcccaagatccacaatgacccccaaacgtaagaatcatcttagaatagacttgggatacgaagttcaactgcaaaataccctatttttagacagcctccgaatttaggaaaccatgtccagcccagaggaaaaaagaagagggctgagttactattttctccatgtttgattctaaggaatgtagcattatttggatattacataaaaccttggaaaataagggaaggggcaggccgtgaagatatgtgcaattaaaattagaaactagacatggccagtaaattgattacaagttaatctagctttgccataacctgagagaggtgatgtagtcaggaagttaggttttatctcaggttggctttctaaatattgaaagctgtcaccaaagaaactagcatagaaccagtacgttacctgggggagagcacctagagccacagatgttggtgtgcctgagaaagtccagaattttaaaaataaaattagaatagctgtgaccggcagtaccctccagactcctcaattgcacacagctccctttgtgtccattttgaggactcagcaccaagacttctaagacatgaagcactgggcaatgctttggggacatgacaatgctaattatgctaaatactcatgatatgttgtctaatattgatattgataacctaagcaaagacttactttagctaagctgaccttgctgaattgcctgtgttagctgccaacaatgtcaacagagaggagagtaatggtcaaactggaggcagatagtgttatgatttatgaggggccatgaaggcagtgtttttgtccatgggagctgtgattagatgctgtgggtagctgaatacagttgagatttttcaaaaattggcaggcatgttactttggaagttctccagtgacacatcagagatttaattattacagttttgtattcttgctttctgtgacatctctcccctttgtgcttaatcaatgtttgtttcccagtatgtgtttgtcactattattaattttggaagatacaaggaaatccccaaatcagtaaatgccctctaggagtgattctctagtcttgtagttggacacaaacccacaacataacctcctttgtaggctcatgcaagaggaaaggaattcagcatagtgatggagtaggcccagttccaaggatgccactgggtatcctgtacatccagagaggaacagggcaacttcctgactcttttacgtcactttctgaaaggaaagggaacgtttcaaagtaggaccatgcacagatacctgaccacctatccctttttaaagtcccacctgtcaagtctctacaccagttgtattgcattacctgggtaaaggagtcaagtgggaaggggtggagggtagtcccaagctaatgagaccagcattcccctgggttattttatagtttatcttattaatcctagaagcttgactatgaggcctgtgttaggaggtttctccttggggaaagataatcttaccaacatctttgggctgttttcctaattcttaacactactcctgtatatttcaaactgggagctatgaaatagacaggtttgcctctcgagactttctatgaaagcttttttgatgttactcctgggagcttctcagtgggccaggaaagaggccccaaagccacactgtatactaggctaagtcaccacatgacgtatgtaagattcacagaggatcctcttgttcacctatgacgaggccagacacaggccctccaaactccctttctctgtctcataaatgattagctgaacgtttacccccctgtgatcaatctggacaaaatacttactaatttgatttgaccgctgtagtgaagcttgtctcctcctccacagcctgtaaactttgactcattcctgaagctaagcaagtgttggaactgggaacaacccctccttaatggcccttcctgagactctccattggctgcaaacaaatctttcttgttcagctgtcacatcatcccacgtgtgcatcccccatgcctagctccttctagccatgtttattcctcttcattaaaagagaagccctttcagcctgaccatctggatgtttatagatcttatggtcagagtcttttccctattgcaaaaatgatcctgtccatttggcgtattctttaaaagtaaagtctgtccttacctaagtctaggtttgtttttatttgacactactctctatattttggtatttaatactgtgtacattgaacacgatcttttcttgatgacctagcttcatctttaagactattatcacattgtgctgaagaggtagttgtcagtgaggccaattctgggtgggatattggctgacctggcactaatgctggagccaacttatttctgggatagagcagctacttttgttttatgcattttgagttacattaaactcatttggatagagtataatggtgacctttcacttggccagaagaaaaaaaactacactgtttattttcttatttttttttttttttttcactggggtctcactctgtcacccaggctggagagcagtgggtgcaacctcggctcactgcagcctctgcttcctgggctcaagcgatcctcccacctcagcctcttgagtagctgggaccaaaggcacgtgccaccatgcccagctgattttttgcatttttgatggagatggagtttcaccatactgacactgttttaaaaataatcctagaattcgtaactttctagcgtgtgtatgtataaattacaatctgttatgtttagaaattaacaagaatcaaataatgaagctaattttccaaaacgtgattgagctacaatgcaggcgtctgaccatcttatttttagcccccaaggcatgcaaatgttagaagaaaaagaatctttaaaattgcaattgatagtaaaattgcttaattatatgtataatatgtggaagaatatgtatatacagccatttatcaaaaaagaggtcaggaaagttgggtgcagtgtcacacacctgtggtcttagctacttgggaggctgaggtaggagaattgcttgagcccaggagtttgagtccagcctgagcaacatagtgagacactgtctcttaaaaaaacatggggagtagggtaaggaaagaaccaggtaaggatggaagaaaaccatccagccatgaggacttacagagcaatatgatagagaaattattctcatttcttaatataaataagaaaaatgagatttgaagatttgcaatttgcataaatttacctgacttgtaagtgccagaaccagagttagaactctgttattctattttctggtctatgactgtcatcaggacactgtgaagcctttcctttagtgagttccaggtaacacagaccagaaaacagtcctaattgtattcgttgttgttcatgtcactgtcagactctacaacttgttgcttccattactgatttcaataccaggggctgctatccactcttctcttcctccttttctaggaagccttactgttcaaatgtgtaaaaactcattcttgacttccagccaatcagccagagacatgaccttcatgcagaccatcatctctttgaggctgtgtctatttctgagtgcttggaggctgctgctttgctgacggggtagagatagaaagaaagggactgtttctctgtttctccctgttagaaatgcttgttgcccagtgccataaagaaatagcacttgaacataaatttaatttcctcagcaaggccattttttttactttctgcagaaagggtacactcaccagcagttttgccatgaaagtacaccaaacaaaagaggcagggtcatttataacctgatgcgtccaccctactgctgtgtcccgtttccattggctggaacgggacctcacattctgtatttgtcctgattggctagcaacttagaactttttaaaagaggcaaaggcagaggagaacaaaggaaggaggaagtaacttgtggaatgccgagaaaggtaaaaacaccttcaaataaggaagaggaacaggctaagacctaatgcttgcttggaccagtgtaagcatgccagggcaaatatttaggctaaattgtgggagctaagaacataaagtacattgatttctttattatggctagcagatatttaagaatgttagcacaggtctttgaataatttttgcttctaagagaagttactatttattcctaattagatggggaggaaagtctttgaagaggaacccctactttattttctatactccctcaccttcctaggtcgtctgaaggtttcctgaggttctggaaaacggaaagtatcctaaatacttaaatagtattatatgctaccaattaattgtccactctatcatctaaagatctcacgacaaacagtatatggaagtatatgtttcaccttattctgtaggtccaaattctcttttgagaattatgtggacttcagagctagtttgtttcatggaggtagctagtttgtttcattgacatgctgcatgcctcacttggtaaggctcaggcctcgtccagagcagggtatagcctttggtctagccaaccttgctggatgttgtaaagtattttagctattggattatgctttctataaatgtaaagatgtcacgggacctcaggtgtattcatgcaggctttgccatttatcctagctccaattagttaccgcaggtacagcaaaacaaatgtaaggcaccgcaccaacacgaggaattatcagtcttgttactaagaggacagaggaatccctaccatgtagggtaaatttctttctaggccctttaaatgtgaaatgtaataaggcaatttaaagatcatttcactaacatgtaaaggaaaatacaaacatgtgcacatctaattgcaggtcttacaattttggttctaaggaaaataattaacataagctcaaaatgacacttcctgcctgggaacagttctggcgaaataatgaacctgtagaaataaaattgaagagctaatcagccttgaacggcgctgaggtgtgtgtttctctctctctggttgctgttcatctcttgcttgtctctctgctttcccctatgcctttgatgagacacataatttttatgttgggcgacaaggtgacagttctctctgataattacatagatgagaatatatttggttttggaggaaaaaaatttactttacaaatgtatatatagaaataactttgaccttttggtaaagataaccaagttcttcctcagcaacagaaaaacaggcacattcggaggtgtgtgtttcattttatagtggtagctcctcctaataaaaacctttgtaaggaaaaggacaaagttgttggttcagggggctagcggtagaccccttctcctaacagctcaaagataaggtaaatcaaagtgccccccaagagttaaatgagagaaaacccacatgcagtggatagcattagccgtctgtggtgggaaaggaacagattgtcaatgaatgcatggttaaagagtttgagaacacccaaaactttaatcaaggtgatatgggagcaatctcatgaaagtagaatgggaggatggttgcatttagccattacaacctcatcagttgcattcccacaggaagactgcctggatattaagatgatgtcatcacagagctgggattctcacagtgtggtaagaagacctctagcatgagaatctcctgtaaaaatgcacatcctagggctttactgcatagacaccaaaaatatttggagtgggctcaaagaatctgcattttgtttatattcaactgaattttcttttttatagtttttttctaatttaaaaaaaagtaacacaatatgggctcattgtaaccaggaatgcaaatatgaggaaaggaaaagtaaatcttggttgatccttctttttctcttaccctgaggtagcaatactagtagcagttgttactagcaacaatactggtgagcatgagcatccttccatgccatttttcacacttacaaacatatatacatttttaagaggttttattttttgcttctcttgtttgtttttatatactaggtcatattataaaatttggagatttacttttctcaagtcataatgccaaacactccaggtattttaaaaatgtatgtacatctatatatgtattcacacacatttacacatatacatacaaacacccacatacatatgtgtgtcaggttgcttgaaaatgcagcttaaaacccatttagggctaaatactggcacagtagtccagtatcataaggaaaagttgaaaaaaactttgaagaatgacattcttttaaattctatagttttctatggaatggattattaagatattcaagcgtgtcccataggtgaacattcaggttgttttctattgttgctgcatgtgttttatttcattgccattacaaatgcctttattttggggatgatagatgagcagaaatgggatttccgagtcaaaggctatgttcattttaaattctattagtattataatatgactttcctaaaagcttgaggtaaattacagttgattatcatgattccacttagttatgtcctataaaatcaccttgagcactgaagtagcagacactgactcactgtgttaatgtattaatatgttgtatcaatatattaatattgaattaatatgttgtatcagtatattaatattgaattaatatgctgtatcagtatattaatattaaattaatatgttgtatcagtatattagttattaactctggaggaaatacagggttaggtttctgcaagctccttgtcacacatttttcaacccatcaatacataaccttgttttacatgtgtttctgtttaaatacatcttatttatttatttatttatttgagatggagtctctctctgtcaccaggctgtagtgcagtggcacgatcttagctcactgcaacctctacctcctggattcaagtgattctcctgtctcagcctcccaagtagctgggactacaggtgcacaccaccatgcccagctaatttttgtatttttagtagagatggggtttcacgatgttgtgcaggatgatcttgatctcttgacctcatgatccacccaccttggccttccaaagtgctgggattacaagcgtgagccactactcccagtcagcttatttattacatattattgataacctagcattgaactcatggccagcaatatgtcccatgcctgaacaatgcttatctaacacatggactttctctatcaggcactttacagactaaagtgcctttactaaagtctgtaaagtgcattatggagaaagtccatgtgttagataaggattcagccctgtgcagaaaatgtggcattaaattgaccaccaaaaggatactaatttacattatgagggtgaaacaagaaaggagaatgtcatcttgttctgcctggactgggaacatgcatgctgggtgaccacactgcacgtgaccatgaatgaccacaaatgatctccaaagtgccacaagtattggctttggggttacaaatacatttgagagtgtaggcaaatttgtgaatacagaatccacaaataataaggattgactgtatattcccaccagcaaagtgtttgtcatgttgattattcttcgtcttcactgtttcattttttaaaatatttgtgaaattttaggggaaaactatttcctcgttgccaactaactagtgaagttcagcctattttcttaatttattacacatttaaatgcaatctttgataacttacctgttattatattttgccctttttccaaccaagtgacttaatttttttctcatcaattcttagaaactgtatattagggatatcaatactttgttatatgttatgtaaatacttttttattctattgcttgtcttatttttgttttgggtatctttgctatatgttttaatactcaaatatatcaaccttcctcttgtgatttaaggtctcctgtcttattgtatctccaagactacatagaatttcacatttttattccaatatttttattgttacatattttgcattaaaatcttgactccatccagaatgtttttgtttctagtgttaggcaggggtctatgttcattttttttcttccagacgaacattcctcagttgttccaaataggaagagaggaaatcaacctctccatgtttgcagatagtacgattctctgcctggaaaaccccattgtctctgcccaaaagctccctgatctgatacacaacttcagcaaagtttcaggacacaaaatcagtgaacaaaaatcagtagcattcctatataacaacattcaagctaagagcaaaatcaagaatgcaatcccattcataatcgctacaaaaagaataaaatatctaggaatacagctaaccaaggaggtgaaagacctttacaatgagaattacagaacactgctaaaagaaatcagagatgacagcaaattgaaaaacattccacatgaattttttttttcccatctgaattgttcctggatctacattatccatgcctggtttccaggccctctcagagattctgtaaactacttatatcctttattgatccttttctacttagcctggataaagtagattatgattttgcaactaagagtagtaattggtgctggaaatatttgtacctaatggactgtcaagtaaatgggaacctggggttagctatttaacatagttgagtttgaaggcatgtggagcaaaacatttccgtaaatattggctttggttaattggagtgaagtgcctactgaaggcagcattttgggaaactcaagtggctgcttccgtatagtattttaagaaacgtggctgtactggctacatggaattgtgctaaaaatcttaaggaaagaaaaataaaacaggctcaaggttttaaattattgcctcaatgtagtctcagaaaacaagagaagttttgactggcctaaaagaatatcgtcttttatagcaacaaggttgatgaacttgaacatcaaacatatgctctgattctgtgacttattgaattacaggctgcattgaaagattggctgtgtttcttaagtgaaatttaggacattgggaagaaaagaatgggaccctgagaattagagtagagacatttgggaggattcagatgactcacactcccaacctccctaaatcctccttatcagcagcagcagcccttatcctctgaaggacacaaacctgtctgaagaccttagaaagaccttgcctagcttctaagaggatgccagttcctcatcactcactcctatcttattacctctacttatctatttgaagtcagatcccagtgtgtcccagagatttaatcataaagtcacaccttgggagaaatatatttcttctactactgccactgctattgcaattttttacataccaaaaaatcacaagattttgcaatttatgtctacaaaatttgcataaagttatccattgctcatcctaattttcttcctaactaaaagggacatctgtttttgcaatggctctagtagaatactacatttcccaagcttcctaatatctaggggtggccgtgggacctagtcaatgagacataagtttaattgtactgattattcctaaaaaaaagttttggtatcctaagaactgctcttccttcttctgcattcttccttactgcgtgggcttggtcacaatttctggaactatagaggtcatcttgcactcatcagggaaaggccagaagaattgctaggacttccaatctgacatttttaaacccctgaacaagtgacgacaatcacttttactttttttttctgtaattaatggaagggaaacaaacctaattgatacattcagccaaacacaatcatcagcagtgatgatgcaaaaatgtagcaaagacatagaaagcacctattttccccttgaaaaagtgaaaattcttgagtttcactgattttgctaatttagatcccataccaacactttattcaattagtttggccagagagtcgctgtgtgctagttggcttaggccagtagggccctccctgggagctggggtcaatcccattaaccccacttgtttgcagctccatgggaagaagtgctaagaagaaaaaaggagatgtttggatgtgaaataggtgagtaacatgtccacttcatccctattgtgaatatgtcattaaaatttactactcttattccactttcatggtcactgaacaatctgctggttggatttgacttctcatgtaatttataagagggatatgaactaatcaactaatactagcattgtgatctgattgctggtttagttaatacatttacatagacgattttatgaatcagcatctctgtctgagcttagttaatgtaagtactccacccccacctccaagagatctgctctgcctgtgatgacaagccaggtcttgagtctgtaaggatgttcagggccagatcccagaacagggaattctccaggtaaatggcatcctgcccactcactgcctggggaactgcctttgctgtactttttagcttctccttgaacccttgaaactgttgtagatgtcatgagtgttatttttcttcatgtaagatttcagcagtagcatgtgccctgtctccaggagtaccaaagataccatgcagggtgggacagagccagttcccatcttcctggagtcaacatgattctagaaccttcaccactatagattgtcatcacttcgattccatttaagagtgctgtggcagatgtaactagaatgataccaattgcagaaatgcagggtgagcttgcaaaacaaaaagtcattgattctgtaacccataggctaccaagtgtcatgcaaaacatctggggtatagttaacttgccaatatttattgagtacaataagatgtacatctgactaatagagatgttattagtaatactcaataggataaagagagttctggatgggaagatagaagctacactgctaagtgctaattttctttactatggatgcctccatgagcaaatcacttcaattgaacggccttcaagtttttcacctccaaaactgaatactgtactcacaatagttaaatatttcctgagcagttttatttatctcattaatttactttaaaaggcctttcttcgtatcacaaactccaactggattgtggtttctgagcaaattataacaaattttgtgtttgtggaatccaaattaatgagatttaactgcatgctaattaaaacgccttagaattctgcaaagactttcccttcaagagttcaaatttgttgatgaaattttctcgttagacttcacaatgagtgtggaaaacaaatgatcagtctgtaagccctaaaaaaagaaaaactttaagatattcttcccaggttttaataacacaacctggcagcaatggaacaacctcacaaacctggccttaaggttatcttgcaggttaactccctctcttaaagagattcttgtaatgatttaaaaccaaatggcgacgtagcattgaggttcaattagcggattccttagttgggtcttgatcacatctctgattgtcacctctaatagggcgtattaaaatttccattcattatagtcattagtctctgccagtgataaggttgtgaacaaatctgttggtgttcaacttctaatttgtgtgataatttgtttatgcttagaacacttactggttgtggatggagggggtgtgacccatttagaaactattcatgtagataaatctggaaagtttgcctggaatggctaaggcatggtgatgccacctagtctagtaatagacaagggccacttagaaggtcagatgagtcttattccagagtcaggaagagaagtggtttacccagagatgcaatggggttgcttcaaatgatccagaagggggtttttgcatggaaagaaaggttccattcggtcattgttactctacaaatggggagaaaagcacctgcatcagaatcatctgagaagcttattataaaggtaagctcttgggctacactccagacctctggggctagggccctggaatctgtgtggttagtaagcaccccagattacgcctaggcgtgctgaaattgagaaccactgcaggagacacctgagagcagagacacagaaacaaattaggtatagcaaagacatcaaaacattttgtagtaaagtattgagaaaccattcaacttgcatttatcattgggatttttgccgtcaacagctgaaatacaatatttaagaggaagaaaatttcaaatttgcaacaagccataagaaatggggcttggcaaagtgtcttactcctgtaatcccaacacgttgggaggccaaggtgggcagattgcttgagctcaggagttcaaaaccagcctgggcaacatggtgaaaccccatctctacaaaaaagtgcaaaaattagccaggtgtggtggcatgcacccagtctcagctactcaagaggttgaggtgggaggatggcttgagccctggagggagaggttctcgtgggcaagatggtgctgttgcactccagcctgggtgacacagccagaccctatctcaaaaaaaagaagaagaagaaaaagaaatggtttgggtgtgggtttttttttttatatactttagaggctttcaggttttttcttgctctgtgtggtcttattgagttatttgtgtttgagtttggtacataaaataattttagtacttcttattatatatacaagaatcatggatatgctcaactttatgtctcctatgcctgaaaagttgtgcaccaataactcataagtttttttaggacactgtacactttgtgaatctgatgaaaggcgtggaacttgattcccacaaatgtgtgtgcatcagtatataaagcattacatttaatctctggggacttagagatcagtgctctctctggactctacatcaagagcctctgacctgagcctaaaccacccagcctgctgcttcacaaagtcaagtagctccacctatgactcagccatagcaagcagggaaaggccatggtttgtgtgggaaaaatggatgaaagcaaaactgaggaattcagcagtcctcgaggcctcgactcacacctttaaatctgttggaattgccacaaaaatatttgttttcctacaagaatattagagatttacccatcttgagtggcaagcctagatgccccattcactcatcaaggcctgatgccatatttagcaaaagagccataactgaaggtgcgtttgatgaatttaataggattatgtcttactaatgacattaggctcctgggtcgggcttagcctttatatttacgttttatcactgcaaatgaagatgatattctctggcatatgagttttgcaacctcagggttagtcttgtgatatgtgaagtggcccttggcttgttttgggcccattataaattagatttttaaaaaaacattcactgtgtttattttttattttatttttgagacagggcctcatgctgtcacccaggcaagagtgcagtgatgcaatcacagccctctgcagactcaacttccctgggctcaggtgatcctcctacctcagcctcctgggtaactggggctacaggcatgcatcaccatgcctggctaatttttttggtattaattttgtagaaatgggttttcatcatgttgcccaggctggtcttgaactcctgggctcaagtgatctgcctgcctcagactcctaaagtgtcaggattacaggcatgagccaccacgcccagccaaaaaccattcgctttaggaaaaagaaaaatcaaacttcctataataccaccaccaaagatacctaacgttaataatatagcatgtattcctctagcaaaaattctatgctttttgcaaaaatagggtcatactatatttagtgtaatcaaatctggcttcttcacttatatcttaaatatctatttcaataagttccatctatcatgttcactggctgctaatattctccaatatttatgtatactttaagggtcaactaatagatgcttcagctcattccataaatgagatttttctaacatctttctatgcttatagccattaacatttgggatttttgctgctgttatggttaattttggagtctctgaagaaacaggtgctttgtagcatccagttttcttgcttaaaaggaaattcctcagagtttaagggtgtttagatgtaattttcacttttcactttgttctggaaaactaagaataaataaaaatccaaatctatagcccatgtccacccactcctttgaaagtaatcaacctcagtctctgaaatttcaaaggaaaaaactgaaaataccactgaaatcatttttaattagacatttagcagttcctaaagcaagttataatttggccttcaaaagcagtatttttaaagaagggagcattttaattggtatgttctggcttagcatattttctcagacattaaaattttaaaatctagatgtcatatcaaagtatatgagatgaaaaatatgatttcttctatctaactagctaaactgtggcacataactggacgtgtctatatggatggatctctgggagaaaagaaaaacttttctattagctatggcttgatatatctgggggcccagagctgccaattttatatcatgcatatgctgtgtagtatctcctactcaaagtgtggtccacggaccagtggcatcaatatcaactgggaacttgtcagataaatagaaccatgaatcccagcccacatatcctgaatcggaatcttcattttaacaagatccccgggtgattcttatacactttattgattgattgcttgattgattgagacagagtcatgctgtgtagcccaggctggagtgcagtggcgcaatcttggctcactgcaacctccacctcctgggttcaagcgattctcctgcctcagcctccaggcgcattccaccatgcctggctaattttttgtatttttagtagagatggctttttgccatgttatccaggctggtcttgaactcctggtgtcaagtaatccgcccaccttgacctcccaaagtggaggcattacaggcgtgagccactgtacccatgcatgctgttgaggacaccaaacaaatcaaaccaaccagatatatacacaacattcatctacttctctccactagatatacgacatttctttcaaagaacttgattcttgcaggtgtttgtaaagtgatttaaaatatgaagatgttgtatgtgcattaatataggaatgtgtgtgttcaatcaaatggacataaagagttacatatagtgaaacttctcactttattttgataataggagatttggtgagcaccttcattccttcttttcattttaatattgcatactgtgcagttttttaaaatttgttttagacacaagatctcaccgtgttgcccaggctggacttgaactactgggctccagcaatcctctcccctcaacctcctgagtagctgggactccaggcaagcaccactgcatggggcttggaacattttcttaatctggagacatctaaattaagactacaatattaaaatgatgaaaaaattgaataaagatgttcaccaaaacccctagtgttttgggcaataatgattttaaggctttgaggccccttcccaatgccagtcattctacaaattgttcataagcacaagcaaaatcgtaagttgtaatttggccttcaaatacagtatttttaaagaagggagcattttagttggtatgttcttgtttagcatattttattagatgttaaagttttagaatctagatgtcatattaaagtatatgagataaagaatatgacttcttccgtttaactagctaaactgtggcatataactggatgtgtctgtatagagggacctctgggagaaaagaaaaacttctattagctgtggcttggtatgtttgggggtcccagagcaagccagatacttgactggggaggggggaagagcaatttatgtgccagtaattacaattataaacacatgaatgtcctgggattggagaacctgttctgtatgagggtaccaggagatcttaacagtggaagaacatttaaactgaatcttgatgaataagtaggattccccaaggggaaccaggaggaaccagcacctcaggtaactggaagaatgaatatgaaaatacaaaagtaggccaggcacggtggctgacacctgtaatcccagcactttgggaggccgaggtgggtagataacttgaggccaggagttcgagatctgcctagccaacatggtgaaaccccgtatccactaaaaatacaaaaaaattagccctgcattgtggcgggcgcctgtagtcctagctacttgggaggctgaggcaggagaattccttgaacccaggaggtggaggttgcagtgagtcgagattgcaccactgcactccagcctgagcaacagagcgagactctgtctcaaaaaataataataataaaataaaaataaaaatacagaagtaggttaccatgttaacaaatacgttcatcatcttgttagtagggacccattggagggttttaatcaaggaatgccattagatttgtatttgagaaagataattctggtggttcagtagaaatagagcaaggtgaggtcagaggcagggaaatcaactaggaagccgctgcaaccatctgagtgacagaagatgaacttgaatcgaacattgaatgtagcaatagtagtgtgggactaagttcagagacatgctggaagtggagcaggcaggttagggactgagcaaagaggtagcgtggggagactagaaagacaagaaacactttgaagattctagttcggggctgggcacggtggctcacgcctgtaatcccagcactttgggaggccaaggcagccagatcacctgaggtcaggagttcaagaccagcctggccagctgaccaagatggtaaaactccgtctctactaaaaatataaaaatttagccgggcaaggcggcaggtgcctgtaatcccagctactcgggaggctgaggcagaagaatcgcttgaacctgggaagcggaggttgcagtgagctgagattgtgccactgcactctagcctgggcaacaagagtgaaactccttgtttctgtcttcccttccttgtgaaatcattgtagatacatttgggaaaacaacacaaagagattccactgtcccccaatagtaacgtcttgcaaatctatagtaaaataaacccttctaaaaattgtatgatttatgagcaattttaaattaaaatatcagtatactctcatgctgatttctaactagtcatttctctgacctcccacccctcccctcaccccttggcccctaccaccctcccacacacatacctaatggctctccagaccaggtcctgtccccatgctcccctgatcaagcagatcttgaaccttgtggggaaaatcacgtctctggtggtcactggatgcctggtgtccatcctgaccctctaaagctagggcttcccattgtgggctggtactccctacatgtaccctccatgtcctcttgtagggaccccagcttcagcagtgctctttaccatgttgttaaatatatggcaggttggggtttgattctggccacagctctccccagataactgacagagtcatttagggcctttgtcccacatttctgggaaatttgtttctataatagttaggactttggtatgctagtgacagatgcacagatcaaattaacttaagaaacataaatgtactggcttactgagttgggaagtccagggataaagctcccttcggagattctgggactcaaacaatatgatcaagattctctctcccttgcacttttgctgatttgttgacctcatgctcttcatggtgtggtttatatggccattggcagatctggagatacatccttatatctcagagtgacacatgaggcataagactcgcttctccaccatcactgcaaaaccctactggagaagggctctgtttggcctcatttacatcctgtgccaatcctgtgggccaatcacttgtgcagggcgatgtagtgtattttggatgaatcaaccaatgactcagcctgagctccttatcatctgatagacttggaattggggtatcaaattgtctggcttagtagaaccagatggaaagggaagaaagagtttttcaaaggaggagatattgacgggatgggctaggcagaacagctaatgtccattttagttattcctggatctagcgtcttctcctgtggtgaggagagaggaatgtcacatggcacctatggttgtctcttgggagttatggtcagtgttgacagaagaaggcaaggatggctgtaagcaccaagatgtttatatgtatgaggttggaatttagaggtgttcagaactaatagccttaattgtctttgtgaaattgaaaacaaaagcacttgtgaaaagacaggaaggcagggtggggagcttaaaaagctagttgagggtttgaaggatgagagagagatcacaaggacagtgtagaggactgctaagagatattgaggatccaactaagattggaaactgtagcactcaggattctccagagacacagtaggatggatatatatgcgtacgtacacacacacagaaatttatttcaaggaattggcttatgcaactgtgggggttgcacatctgaaatctctaggacaggactgcaggctggaaactctcaggcaggagctgatgctgcagtctcgaggcaggatttcttcttcctcggggaaacctcaattttgcttttaaggccttccaggtgaagagatgaggcccacctgcatgatcaagggttatctcctttactgacagtcagctgattgtagctgctaaccacatcaatcaaatacttccacagcaacacctaaattagtgtttggtgggataactgggtaccgtagccttgccaagttaacacatacattggagtgtcacagaggcctaaactctgtgagccagtctgcatgacactagatgatctatttttcctcttcagttccacagagataaatacctagcaaatagaagccaagagagtggattgttaaactgattgatgattggaggaatcttcaggctggggtcactggagtctcaaggggagatcttgacgttgctgtcgagagaatggtggacaaagtccctcagggttgtggctggactgagaagttagttccccaagcgtaaagtgacaagagcatcaaccccaccagttaaaatgaataatgcatgaataatacttatgttgggcactgaactaagtatcacattaattttaaattattatcattgttacgatttcatttaattgtcaaggaactgacactacataaagtcagagtggatttagtgggagtaagagggtgagctaaatgtggtatattggagtttatttatttactcaaccaccagttatttaataagcattgattatgagccaggaactgttttaggtgctagagatacagtggcaaacagaacagacaaagtctctgccttcatggggcttaattctgttggtgggaggaggtatctgctaataagcagacaacttcagcaagcaacactagccccaggtccagtggtaagcgtgttatgaagaatagtaaagccaagttaggcaatagagagtgatggggccagacagggctggggtaggatgctagacttataagagaaaccctttcggataaagtgacatttaaacaggaccccgaaggcatgaagggagagcgtgggctatgaatatatagggaagagcgtgttcgagagaaagaacatggtgtgtgcaaaggtgctcagaggctggaggctgcttctccctgtaagtgaggaggagaggggtgggggatgaactgggataggttgcaacaaggagccatgttgggtgtggtgggtcattataagttctctggagttcatgctgagtgaggtggcaagacagtggagagttttgaacacagaagtgacaaggttcttctctaagggccgttttggaggccgtatgaggctgtatgaagggatactgggaggacaaggatagaagaaggagaccagtgggaaactgttaccgtaatccaggcaagaagaatttgtggtctgaaagccatgctaggtatgagcatgaccaggaccatgccacgggtatgcattgctgaagcagcctgccagcgaagaccaagatggcccaggaccctagagcagcatgtctggaggggtctgctgtgttgacatggaacttcttcaagatggagacaggatgggtgggcatggggagaagaactctgacccagattctgaagtcctccaggagagggaagatggtggaggaaagcagcaacggggtagaaagaggagcattagctgcatgcaggcaggtgcttgaggctcctgcctctgggtctttgcatgcacttctttcttttctgaaacattctcttcctaatatccacgtaactcagtctcttccttcccacctcagatctttatttaaatagattggaagactgctgtcaggacatagtttatgtaagaatgaagataactctcttgcctccatccttatgtcacctggcatggggtggcatgagcagccactgcctggaaggtctacttggaagtggtgtcctcaatggagaggcggatctggcttgaggctgggaggtgaggggactctcctgtgaaaggggtaggaatgctggggaccttattgaccatgggctaggggtttcagcaggcactgtggggagtgtctttagggaagtcaggaaaggagggtagaatcaatggggatgaagtaatgagaggaccagagggaacaggtgctgggatgggagctgaggatgccagaacatgggattgactgccctgggagggcctggcaagcctgaggctggcgtgcatgcagcctgtacgcttcctggggcaccaagcagagcatgggtggccacaggagacgtaagggagcgttgtctgaggggatgtgaggaatgaccaggtgctacccacctacagagctctcaggatgcttaactcctgaagaagctgtagcctggaatggcttgtagacctgaatgtataccaggtgtaactggcagagagggagcaggccccagaaggtccttgttcatcctagtcaggtccttcatcctgtcccacttcagggcccaaagtgctctgattctaatgccagcctctttggccttgcatttgtagagaagcgagttccctatcattggaggtatctaagcaatgaagtggacagccacttagaaggagtgtgcaggatggaggcttgggtatttcttgggggctggactcgaagacctttattttccacttggcctggagcgtctgtgagtccttgtcaaatactgcctggcacttacctccatcgggacacagtgcaggcatggctcaagtgggtaaattgtttatggaatgcaaacctcgtgggacttatagatggcttatcaatgtggaaactgtattaaaaataagttgagatcagcaccttccacagcctctgcatatgaaatgtcacttacatttaaacccacatcaaaggttctgggttgattctttgtatacttgttagtagtccaatgcttaggacaccattttcaggtagctgttttttagtgtgtgtttggcagggctggttctatacaaacgttcacagtgagcagagggacagcatgatgtctcctgccatggtttcacaattagctagaagagagagggttgcaggctcactgggccagaccggacgctagaggctgtattcagtaggtggggcagtggcatggacctctctgcccatgatgtggacatcctggcagatgggctgtttcgagagcaagccatggcttcaagaccttggctgtttgtggtgatggggtgaaggaccgaatagttagagttcgtactgagtgtctgtggtgcagggagattctaatcacatcatttgggggtagcggctgtgcttagcactggttaagggaacgaacgggcatagttgtgctatgcttgtgagtatgctcacttcctggagatggggagagtcaaattcttagagtgttgtgtggcttatatattttattaagcacctgtgttctaagtccgataagcactttgcgtacactgcctttaattttccgaatcattccgttttgcttgttgaggaaggcaagcagttaagacaggctcatctcttgacatgaccccacatagtgactgtacctcagaggggtaaccattttctgagagctgggtcccaactgtgttagggtcaaaattctgatttgcataaccagaggtgaatgaagacctgggaaactgacacatactatcttgactcataagagactgatgtataaaaacagaaatgatgccagctgcttattttgtgagaagaaaaaaaaaacaattctgtgaaccagatacatatgttctctcatcagtgcattcaatatgaaggcaaatttatatgaggacataaattaagatcagaaggttgcttatcagcatgaaacagtgtaggctgagtgaggataggacaccttactgacagggttacagagctgtgatcgtcttggctccagtgccaccctgcctgctgtagggctggatggtaaggttacctcacagtgacagggacaccaccaccagtcccagccgctctcagtctctgcttgcagtgcctctaacactgatcatcatcagcccattgggctgattcatcctttctttagacattttcctcatggaccctcagtaagttgtcatcttcctttgagagcaagttttctctttgtggtatctttgcatctcaccactttatttcgttatttttgttttgtggctataagctctacagagaagttgtattgttccatttccaaatttgtgggaaaggggaagaaaagaggagaggcaccatattgtcagcctgatttcccacctcagagacgatattcttgtcctcgttttacaattgagtcaactagatggcatggctttttttcctagctcccattgccatctgacgtggtatttatttagttgtttgtttattgtctatttctcctgttagaatgtaaacttggggacagcaggtctttgccatattcttggcatctggaacggtaagtggcctgaggtaggtgtgggcaggtaggagtatgcgtggattgaagaaggatgaggcaggccctcaatcccagtctctcccacaccccaccttcagtttggtgaggtgacagaagggaggaaaatatgagaagatctgagccaaaatgaaaatcagacaaaaactcagggcatgttctgggggtccttgtgtccctacatcgtcttaaagaaccagcctgggacagtggggactggagctggtgacacacaaggacccaagaatatggaaggcctttctctggcataattgaaataaactttaatgaacaatttgtcctgttttaaatatctttatagataatatctggagctggacaaatcatgtataatctacttcctttatcattcttatttcaattatatccatctacaatgtctcagccaaagggaacaccatttacctggtagcagccacctgaattttaggcattgatatctaagagaaaataagttgctcaatggttgctcctttgtaacgccaaacctaggacttgactatatggttctgatacagtccaacaatgtgctagttgataacagcttgtagatggatatatatgtattctgcatattttgtttggtgaataacccacagcattctaactcaggtgtccagtactgcttatcaaataaggctttaacatagaaatacataaattctagaaattgtcttgcatttattgtattagaaagtgaaattggtttctttaaatctttgtaagggctattaacataatatcttgttccaaatcaaatagagctacttactactaaagacttttgtactttcttcaataattaaagcaagcaagatttgtagacaatgcaattttcatgatgcattgaaaaatgtattcttacagcagctgtgtttatcacacactttcattttcttaatatcttaaaattgcttggcaaaatgaaagggaaggagggtggtcagggatgtttccaacattctattaggatcattttcacacaaacagaaaatctgaagtaattgttcagtgggtcccctgcacccatcacgtacattttacaattaatgttttcctctgtttgcttcatcactggctatccatgtattcatccctctcttcatcttatttttggtgtattttaaattaaattgcagaaatcagtacacttcaccactaaacagttcagcatgcttattattaactcgagttaaatatttaatatatatttcaggtaaaatgtgcgcacagcaacataagcacattttaagctttccattcattgagttttgacaaatgcatacacctgtgtaatgccaatcccaagccaaggtacagacattctttttttttctccaatttaaaactttaattaaaaagtaaactttaatgtcgaaaatgcaaacttggggaaggcagaaagatcacacacaaggctgtcacttcacacttggaaggttgcacagcggccgggcagaggcgctcctcacatcccagacggtggaggggccgggcagaggccctcatcacttcccacacggtgagggggccgggcagaggtgctcctcacttcccagacagggctgcggccagagagaggcactcctcacttcccagatggcagggggcgctgagcagaggtgctcctaacttcccacacgcggtggcagctgcgcagaggcgcttctcacctcccagatgggcggcggccgggcaaaggtgctcctgcttcccagacggggcggcggcattcttaccacccagaatggtgatgctagtgcctctttccagtcgatttccaccctacgtgcacgcagagggaacccatgttctgatttttttctcagcatggattactttagtctttcctagaactgtatacagttctagaatcatatagtatgtactatttgggataagtacatgcaatacatactactttgcatgagactttttcacgcagcacatttttgaaattcatctatttttgtttgcatatgtcagtaatctgtacccattttagtgctgaatcatattccattgtgtgaatatgccacaatttttaaatctatttacttatcgatggtcacctgcgctgtttccagtttgcagctattatgaagaaaattgctgtgcatgttcttatgcaagtctttttgtaggcataagctttctgattacttttgaaactcctggaatatgtagtcttagcacagagtctacacacagtaggtactcaatgaatgtatatattgccctggcacaaaacccacatgacatgttgggttttacagtacaccagacgttttcttcctcatctgttctcagatgagcttcgtaactacctgctgaagaggcagaggcaatccacacaatggaagctgagacattacataatcgctaattgttggagctaaactagaaccctggtttcctaactcctagtcctgtactctctgactgcttgctattgagacgggagagttcccttgacccctttgcaggacttgtgaaaggggtgtggcccacttatttgactgccaccatgctcaaaccccctgcctgagagggagcatgcaggtgagcaggtacaggagctgggggaatgtggcaagaatgaaccccgtactggtactggtcaacggcagcatccagggttgtctgcgacctctggagccctcgagggcatgtgttacaacgctcatagcagttactatctgcagatagctaagtgttaaccagctcagtggcaagtcagggtgacaggcctttacaccctgccctctgggtacctggcttcctgtctggtgtccaggaagaatcaggtcacataggcttgaaggatggttcaaaatatggagattttattaagcagtgggagtggctctcagtggaaagggagctggaaaggggatggtgcgggaagaaggtgctctatctctgaagcttggccgtctctgaggaggctcttctccaaagttgttctctttgaagttaagccgcatctgtttatagtttcggacactcagttgcttctccttttcacgttcagctgcttgtctctctgccagctaaggtctgaggtttatgtgggcacaggagagggggagcgggtaggccaaaaaggtaacatttgggtgggaaaacagggataactcttctcatttagggctgtggtttccaggcttgagggtggggcctttgccaggaaactgccctcttctacccagtacttccctgtctcctgtctgtatcgctatgtcagtgccaaaccgaaggtatgtgtactttacatcctcccttccccccaagcattgctctgtgccacagttacggtctttgagagttttgggtttgtactttggctctatttaagctcctggtcatcagaacttatgtatattttccccttttatatcatcttgttttctcagtgtgtatatattgaggtgaggggaggggcagcagggagggcctgtagagggagttattgaaaagtgacctaagccaatctggtacttttgattggcaatcagagaagtcagccatgaggttcctgagtctctctttctctgccactcccagctgctctgggatcatgaaaaccagcctccaacctgattctgcaacacatgaaaacttttattaacaaggagattcatataccatgcctaaaacactcatacaacctgttctgtaaactcaagttgtcccccatccgtggtttaggcagcccggttgttaccagtggaaggtgtccgagttactggcagcaattccatatggatctgcagcaacttcaattcttgcctcctcagaagaaagaattcaatggaggggcataaagcagaaaaagagactgaagttaagtttcagagcaggagtgaaagtttatttaaaaaggctttagaacagtaaagaaaggaaaattcacttggaagagacccaagtgagcacctgaaggtcaagagccccgtttaacggtgatgctaggactttctaggattcccatgattcctcccttagggtgagctgcctgcatgcacagtgccctccttacctttgggaattgtgcacacacagtgtgtttaggaagttgtatgcatgcccatctgtggctttcttcccttttctggtggtgtgcccctggaagtcatactttgccattttgtctcttaatgcacctgcccaggaagttgcttctccctggagcctgcgtttgattaacactttaatgttaacagatgtgcctcatcaggagattgtctctccctggtgcccttggactggctgctgaattatcatttttagagaggcagtgtgataattgtcagaccatcacctgacattcctagtgggtgggggagaagagccttctcctgccccgctcatgcctgtctaactacctgtaacacagtgagcacctctcttgacaccagtaatctgatagcaggatcaggaagctgcttcttgaggacagagtctttccggaagcagtaggacagtggtgtgaaggaagttctgggcctcagccctcctctgaaagtgtttgctaggctggctaagcccagcacccttttcatggaaattttgaggtttctagccatccctcaaatctctcatagccttcatttgaccattgaaaataatttctaatatccctttatgctaattaatgaactatctgttgcagattcagatgggagagttagaagcttttatgaggccacctctgggaatataaacaccatttgggatctttcaaatgctcactaacaccactgtcttggtacttcctgcttagggtgcttcatatattaactagtaactgttgagggtgtcctaacatgaatctacacacacacacacgcttaaagctcactatggatggcggagtgtttcaacataaaacccaggtcacattggggaggtactagagtccatgtgtccttcccctaacccccaccctctaacggtggcatttccaccagactcttgagttttcagtttgagggaatcctttgaataaatatgattttctgcctccacacttaatgtggttagagctgcagccttgatcctaatctgtctgatctcccatcctcattgatagtaaaccagtgagtaggcaagtcaactgtgagttaatcggggtgggggggatttttaaatgcaagtctgatgtttaaatgtagctctgattatgcctcttggctatcagaagtgagtttcatttggatggagagccattttactgagggcacacagcacagaagctgagctgcagtgtaaagctttcaagtgactcttggagctattaaagtgccactcatttggtaactgttgctgttaattaagtttgtagccccattattaattcttggctctactattattaattatgcttctataaatttatagtaggcagtacctcagggaatttttcaagttgtatattaaaattagagataaataaacacttaagcttccttctcaatataagaagagtttggggtttttatttccggtactaggtaaatttgaaaggtatgtgatggtcattttctctccttactgaaacattttctacatggtttgcagcagaaatttctgtaacatatttaacaatgcggtttagtatttaaatatttaacccattcactgataacttgtagctaattcctacaattaaacttacgcctttggccaggcgcggtggctcacccctgtaatcccatcactttgggaggccgaggcaggtggatcacgaggtcaggagattgagaccatcttggccaacatggtgaaaccgtgtctctaccaaagattcaaaaattagctgggcatggtggcatgcacctgtaatcccagatactcgggagactgaggcaggagaattgcttgaaccagggagtcagaggctgcagtgagctgagatcatgccactgcattccagcctggtgacagagcgagactctgtctcaaaaaaaaaaaaaaaacaaaacttatgccttttatgagagcaagcagacagagaaggaaaagaaaaaaagcctggcattttgtgtataaaaaatcagagctcaagtaatgttggtcaaatatagatgcaaacaagtccatgtgcatattaacaacccctttcaccatgtgctttatttctgaaaatactttaaatccttttctgtcttctgatccagctctccagacaatagttaataaatgggttcataggtaattatgatgcattttggttcttttacctacagcaaattcctttttttctctctctcttattctaagaaggaacaaaaattgcccataattctccaggttatagaaaacgtctattggcattttgatgtagttcctttcagatgcttttccaagcatatatcaaataatttagatcacacaatgttatggtttgattttaccccttaacatttgatgtagcaattctttattattggacatttaagttgtttataatttttgtccttgcaaataatagatatatgatatgttggatagctctttaaataaatatttgagagtacctctaattatctattttaatgcctagaaatataaattttttgcctaaaggcatgaacattgttcaagttcttgatacatactgaaaaattgctttccaggaaatgacgccaatttccagtccactagaaacattccacggtgtctgtcttactgcggccatgccatttaatatagctaatacaattataataatattaacttgctaactttataatttttgaattcggaaacttgaatgagatatgctggaacatcaaatagtgacctattttatctcaacgcttcattttgctttttggagccaaaagagttctttctctctcaaattggattcagtagttgaggggctacacattaactgacagtagccatattaacaagagaaaagacaatatttatttacccatgcatgggagagctgctcagtaatgagtaacccaccgactagccagagataagggtttatataccaacttaacaaaggtgaagggggcaattagggattcagggggaaggcatgaaggtgctcttgggcttttcagtgataatgggaataggaaatatgtcttcatggcagctgaattaggaggaaactgcctttgaggggagttaatggcagctgtatttttgggaggctctgctatagtcagataagggaagttcagataagacttctttctgcatctcctgcagctcaaatgttttcaccttaaaataacctttataaagactctgagggtccaagtgcatccccatactttctatttattttaacatcacaaataaatgtgctcaataatagataaatttttcatcatgaaatgtattgaatattagtaataatggtgttttctgccgtttttgacaggtaaattaccagtaagggatgacacaggaggagaaaaggagaaaatgaagaactgtcataaggataatttttattacagatatgaatatatttgtttggaactaacaactatttttagaagacaaattaggcagaagtggtcactactgtatggacaagggtgaatagtagttgtgattttcaaaaattttttaaacatatctcttgatacagtatttttccaacttcatttcttttctttttttttttttttttttttttttttgagatggagtctcgctctgtcatccaggctggagtgcagtggtgcaatctcggctcactgtaacctctgcctcctgggttcaagcagttctcctgcctcagcttcctaagtagctgggattacaggcgcgcgccaccacacctggctttttgtgtgtgtgtttttaatagagtcagggtttcaccacgtgggtcaggctggtctcaaacttctgacctgacgatccacccgcctcggcctcccaaagtgctgggattataggcgtgagccactgcacccggccttccaacttcatttctttcaagtcacagtcatggaacatgtttacaacttctgagttacactattttggataaatagtcataaatatcagaaattgaaaattagattaattcctccttattttgatattcacctaggaaatagtttttctacagatattattctggcaaatctcagtttcttgaatctcagttccttgaatcttgacttttgtcgccacccttgatttgaacatcccttggcagctttgtggataatacagtgtgagagacataattgaaaagcatgacaagtgagaaaatgggttacatacctcaaaacaaaggctcattatacatgacaatgcaattcatttgggtctctccattgcatatttgctacaggtattgattgccttccaactcttcccacagccttttgctagtcttaaaggcataaatcacttggtgaaaggatatttctatttcagccagataaactctttcctttttgtttagatttaatatgaaggcaaaatgcactgctctcagtgaacagccttgtttcctttcgtttaatggggaagggaacactgaaacatttcctacattctctaggaaaagcaccttttttttttttcttgtctttataaccctgtatctgttgtcactgattcagctattcagtctgggacaaagcgacttttaagttctagagctatgaggaagctataaagggaatacagttcactctgtagagaaataacagcctgggagatcatggaccagaaatgttactctccaaaggtttgctagagctttactttgaattctattcatcaatatttttgttggcctggatcagtgactctaattatgtatagaagatagaaacagcagttatatttagcaagctggaaaagtccctgcagtctaccctcagaacagctaaacatacggagtcaacctgagattctgaatgctctgttcactccctgagagataatgatgactgaagagtgatagcgcagggaacagagtaaagctagaatgggaggcaaggaaagttatcagtcagacctctaggagaagtcccagcccctgccccatgcttttgttttttatttgtctaactttttttttttttttttggagattttccatttcaggcttttgttgcttttctcaaatgtcaaccctacctacctctctctgaacgaacagcccacactttctacttcatcaagaaaattgctaccacagggatgatatcatagcccattactgtatgatgctatctataccttagcctgggcttccaccatttctttgtctcccaaggagaagggacgtgactgcaccggatcttagtgtcatcttttctgcctcccattggggactgtgaagttattccaaggacagttgttccccctaccatagctgctagctccttccctcgtgccaggagccacttagtcacagggtaactgaagagaaaaaagaacgagacctattgctgagcctagagcaagctcccccatacctgcaccccacatgtgtaccaaaagcttgctttctctcccattcccaggtctttgatggggacgaagctaagaccatgtatgccattggccccaggcaataagaggtgcattgtctgcaaaagtcttaaaacaatattaaaatcaactaaaaattggtctttttttttttttgagacaagagtctcactctattgcctaggctggagtgcaatggcacgatctcagctcacagcagcctgcacctcctgggttcgagtgattctcctgcctcagccttctgagtagctgggattacaggcacccaccaccacaccccactaatttttgtatttttactagagatagggtatcaccatgttggccaggctagtcttgtttttattatcaccatgttccagcaattctaaacgatatcagcgttggggaggaaaaacatctcttctttctacctgtcttaagttcattggctggggcccctataacaaaagacagagtaacaagagaaaagcacacacgtttgttgaatgccagttttatgtggcatgggaatcttcacagggaaatgactttgctgagaccagctcagtgggggagaccctaacccagcggtactagaggaattaaagatatacacacagaaatatagaggtgtgaagtgggaaatcaggggtctcacagccttcagagctgagagccccaaacagagatttacccatgtatttatttacagcaatccagtcattagcattatttctatagatgttaaattaactgaaagtatcccttaagggaaaggaagggatgggccaaattaattgcagcaggatcacgcccttaagacacagattgctcatgcttttgtttgtggcttgagaatgcctttaagcagttttcctccctgggcgggccaggtgttccttgccctcattcctgtaaacccacaaccttccagcttgggcgttatccttccagcttgggcgttatggtcattatggacatgttacattgctgcagagattttatttatggccagttttggggccagtttatggccagagtttgggggggcttgctcccaacagacttgaagaagcagttaaactgggagtttttatgctagcttgagtgaagagtggagagtcatggagaaatgtgttaggacagaaaaagtatgagccgaggatagtcaactgggagaaacaacaaggtctgtatgttcacattcctcttgacatccctgtgtctttggagagaaagatgttattttcctccaggcatagggagggtacctttcacatgatctgcctcagggaaggatcagacaatctttgctatacatgctgttttccaaattccttcaacctaaaatattcagtattccaagtcaccatattttggggtagtatgtcttgaaccttatcatcagtgatgtaatattcctccccagaaaatccttttgttggtaagttacaaacaattgctataacgattgttgacccactggcttcctacaggcaacccagctatactcagctgagtgtcaattcataagggttggaatcatttgagtttgctgcctgcacagtttgtgtctctaagccctgtgatactacctagtcctacgtttaaaaagtaggttcaaaataaacaatggtaatacaacaattctaagggtaaagtgacagagcttgccttattgcacttttgtgtgcagatctttctctaaccttgtagcatttattcctttggacgtgtttcttttatgctctccttctcccttaaaataaatacttaaatgtaattaaaaattattaatccattactttgtttccttttttgtactgtgatagttttctaactgacttgaatgtacatacaaaatttaataaaagactatgttttatgtttgccattattttttggcttttattactattattttaagaatattattgaaggcttggcgcagtggctcatgcctgtaatcccagcactttgagaggccgaggtgggcagaccacccgaggtcaggagttcaaggtcggcctggccaacctggcaaaaccccatctctactaaaaatacaaaacttagctgggcatggtggcgtctgtagtcccagctacttgggaggctgagacaagagaatcgcttgaacctgagaggtggagcttgcagtgagctgagatcatgccactgcactccagcctaggtgacagagcaagactccatctcaaaaaaaaaaaaaaaaaattattgaagacaattttgttgtgtagaggaggagggtcttaaatgatcctctctggctgtcagatatgctggggactccctgtgttcctgcacacctgcccaggctctctcctctccttcctccctcattcctgcacctagaatgttttcaaaagttattctaaaagcctaaaataacttccgtgaagacttgctgtgataattccagctctttctttcttctctgaattcttctaacacattgtagttttccatacaatgtagcaagtgatggtatgccagcttagactttttctaatactttttttcccaagatagaatgtaagctccctgaaagttggggttagccttatatttcttcttttgtgtctccccaaagacaacttttggaagtatcccattaaaatgtatactctgtagaaaccagctcaaatccttcaaaaacagctcttctactcctgcaaacttcattatcctctcataactttatgtgatcatttaaaatcaggtttttctaaaacttcggtctgagtgaccaaatgcaattgcttatcttcaaggaaatagtgcttgctttaggcattcactccagaggcacacaaggagagataggtgaaatcaacatgagcagttaatttctggtttcacccgtaaaatactgatttctgtggtttgaatgtgtccctcgaagttcatgtgttgaaaatgtaattccaatgcaatagcattgggaggtgggatcttcaaagagtaatttggtcaagagggctctgtcctcataaatggattaatgccattatcttgggagtgggttagttatcgagagagtgggttgctaatgaaaaggatgagtttgttccattttcctgttgctctcttgtggactgtcttattcttctgcctttcactgtgggataacacaacataaagaccctcaccagatgccagcccctcaaccttggacttcccagcctccagaactataagaaataaatctctgttcttaattatccagtctgtgttattctgttatagcaacacaaaacagactaagacagtgactctacaaccctaaagaggtagtcactgaagaactattaagcattctctcagttgtgtcagtgaaagccatctctatttgtgttccctatcttaagccaacagttctcaaaatatgatccagggactcccaggagtcctagagacctttccaggggttctgtaaggtcaaattatttttataacatgacccagacattatttgcctttttctctctcctaagtgtgtcaaggcattttccagatactatatgacatgtactatcattatagatttagcgtggaagcagatatgagaagccagctgtggtccattaagccagagggtaaagagatttgccaagaatgtaaaaagaatgtcttctcatggagttttttgtttgggaaaatagagtaataattcataaaaatttcctatttatgttaacatatgagtttattgctaattttaaatcaattcataaacacatattttttaatttttcagttttaattttgtatacagcaaataacactctatgtaacccacatatacaaaaggtccttgaggccctcaataagagtgtaaagaccaaaaagtttgagaacttctatcttaggccaaagcagagatttttagaaacatattcttttaattctttctttggttacttacctccaaatcaaagcaatgtgctgcaactgaatccagtggaaaaattaattagctctatgttaattctttggctttgctgtgaaaagcctgatctttgggccattgacatctgttagaaatttaaactcttgagccctgacccagacctactgaatcagattctgcattttagtaagatcactaggtaattttaacctacaggttgagagttatgagcactgctccactttgcctttgtgaatctggctgggatctttttccaactttattgaccatgttaattaactccctcttttttgattctctcctaataaggcttgcagctataactgcagtttatcctgataaaacttatttctgtagggggaaaaaaataatcttctccttcactcttcaagaatttttagctgggactccctgtaacaaaaggtagattaacaagggaaagcaaacaaaagcttaataacatgtatacttcctgtacacatgggagataatgcagaaaaatgagtaaacctctagagtagatctaaaaaagttgtcttagtcttcaggcttaaataccatcctttgctaagacaaaagaaagttatagggaaaggcctggttaagaagaggtggccaggaaaagcatcataaacaaaaccaaggtttgttatgcagatttaagtaatgccttctgcattgataagagtctctagtgatttagacattttcctcttcctggtgcagagagggagacattcctaccaatagggatgtcctgtatagatgtaaatttatgttacaaaagggtaacttttcagtgcttcttctgtatgtgcagtttctcaaaataaccagttcaaaataatcccatgccaaagaggcctatttggatgggcatattctggtttcctacaatcatatgttgggatgacatgtcctgaattccatcacttcctaatgaaatctgataaaggactgacttgtctgacatttattttcatcctacaatgtgaatgcaatgaaggatcaatttgcaattgtattttttatggccttttggatttatgcactagagaggtgctaaagctgatgtgttgattcaagtgaggagtaagaggggtgagaaactgtgagaaaaaaaagtactataaagacacatgcacacgtatgtttattgcggcattattcacaatagcaaagacttggaaccaacccaaatgtccaacaatgatagactggattaagaaaatgtggcacatatacaccatggaatactatacagccataaaaaaggatgagttcatgtcctttgtagggacatggatgaaattggaaaacatcattctcagtaagctgtcgcaagaacaaaaaaccaaacaccgcatattctcactcataggtgggaattgaacagtgagatcacatggacacaggaaggggaatatcacactccggggactgttgcggggtggggggaggggggagggatagcactgggagatatacctaatgctagatgatgagttagtgggtgcagtgcaccagcatgacacatgtatacatatgtaactaacctgcacaatgtgcacatgtaccctaaaacttaaactataataaaaaaaaaaagtaactgtgttttcttctgtttaatgattgttgcactctcctacaaattctctttaaggaaattttcctagaagccttcttccttgaatttgtaagaaagtggcttttcagtgggttgacctcttggcttttacatgtaaatacaccgaaaaaaaaaaaaaaccccaagggatgtaaaaacattgagaagtttctcaaaaaaagaaaaaagaagtccatttagtctggtataactatgaagtaaaataaatcatagtatctgagaaagaaggggaaaatattcaattgtcaaaattagcctgtctcatttatttggccttggagaataatagtcattgatatagaccagtgggtttcaatcttgaataaacagaggatcacctataaactcaagaaaaagcccatgtctgagagattgaattggaatttggtaggtacttatctttaaaattttgacaaggtgattatgaaacacaatgagaattaagaatgtatggtatggtcaaatacgtgagcagatggaacacaaagtccctagtctttaagtgtgtggattcaatcatttattcatttttctttatccagggttagatcctgtaggggcaaagataatttccccctccccctctgaaggttcaagtctgctgaaatgaactgatgagagagattaacagggcaaaggcatacaagtttattaatgtgcataagcatggaagccatacaaaaaaatgaggctcacagaaaggccagatagctgaagcttaaaaagcactctctttgtagaggagccagagatggtggatgcatgaaattgagggttagtagtaaatgctttttaagagagcttaatggacccaaagaggaaacaatagtttataaatgattctctttggaagttgaatttatgggacggtaaggggcagaactgcaaagcaaacgaaggttgtctttttatgcagataaagtttcttgggtaatttcctgaagcggtcctcagaagggtagatgaaaagtttgtctgggtatggtcagaattttgctttcttctcttctccagtggttaatctttcttgttaatttaatgaaattcctagggagggggtttaagactattacaattcttttagaaaaagttttcttaatcagatagggaaattccagagagaggtcctccctgcacttagaagcaaggaaaacagaaagttagcaagtccttggttcagaggcactttctgaggtattccaatttctttcaattcaaaagtggtcagcatgccaaagcactttactttggaatatcatttttctgagccacaacaggcctgtccagagatttgaattaagcaaattaacacaggaacagaacaacagatgccacatcttcttatgagtgagagctaaatgttgaaaatatgtggacataaagatgggaacaatcgacaccagggactactagaggggaggatggaaaggggagcaagtgttgaaaaactacccattgggtactatgctcactacctgggcaataggattgttcattcccccaaaccttagcttcacacaatatacccatgtaacagatctgcacatgaaccccttgaacctaaaataaaagttgaaaagaaaagaaaaatgaataaatcctgtttaacacaagaattttatggccttatacattttctaatgactattagccaagtgggaaacttgttgaaggtgtagagaactaagttcaattcctcatttattccctagatgagctatgccattggagtgaagactctgaactaaattaaaaagaatgtgttagactagtttttgtaccatagataagatggatgcacttgtgctttttaggtacaggaattcagacctgtggaagatccctggagggttaaggaatgcaaatctgcattatctgtaagccaaacatgtaatatgattcactcatgcgtatgcccgccattctttgtcaaatgtatgtgtgggctttattgacagaaaaggttttcaaaaaatcatttagaagcaccactgaacaatgattctttttatcagttagtttagaaattattaatgaccatcaactatgtatcaattacatgtaccctgggatacagtagtgaatctgacagccctaaatcagggagacatacagattaacagatgattaccatctagtgaatttagtgctgatcccattatatctatctgcagtataaatttaggtgtctgtaatcctagaaatactgctttaaagccagcatgtctgctcccatctccctgttagcctgtacaaatctgctcaagtgttaattagtaatcccaggagagaagtgctgtcattcacaattttctcaaaattacctctagaaatagtaaacagtggctcgtaactgatgaatgtgatggttttagccaaaacatattctcaatctatgtctactcaaagtagggcaatagtcatgatggggggaggggtgatagtaaaaatgcattaacatgaaaatgttgaaaacaatgatgcagtccaattatctctttatagaggaggactctataaaatgttaagagagatacaatgacatgttctagattcatggtctattaactcttgatcctaggtttctcaaagggctgaactgactcaaatatactggggactccctctgctcctcacacctgcccaggagggttacttctcaaggtcttgtgccagccattagtgttgtccactcaaactgctcaggaagcgtggtaagcacggtcagttgtgtcagcatttgcacaaagtcagtgacttacggtgcttccttgtggaggagttctctatccaatggtgccaggcttggccatgtgacttgctttggtcaataaaatgtgagcagatgtgatatgactatccacatccgtgcttaggctgtaagagccatcatgtgactcagccatgctcttctctctgccatgagaatggcatattaccataggaaatagtccttcagcctgtggagatagggcaaaacagagccacggcccacctgccactggcatgtaaggtgagtaggaaataaagctttctttgtagtgtacacccctgtgattggaaggttatttgttactgctgcataacttagtgaaagacaacttatatagtaggccagagacctgccaactttttcttaaagaccagatagtaaatattttaggcttgtgggccatttacagtctgtcatagctactcaattctatggcaaaagcagctattgacaatatataaacaaataggtatggctatgtgccaataaaactttatttacaaacacaggtctttggcttgtgggctgtagtttgcccacccctgccataggattttgcttcctcacctccttgaagttggatgtggccagtgaagttgggtgtggcacttgctttgcctagtggaatgcaagctatttaaagaagtggtgtaagtggtggctactctgtcagtctgagtcttgagagataccattagagagctgagcatcggccaacctatgctggacattcagcataactaagaaataaaccttattgtttaaaaccactaagatgtatggggtgtttgttactgcagcatatataactgcgcctatctgtactgatacaggtctatctggcattacgtttcggggcaccacctctgctcactgccatcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacattttcaaaggtatgaaatcacctgaaataattttttagttcattttttagtggctaaaatctgttaatagtttgattcacaagcctggcctttgaaaaagtaaaaattggataatgctgcacaagccatgttctccctggtgtgtaagggttaattattggactcttgcttgatgatgacagtgcaggttcattgaagtcatcactttatatcaccagcctgtctgcagcactgttggggccacgcctcttgtgcgatggttggctcagacctgtagcttcctttgccttatcccctttcacattgaagcctcatctgctgcttgacagtgcatgcctgagagttgcttttccacagtccctgttcttctcctaggtctggttaattgcttctctgttaaacagagaacatgttgaacagcagccttaaattattgtccaattttagcctactgggaacccctctgcagctactctgatcaccactgatatttctagaaagttcctattcacaggggactcttttctcccttctttatgctcaagggagaataaatcacagaagcagcaatccctccatgtgtcaaactatcaatcctacatggagctacaaaacaaaaggcagtatccctttgttgccagagaacatccagtccctgtacaagtctgtgcctcaggggctcaggctcattagcaccatagcagtggctcatgctttccatacacttttctctaccaacacctacagttagtctcagagttgttctttatcatgataggttacagagcagtgttttaaccatattaccttgactgaggtatggtgaggccagatgtggatcaagagaaagaaacagggatggattttatggttttgaggctcacagttccctggggagacacagcaggctgtgctgggccactcagcggaagcacagagtgaggcatgaggcagagggagatgggggatggtagggaagcagctttattgtcgtctccagggaaaggaaaaggaaaggcagggtatgcaggtttaggattggctaatttgaaaatgttcttggggctctggggcatagaggctgtccccggttgtctcatacctggccccagggtgatgaggtaggtccacggtggcctagggtgcaagagccacttaagggaagtggtgggagtttaaactacttggttgactcctcaagaaggggaactgactggcctctagctagggcctcaaaacagggtgaagacagtatagaataaaaaatatattacaactaggacagataccaacatactgggggtttgtacctaccacagttattccttacatttatgtttcattttgtctagtaatagtgaagtgaatggagttctagactgaagtctctgtttaggcagactctgaatttgttttctcattggttcccagagatggactgagatacctcagtcctgtggatacctcaggcaggcttaaaatgtggcacaaattctctttaactattcagttgatactttttcgtgagggcttcaaagaggctgattttctattgctaaaaattgcatacctctctatgttcaaagaaaataccatttactttatatatgaaagagcatttgcttatttggaaaacttttatttgcatttcacattttttatcacttcttactaaatagaagtttctcacattctctagggattgaactaagtgataacttagaaagaaagtattgttcaaatacccattttttggcttttatgttagtaaaatgtttcccctttttctagcttttctttgtgatttcagaaacgtgcaacttctttgaacgcatattaaatgtttttaaatttaaataatgaaccacttgcttttgttacagcccagtggttcttcttgcctgctgcacagacagagccaaggcactgagacagtagtgttgcagcgagaaagatttaattattgctaggcagtcaagtgacagaatgagaggcatttctcaaatccactgccccaagagctcagaggctagggtttttaaggataatatggcatgcagggggctagggaataggtgctgctgattggttaaagatgaaatcattgaggtcttcatgcactgagtcagtttctgggtaggagtcacaggaccagttgagtcagttccctggtgtgagtcatgggtccaggtagagtcagtcagtagccagaatgcaaaagtctgaaaaatatctcaaagaccaatcttaggttttacaatagtgatgttatctataggagcaatttgggggcattaccaatcatgtgacctctggctagatggctcctgagcagtaagaaattatagaaaagcaagctaggggacaatggttggttatcatttagttactcctacattttagcagaattcaggcccctcccataattctaaccttgtcgcttttcattagttttacaagggtggttttcagtccctaaacaaggagggggttagttttgggaaagggctattatcatccttgctttaaaattaaactgtaaactaaattcctcccatagttaggttggcctatatccagaagagttagcttgggaggttagaagcagaatggagtgagctattttgctgactagctttctgtcattgtcataatttttagaaaggtggtctcactcttagtaaacagtagtatgctatgctttactcagttgtataatttcatttgaattcaacaaataactacagacagctgtcaacttagtgatgttgagattggggctaggcctgcagtaatcctctgaaatatgtatgtgcaccccaaaaacatgtcattgagatgggtagacacctgcaagaggagtgcttttaaaacgtttttacatgaagatgctttctacttcagtgagacttttgccagtggtgttagaagttgctgtgaaaaccaagataaggagccactgtgtttttgatttgttctagggatttaatatccctcatagttaatcactcaggcaattactgggttaacaatatgtcctgaagaagagtagtttttgagccatgttctttgaatcactaagattcttcaaaactgctttagagtttcccatgaacatttggatcacattaaagcaggctcattatttccatcttcatgtccatgtaaatgaggttgagttcttcacttggttctcagctttagtgttgttagtatatagaaatgcacctgattttttatgttaattttgtatcctgaagcttcattgcagtcgtttatcaggtctaggagtcttttgcaggaatcttttgggtttctctaagtataagagcatgtcactggggaccccaaaagtgaggaaggtgggagagaagtgagggttaaaaaattctctattgggtacaatgttcactatttatgtgatgtgttcactagaagcccaaaccttaccattatgcaatatacccatgtaacaaacctgtacacatactttctgaatctaatataaaataacaaagaaaaaaataacaaaaagtaggctcgttagtaagacaatagctgaggagccctgaggattggtcaccttctagcagagagaggaagggccaagctgatttacaacagtcctgatcaaagaagggtgacctgtccagggcaagtccacaagcctccccctctgtgtcatgaggccacagagcactggagttccatgaagtcaatggaaaagaagagttctactgcttaaacaagtttaaaaaccactgctctagcattgtttataagaaaagaaactaagaataaaaacaatactgaattcaaacagctaattccttaagacctgggaacattgtgtgttcttatgcagttataatttaatccaaatacattggaaccacaccataattcaattctaggtcaagagcagagttttgtatacagcagattcattttggagcactctctggggatttggttacagaaaaatccagaggatttatctgggctgtcttactcataaaactgcacaatggcctagattttagagatgacattacagtgaggtctcctccaggacatgctatggtatacaccactatacaccacttaatctttagagggctcatttgaatcacattatttatgtagtgtgtccacatgttagatttggccagattctcaaactggggtgtcagttccacgtctagcccattaatttgttgccattgtgaagacagtagacttgaatgccttcagaaggagcatgctgtactgcacaagtgcgaggggcctcattcctaaagtgatcacactgtgttttagggaattgtgcccctttacaatgctgtgactttgggtgacactctctagcttctatagtacccaagtctgggttgcgtctgaatttgaaatctctactatgagactgtattgtttgtttttaaagtcgatggagcacttgacttggagccagaagagaaagcttgggtcttcacgcttcttgattaattatcaagccagttaattttctagagcctctgtttattcatttgtcaaatgggacaaataatgtctgtttcacagggcttgttgtgaagattatactctgttgtgttatagaggtttaaagtggacctgtgggtttgtatgaaatacagcaaggtaacataaattaaaagtagatgagggataaaagcggggaaagggtctaaaatggggttaacaagttgtaccttttgtgcagatctatatgcttgctaggaatgagccacaaatttgcttctgtgccctctagcagccaaggagaaaatggaaaccttattttctttaatcatggtgtctacgagattgggaacacagtagggagtcatgaaaaatattccttttcctagtaacttaacagagagagaccaccctcaggggtctgcaaaagaggacattgcatggtacagcctatagtgtctgctacacagagaggttgcaaactggcagtccaccagtgtcaccatttgttgggatttttgttttgttttgtttaggcttgatgtctaaaaagtttgatccaacatttaaaagaatcagattttgcaaaaataacatttttaagttttctttcaaaatcagatgatcagttaatattgtaactatatatcaaaattaattggcactgtgtagcagcttttttttaatgtagcaatgatttcaggtttgccacagtctccaccattccctactgccttacttactacattttatttcctacttggcatttaggcatctgatttagtgactcctattctacagcatccttgtagtaggctcagcagtacgcttcataaggctgagaatccctgagaggattgattgatatgggaaaatgctggtactctgtacaatattgttctacaataaaaatgtagaattagaatattgaagttactgttagaactttgaaatcatgactgagggtttaaaaatgcttaatgagggccgggcgcggtggctcacgcctgtaatcccagcactttgggaggctgaggcgggtggatcacgaggtcaggagatcgacaccatcctggctaacatggtgaaacctcgtctctactaaaaatacaaaaaaaaaattagccaggcgcggtggcaggcgcctgtagtcccagctactcaggaggctgaggccggagaatggcgtgaacccgggaggcggagcttgcagtgagccgagatcgcgccactgcactccagcctgggtgacagagtgagactccgtctcaaaaaaaaaaaaaaaaaaaaagcttaatgaacgagagtctcaaatagctaattaaaacaacctcaacttccaaactaatctcctagcaagtagtttacccagagtatccattccaattgctctttaatcaaataaaaatttcagaatattttatttaaatatttacatagctatatattttcatcagaaaagagtatcacaggaaagacatgttttaagtatgcttttaactgtataaagtttgattgttaggctctatgatctggtgacaatagtcgttactgttagaggtgaatccttgtaaagttgttatttttgtcaaggtccactttggcttctagacttgttgagtttggtaagatgttttgagcgctgagttgctaattttccagaaatgtaatttgcaatgaagatgttggatggggctttcccaattatcagaaggaattctccaaagttgaaaatgagtgataattatctaatattctaaaacatgctgctagacatggatatagagtgtttaataaaagatgtcaaagttgtgttgtggccaccagccaccatcacagctctagccaacattagagatgactggtgatctaggaggagattgtggagggttatctcagtgaagagcctcataaagagtattggggaattttccctcccattgccgtggagagaagagatgagtgctcttaccctttccccaagccaagagagaagagctctgatctagagataggggttatggcaaccatgggagattggcatctcacttcccacttggatgcctgcggagctctctccaggcccatcagaatggagcacagcgatgattttagggatctgtgagcatatatacagatgcttccaacatacagtatttgatagatgcaaagttgctagagcagcctgtgaaagtgaggcaaagaaaaagatgttcagtggttgacaagctcaacttccaccatttggcagagaaagatgtgtacattttcgtggggccaagcaacatcaggaaaggtagagagtttgagcaattgttgctggttccttgtccagaggtggccttttgggttgaggcaacccagactgtgagaaccctgacatgtatgttgaagtagaagatgtgtgttttgggggaggggctcacaaaaggctggtcaaatggttcttccaccatgctagggaacttggaatagagggtccatgtgggcctctgaagaacctacaaatgcaccctgtgaaggtcccaggatgtgactgcctgccttgcacagctgactttggtagccaagagaattgaaaacagcacgacctgatgtaagaagatgttccgtttcctcaccactgatgtcacttccctgtgttaacctgagaagagctacggcacagagtgatggaggagagaatgaaagcagaggaggagggtaaaaggaaaggctacagtcccttccccactacaggtcatacaaaaggaggagggaaaagctttgagttggatatgagattgaagttttgatacgaaattactatacttttagtaagtgagtgagtcttagtttccataaataaggctattataagtgaaagtgatggaaaaatgatggggtcttcctgagctgtccagctgcagggaatggagatccactggaacaagtcaaagataataataatgagaaaaaaaaagattcttaaatccccaccattcaatgaaccagttaccaaacccacacgatacagagacattgagattccaatatgaatctctccacagaaggaggcaccttctcttgccatcttctgtgtattataaccatttttgggggggtttggtgcttcttgttcaaaattgaagtcttgtagccaaaagtcaaaatcatattcttctaaaattcacttgaaaaatatttccttttacagttgaattaaagcaaattacttggttaattaatgtcaaaggtgactctgttctagagataatttctgagtcatgatacctaatatttaaaaattatgttttgatttttatctttagtcatggtgatttcaaatgaggttattaaatcactgtaattcatgatttatataaaatatgaagacattaacctacaacatcttggattgctttttttttttaattgcattagtcactagtaccttctaacagttccagtttttggaaggcagcctctagtttcctattcagcctcatcatagctgttccttttggagagcggtggagaatacaggattgaaggtgaccctcacagcatgacaaattgtcaatctggctccctcagaaaccttatagggagtgtattagtcagctttggctgtcgtaagcaagtaccacagactgggtggcttaaacagcagaagtttattttctcacagttctggaggctggaaagtccaagatcaaggtggaggcctctcttcctggtttgcagaatcccaccttctcactgtgtcctcacgtggcctcttttctgtgcacttaagggagggagagagacagctgtctggcgtctcttcctcttcttctaaagacaccaatgctacctattagggcccatctcttatgaccatagttaacttccctaaagggcctatctctacatatattcacattggggattaaggtttcaacatataaatttgggggcctggggagaacacagttcagtccataacagagaggaagaaagagattcttaaaaagtgttctcttctgcaagttgacatttctgaaaaatatgtttattctccaaatttaagagacttttagaaccaattacctgtgaaattttcttttccaaatgaccgaaactcaactcaaactagctgaagcaaaagtggatattttttggctcacatagcagatggccaagggtcagatatgtcagccacagctggatccagggtcgatgtcatcaggtctttgtcctccccttgagctctgtgtccccccatgttggcccctcctcaggagggtccttttcctgtggtggcattgattacctggggcagctccaggctgatctggcccttagaatttgcagctttaaatggagagaaactgtctcccaagagtcaactctgactgcccccgcctgggttagggatacatattagcagcctggacccagggcctatctgggtggttatgggctggcattcccaacagctgggagaggaccaaatgaaagattccaggcagatcaaactgtaaggcatgtccacagtcttccccttctaagtttctgagctaaaacaacttatttgtcctttgtgacttgtataattgtataattgatagtccagagaaggtccaaattagttcatctttatatgtgtaagagattctatctaaaggtcatcagaacctttttgaaagtcaactgatgtcatgttggcctttgctggtgtttctctgcagactctccggacgacccagccttgtcaccacctggagatttggctccagcctggctaaccacaggctgttgacatgatggctgtggtctctctgcactcctcctccaacctcccccttctctatcctcttatgcatacctattgttgtggtctaaatgtatgtgtcccccccaaattcatatgttaaagtcctagcccccaaagtactagtattagaaagtaggtcttttgggagctgattaggtcatggaggcagggccctcatgattgggattagtgcccttatcaaagaggcttgagagaggtctctcacccctttcaccatgtgaggacacagaagacaccatccatctgtgaaccaagaagtgagccctcaccagacaccaaatctgccagcatcttgatcttggacttcccagtctccagaactgtgagaaacgaatgtctgttgtttatcagccacccagttggtggtattttgttatagcagcccaaatggactaatacacctaatgtcacccatctcatgtgaatgtaggtgctcatctcttgcctgaaattcttggggtcaagtgtgttctggaactcagtttctaatttcagaaaggccatatcgtatacacactgtttactgacacccttagcagagtctgggacagcacccagaaatccatctcattaacatttctgcagagaaacacgtgaacattcatactacgtaggataaagaaaatcaatagtagccttatatcagttcaggtcaggttttgtcaccaaacacattacgagaaaggtttgttctcagggcttttcgtaatttcagaattgtaaacaagggatcccgaatttatattttcttgtatgcattaagtgctacctttgttggactctcagcagctaggactggtctccataaaatttaaaacttaagaaacattttaacttaaagcactttaagcagcactttccaaagtttaaagtatgtaagtaaatctgtgtgagtagataactataaagaacaaactttcagccaatatcttcactttgagtggttactggggggcaaagaattagaaagccactatgtataaaattaaacatttttatttgttcatttctttaaagtacaacttattttccgggagaggaaagtactctcaccaaagaagatttttacagagagaaatcaggtcaacttgaaacttgtttgcaactctctatttgtaacaacctttgtggggttttcataaaaggattttccaagtcttttgtcttcaagaacataaattagaggacactcttaccaggagtacatgcagtttaagtacccaaaaataagtttgtttaccacttagaatcatggagttcaagagaattttcaagtttgcaatcctgggtctctcccagggacattgagagggcagaatcgattctagttttgctaatgcgcctgccaactggtgtcaccatttcccatcacgatatctcagttatcccatctgtcagctctaagagtctttgatgtatttcaacataccatgctttcaggaacctctcggtaccacgttctggtgcttggcagctgtccaggatgaatttgatgtacctctccctgatgcctgccaggagggagttggaggaggggcttaaaggattttctggtaaatccaaatgatcacatatgagctgttatcaatgtgggagaatggaattaggggatagtcttctcattagaattgtgaaaattcaggatggtggaaatactcagtatgaagattttcaggttggctaagtgtatgtgaaatgtcctaatttgaaaaacactttggatttgattgaattagtggtgttaaattagtggggtgtggtgggcatggtgacacggtgctgggcatccttgcatacatgacggatcagaaaaccagcaatccaggcaactctgtggccaatgcggcattttgggtccaagccccttgaccctgtgtctctctccttgcttcatgggaaatcctgccacctggctcagacacaggcctgggggttaaatggagcatgtgctgccaggtactggtcagtgccctcaagggtggagaagacctcttgggaaccacagacaggctgtagggttgtcgtgtttgtctgtttttaagtgacaggctgcttgatctcatcccattagtagtgacgttgctagaggtagagcttgcaaccacccccttcccattaactctaccatcaccacctgccgctaactactgacggctacccaatggccacaaggcacataatattcacggagagccaaagtggcttgcctgtgtcattacagtagctctccttgttaagagtctcttaaccatttccctccttcccacaccccactcttcacacatacatgtacatccctacctgagctagagccctgcttccatccactttcctggccttccccaagctgcctgtgcaaagcctcccttttctgctccctcagcctccggtttcttcctttttctatacctttccccaacaatttcagcctttattaaccttttccttctctaactatcagtcctatcgcttttttgggggggggggcgggaggcaggtgggaggtgtacagctcctcatacttgctgttctgtttatgtatgctctatagcaaactatccccaaatctaacggcttaacacagtaaactgtttccctatcatcactcatgattttgtggatcgggaattccagccggactcagctgggaaattcttttgctcctcgctgtattgaagggggtcgctggatactttcactgggcagatgggtgaactggaggtgattaagatggcttcacatgcctggcgccttggtgggatggctggaaggcatgttcagctgggtgtgtccactggggcttccacacatggtggtctcaaagtagtcagacctctttcaggtagctggcttccacaagagtgagcatttctagagaaaggaagtgtaagtggccaagcctcctaagcctgggcccaggatcctctctgctgtattcggtggttgcacagttatgccgtcctcccagtttttacctagcccccacctctctgtgtgttacaacaaagtctgccaccactattaatcttccacacgtgcctcctccattctcgaatgttcttgaagattatattgctttctccaaacctaaactgtctcataagtttttggcgcttaagacaagtttcaagaaataagaattgaaaagtgttggaggaaagaaagtttccatctctaaccactttctcagaagggcatcagggtttttgcagcaatgtggggatacctcttctgatctcatagcttagggctctgaactaaactgatggccttttctagatttcttcctaggggtgtcaggttggaagtgctgagggactgctctttctccccagggctcagctgtgtcaaggctaagaccaggagtggttcccacagccaggctgggtgagggcaagtttatcctgcggtgcagcacctcagaccagggtctagccaatggtggcctgcaggctgaccccagtccaccacctgtgagcagccaccaccacctgtgtttatactacccatgagctaagcacgattgtcatattttgtttgtttgtttgtttgtttgtgaggcagagtcttgctctgttgcccaggctggaatgcagtggtgcaatctcagctcactgcaacctctgcctcactagttcaaatgatttctggctaatttttgtatttttagtagagatggggtttcaccatgttggccaggctggtctcaaactcctgacctcaagtgatccgcctgcctcagtctcccaaagtgctatgattataggcatgagccactgcacccagccaatttttatatgtttagatgattgggaaatagattttaaaaagaataatatttcatgatacataaaaattataatgacatgcaaatttcagtgtccataaataaagtttctttggaacacagtcatgctcattcgtgtacatggtagctgtggctgctttcacactgtgagagctgggttgagtagttgtgacagcaattattagatgacctgcaaaaccaaaaatacttgctatcttgctctttacagacaagtaacttttttgctgttcttgccaaagaccaaatgcatttttcaaagctggattccaggctcagagttacagcaaagagaacagaaagtatagctcatgattgggtgctgacaggacaagggagagagacgaaaaccattaggagcattagcaacaaatatattttttgccattccaactccatggagcaaatggcttcctaaaagccagcagagaaactaattacctgaactgggagaagaatgaaagactcattgttagaatattcctcagagctgaatcccttctttcagcctactgtattttagtgattcctaataaaagaaaaaaatgtatttttgtcctcacagccaattaatttctgctccaaagcatagaatatgattatttctgtcattattttagtttccagagtcattgatgagacagggaatgacacatacctattaacacactcgcacactcactcacacactcgtgtgggtacatgcatttccctagaagatgtactggaaggatctgactttactttcaggtgccttcatgtcctcgcaattattctacaaatggtttttaagatatttctattgtatttgttgaaattttcctgacattttgacttgtctagacgattattcttgcatccagcacattgtaggaaacactcatttgaaataccccactgtgcttccgggggagctcatctttctggagcatggcgggtccctcatgaggccctctttcgttaaccgaagaacaagctgcagtctgaatgtgagttgttaaaggtatggtattgggagttttctgttctcctgttttcccattctgtaatgttttctttctttctttccttcatttcatttcatttcatttcacttcatagcaacttttgaatgaaaacctccccacagggtttgacaggcaatgaaacttcctcccttgggaggtgtctcagcctgagggaaatggaacagcaccccacagaggattttcctcacttcctccctctctcctttacaaatcaatgttaaagagcctgcatggatgtggttagcaccatctctgccgcatgtgacttttcagtcattttcacccgaaataggatttcattcaccagttactataagctactcgtgccttctaatggactttgcagcagtgattcatccaccctgtgctgggagagagaaagagactttaggtgagaaagaatggttgggagaggggagacaggtaggcagaacagttgtggtaccatcccgccccataagacaataatgatattcagtgttaggcgctttataccaagaaatattccacctgacacattatcctggttgaatcttatgacacatctgcaaatagacattaccaaatacagagggggacttttaggttcagagaggttaagtgacttgcccagtaacacactgctggcaattcgacctgatctctctctttcttccgccttttccatttcagtcagtggcagtgccatctttccacctgcttctgtcaaatgtgttggtgtgatttgatttcttttctgtttctcttgtatcttttaatccagcaataaatccctgctggctctacttgtaagatatacccagaatctattacctccgcccccccaccacccaccttgctccaagcctccatcatctctctcctggagcactgtgatacccttcttcttggtcatcctgcccctgccctgacttccctaaagttgatgcccaacacacaggcagataaaccagatcagacttgtgactgttttcccattctttgggcaatcccattgcattccagataaaagcggaagtccttagagtactgcagtttgcctcctagcccacgttatctctggccttcctttctcactttctccctccattccagccacgttggcttcctgctgtctcttgaatagtcagggcctttgcccatgctactccctctgcttgaagcactcttatcccaggagactgcatgattgagacccttacctccttcatgtctttactgaaatgtttttacagtgaaacctatcttaaatttttttttttttttttttttttttttgagacagagtctctctctggagtgcagtggcacagtctcggctcactgcaacctctgcctcccgggctcaagggattctcctgcctcagcctcccaaatagctgggactacaggcacccaccaccatgcctgattaacttttgcatttttagtagagttggggtttcaccatgctagccaggctggtcttgaactcctgacctctagtgatctgcccaccttggccttcccaaagtgctgggattacaggtgtgagccactgcacccagcctttgtatagctttaatgcatcaaatatgggcttagttcctcatgtaaacaattctcccaggaaattagaggataaaaagttaaaaatagcatatatgtcctgccctcaggaagtttacgttttgaaggggggatacaacaaaaagctagaatttgtagcagcgtacaacacatgccaataaaacttgcaactcaagccctgtgcacagagaaccatttggcagaaattctagagaggcttcctggaggaggtgctagtagaggagaccttgacaaatggggatggatctagatcaaattcccctatgccacgtgctcctctttgcgttcagaatgctcttgtttgcaagatttcagccatgtacaactcttctggcactcagccatggactaaaacgaggttcatgcccacagtattggtctgcagaaaagcatgagactggatgacagtcagaacaaatggaatcctctagggtagggagaagagaaagaaagaggaaataaaacagcataatcccaggaactgccaataggaaaggatgggagaaaggacaactggcaaagactctgatgtggtgtccagcctttcagatgtcacctgaggacgttgctacaattaacatgcagccagacacacacagtgactacacattttggtgtggttggcggcattagttgagtcttaaacaaaagcaatttcagttgcaaatcttgtgccaggctttcagagaaagagaataaattatgctgctgtgacaagctgttccactgtggcaacaatagtttggacttccagtgctgcctgtcaaccaggactgaaaatacatcttcatttgttgctgggcagctgggaagatgagtcattaaagaattttataatacatcaaaggccatgattttctacctttcacgcagttacaccttttcccaagtcctcattctgccacaaaaaacttttgaatgcaccgaaagttaagtagaattccttttaaaatgttctgttctgtgcacatatctctaggggaagtgcagaagacatggggcattcccttttgtcatgcatttcagctccataaagatttattgaccacctactatatgccaagcattatgttagtcagtggggttaaaaagatgagcaaattgtggtcttgaaacccatgccttttgttcagattattacagtgcaagagaagcagcatcagccatgtgtctgagaggccagaggaaggagagagtgaggaaatattgtacctcattaatattgttcctctcgtttcaccactgtattaatctgttctcatgctgccaataaagacatacccaagactgggtaatttataaaggaaagaggtttaatggactctcagttccacatggctggggaggcctcacaatcatggcagaagttgagagaaaagcaaagggacgtcttacatggtggcaggcaagagagcttgtgcaggggaactcccatttataaaaccatcagctctcatgagacttattcgctaccatgagaacagtatggggaaaaccacccccatgattaacttacctcccactgagtccctccacgacacatgggaattatgggagctacaattcaagatgagatttgggtgggcacacagccaaaccatatcaaccactgtagacatgaccaagttcagacttggtcagtagtcaaatgagcctgtgagagaatggtgccacatctttcctgtaagagcacagcattttaacctgcgatggatttgtgagcagtcattccaactctgtattagttttctacagttgctgtaacaaattaccacaagcttaatggcttaaaaccatgtaaatatattatcccacagttctgaagtcagaaatctgaaatagataggctaaaagcaaggggtgacaggctgcattcctttctggaggctctaggggagaatctgtttccttgccttttccaacttctagaggccgctggcattccttggctctttgccccttcccttcttcaaagccagcagcagtagttgagtcctccttaacacagcatcactttttttttttttttttgccttcttcttccacttttaaggactctgtgatggcactggggccactgggataatcgaggataatcttcctattttaagaacagccaattgacaaccttaattctaagcaatcttaattcccttttgccatgtagctgaacatatccaagttctggggattaggatgtggatgtattggggtggggaaattattcttcctaccaccaaccctcatccatctctaaaggcactgatttttttgataaatcagataagtaccagagatgtgtactctgggctcaggagtgaagagggttagctggcctttgccaacagtgacttcatatcaccatactcaatgcaattgaggtgacttaatcaaggggaaaagatggacagcatgttttatggaaatagcacttgcctggtaatcaggagacttggattttagcttctctccttcaaacagactactgagtgtcagtaggcaagttgttgaactgctctgggcctctgtaaaaaatcaaggttgtggttagatgttctcaaatcctctttcatcctctagccttccatggctctcaatttctacagggaatgtactggaaatggagagaggctagcctgtggaaaatgcagtgccattatttcagcatcaaaatcctgaaataagatacagaatgttgtgtaatatacagctcggtgtctgtgcccttttatttctctcttgggcccagccccatcatcctgtccttgatcattgtaatgcagtgttcactaccagtcttttctccccctacattggaaattatgccaaaagagtaatgaatgaattaggtaaatgaattagatgaattagagataaaattatggctctacagttgaaatatcagctttaagagaatcgacttggagaccaggtgcaatggctcacgcctgtaatcccaacacttagggaggccaaggcgggtggatcacctgatgtcaggaatttgagaccagcctggccaacatggcaaaaccccatctctactaaaaatacaaaaaattagcagggcgtggtggcaggtgcctgtaatcccagctacttgggaagctgaggcgggagaatctcttgaacctgggaagctgaggttgcagtgagtggaggttgcagtgagctgaggccgtgccattgcactccagcctcggctacaagggcaaaactccatctcaaaaaaaaaaagaaagaaagaaaattgacttggagatgtacgggttcacatataattgaaagtgagcattccacagtgacttgagaaagttgattccggctttcaaagcttgcattatgggtaagaaacttgagcctaaaaagaacttatatgtatgtgggtcattagacaatctcctccctcaccacctttttttttctttaatcaaagaattatacatatgcaagtaactgaatcacctcttctttcatttttttccctctttaatcacagctgtgtggaaagtttccagctaggcattaaattgggtcaacagctaacacagcataagtgtggacagcaggggcaatcggtggtatatacataggaaataaacgacactgtgctgctggcattgataagctgttgaatagtgcaagggccctattaagatttaaagtaataaaagatgggaggaaatatggttaccagcagctgataaacattcttgccttatgaaggcattagtttcacttaatggcttctagtgcctggagtataagctcttgtaatttttctcccccagagcagactgaaagaatacctaggaattgtcatctttgtagttgctcaagaaagatctttgggtggctgtgagcagatctgaaaatagtaagtatggcaggtacatggagctgcatccgtttgcaaaagctatcaataaagaaaggtatagaaaggatgcccttgaccccggtatgtgcagatagaagtggaatttcctccggaatgtgcatgcaaatgtgcctagctgcaaaagaagaggcattccctgctcaggtgtgtagagtgatttagaaccatttgtttctgctcaatggttctcaaatgaacagtatttcctcactaggaaacagtgctaattccaggctaggacggtccacagagatggtggctgtgcccagatcattcttggaaatctgaggaagggagtcatttcttctcatgccacacccagtaaggggtacattagatactctatttcctccaggcagatctacagtgaccaggaccacgtactaggataggagaggttctggcactattcatcattggctccggaaatagctttcccctctgagctcaaaggtaggctcatcctctgctagagtctattaggtctggtgggattggaactcaggtgcatacccctgggctctccaaccactagtgctgcatccagggcttggggtcctgctttgtgccatcaggtcatcagtgacatgactagggcagctcaacccgcacctctggcatcactgccttcctcccatggccccctagcatgaacccaaagaccacagggccggttccctccttcaggcccaaggctgggcctccaaataatggcctcccaaagatgcccacattcacatgcccagaacctgtgcatatgttaccttatgtggcaaaagagactttgaaaatgtgagtgaattacaatatggagattggcctgggttatctgggtggactcaaagtaatcaataagagggtgacaggagggtcagagtcagagaagaagttgtaatgatagaggcagggagccatgaaccaaacagtgtagacagcctctagagactagaccaagcaaggaagtggattctctcccagggacttcagaaggacctcacccctgccaactcatccgaggacttctgacctccaaaagtataaaataatacatttgtgctgctttaagtcactgagtttgtgataatttgttataacagcagacagaaactaatacagtttatcttattcctttactcatgatcaactactttggggttaacgaacaacagtatatttacttccttcaatgaaacacttacctccacccaccagagtgaaagtttgtcaccctggttccaacaaatgccacaaaccactgtatgatcatctttgggtaggtcagcttgtctgctatggtatttttcttttatattgcagtttacaaagtgctcatttgtcttgtatgatagttatatatggaaggtagcattactatttcacttttctgattttctaaaaaatatctttaatgaacacatattaattttgtgattaaatgacacaataattagaaatgttaaaaggagatggcagttttagtcacttaataaccataatactaacaaattcaggccacatgctatctcagtggatagtccccagaaccaagttaggctagttcatgaggcatttcagatagctgaagggactaagtatacactggaagattgggtacgaagatcaaaagacagctctacaacaaagcttcatgggccattggtttcacagtagggggaactgaaatccaggctacagattcaaaagcttacaacctggcaatttatgtagcatagggaatcaatgtctatagtcttaattacatagaggctaaagcctcaattattctatttctgtaggcaggattcctacataatctatagcatctattggcataaaacattcttagtggccattctgggtacaagcatcccatttctctttctgtccttccacacactaccagtgtctctcgcttatttcctcccaactctaatgttcatatgtgggttatttgagcttctaagttaattccttgcctatatgtaaggaacatattggaaaattataaccaaagtgtagtatatattgcagagtctctacttcccatgagcagctttggagggtacctcacaggagagggttagctggcatctttccattaggaagccagcatcagcacaaggggaaaacttctctccaacgtctagacctctctatcccatgagactttggggactgggactgggtagcagggcagaattgggggaaggaggcacttaagagctttttaatttcaatattctaaccattagtgagggtgtgctgctgggtacatgtctgcccataaataaacatggactgttcattgaaacttgcatttttatgtagaaaagctcatgctaccttatcactttttgcacaaaagttgacacattatgaatgctttaaaaaaaaaattataccttactcccatacactgaacatatctttcctcatctaaaactatccaagcagccaactttttaaaattaatggaaggagagggtctacagcatgtattctcaatgggggcaatgtagccccctaagggagccaaaattggttctgggttgggagtggtgaaaaaagtctttaaaaaaataaattgcagaatatacatgcagcacatagattgatatatatatctgtgatattaaaatttcatatggaggtagttgggaaaaaatgtctaaaaaacctccttagggtgatatttgatatggttttgctgtgtccccacccaactctcatcttgaattgtagctcccataattcccatgtgtggtgggagggacctggtgggagataattgaatcatgggggtggtttcccccatactgttttcgtggtagtgaataagtctcatgagatctgatggttttataagggatttctgctttcacttctcattttccttcttgcctattgccatgtaagatattccttgctcttccaccatgattgtcaggcctccccagccctgtagaactgtgagtcaatcaaaactcttttttctttaataaattacccagtctcagatatgtctttattagcaacatgagaagagactaatacaatattgaaaaaaaaaaagttgagaaacactgatctatagtaaaatttaaatatccaacttctactatttttttggctgtccattcccagtagaatacaagttccatgaaggcagggatatttgtcttttttgtgcactgatttctcctaagtgcctagaatggtgcctgggatgtaggaggtattcaatccatacatattgaattgaatgcatgaatgaacaacttccctcagtgtcccagagtccactttctctcaacactgcaagtggtggcaagctggaaggtttgtgagcagtgctggagctgggctcttccaggtgcattcacaatagtttaaaatagcaggtgcatcagaggaggcctctttgttcctggtactatgctcattgatgtttactatgagccccttgcagactcaagcatccattgtttgccttttaaatatctctactagccgggtgcggtggctcacgcctgtaatcccagcactttgggaggccgaagcgggcggatcatgaggtcaggagatcgagaccatcctggccaacatggtgaaactccctgtctactaaaaatacaaaaaatgagctgggagtggtggcacgtgcctgtaatcccatctcctcaggaggctgaggcagaagaattgcttgaactagggcatcaaaagttgcagtgagccgagatagcaccattgcattccagcctggtgacagagagcgactccatctaaaaaataaaaaaaaaaaattttaaatttaaaaatctctactctccaggccaggtgcagtgagtggctcctgcctataatcctagcactttgggaggccgaggcagtcagattgcttgagttcaggtgtttgagaccagcctggtcgacatggtgaaaccccgtctctaccaaaaatacaaaaattagctagacttggtggtatgcacctgtagtcccagctatttgggaggctgaggcaggagaatctcttgaacccagaaagtggaagttgcagtgagcaaagatcatgccactgcactccagcctggacgacaacgagactatgtctcaaaataataaaataaaataaaataaaaatcctctactgtctacttcccccacccctaatatcctagctatgtggcccaagtacttatttagcccagtccatgaaagtaaaggacagtggacagtgtcctttgataggaggatggggcagaatgggaaaagaaaatggtagggtctggaggtacaagtgggggccagagagaggggctttacagattattcgggtgtttgaaagtcagttggtgttatctttaacatacaaacatgtattatgaatctctgagcatccttcaacgattcctgaattttcaaaacagttgtgtccaaatgacacaccttgtccagaaacaatttggttttgatagaaaaagaggcaaaataaaaacactgatttacaggctcatggtgaggggtttggggaggcagatgagaagagaacctagaaaggatgtcaagagcagacttagctgacctcactttgctttgggcttgctttcctacagacattgacagtgagagttgtttttgctcaccacactgggaatatgtattgcttaggagacacatggcagttaaggcaaacagcacatgccaacaatatgttgcatgatttgatgcctgttttcagggaacttcactaggaagtgtgtgtgtgggtttatatagccacgtacatacatatacatttatatatgttttatatacttagaaataaatacggaatttgttacaggaacgtggccttacacaatcatgggagctggtctgccatcttcattaagccattgtctggtacagatgctggagtttgaagtctgtaggataggaaatcagatgttgtctcagttggcacctgctgcataatacggtaccatagactaggtggcttaaacaacacacatttattctctcatacttccagaggctggaagtccaaaatcagtgtcttgcagggttcggtttctggtgattccccacttcctggctgtgggcagtgccctcttgttgtgtgctcacgtgacctcttctttgtgcacatgtggagagaacaggctctccagtgtcttcacttataaggacactcatcctatccgattgagaccctaccttatcatcgcttaaccttaattacttctgtaaagggcgctatctccaaggacagttatattgggattggggctttaacataagaattttgcagggacatgaattgcagtccatgacagatgtaaactttgagaaacaggaaaaagctggaacctacaagcagaagtgggaacctgtgaggttggactgaaactcagatcagttcttgctgcctctgaccttgatgtatgtatcctggaggagatgctggcatctctcatcatggagctaattgtaggacaggcccagaaatggaagaagctggaagagagtctagtggaaggtggggcagcgtgggcccagctgctgttgcctgccaaagaggtgagcagcagataagtgacgaggtatgtgagctcacacacccaatccactgtggcacttctgccttccagatcctccataagaaggtctctttggcctactctgctcagaaatatataaggcaggagattctgagaaatctagttgagtccagccacgttgacatgctacaaagccaccacagactctaaggagaaattatgtccagggttgggagaagagagccattagctgtacttggatgaacagttagtggcctagaaactgatctagaaagggatctctgttgatgaaaaaggacagtggtgtaaataaaggaagagtgatttggcgatggggtgttggttcagagttaaagacatgagaatgacaaagaaaggacaagggtggcaattgagatagatgcctttattaagtatagggtatagaagtgtagaatagagaagacaaagaaaagcaaaagaactgaatagctagaatgtattaatgcagggcatcaggcatgtggagccagctaaaaagtgagagatcaaacaagattcttagagcaagagaacatcagtaggaactagccacatttatttcacggactcaatgatactgagtttctactactacagggtactgtgtttgatgcacataaaaattattaacatgtattcctgcttatcattattggaggcaggggttgtgaagtcagcatggtccccaccgccacgcccccaccccaggccaaactctaaaggtatttacctgggttttctttcgaaaaaggaagaggtcttattttttttttttatgggagctgagggcagtggataaatttggaaccagacagttgaagtattaccataagcatcagaaaaagtgaataggtttttaaaataatagggaatagagatagaaagcaatcaacaaggcttgttttagaattaaaactctacaaagtaaaagatgtagcctgaatgacccttgaaatcacatgtataatttatagcacctgattccctccaagtcatggtacagaaaatgtatgtctcagctgtgccatgctggccaatctggtctagcctcaggcttgtcacatatgaagtggtgatgacatatttatatcacagaacaattgtgaaaaacaacggctaatgtagttactcaacaaatgtagtgtgcactaaccttatgctaggcactattcccggcactagggacacagaaatgaagagagaaacaatgtcctcattctcgtggaacttgcaaggtagtcagaagagacattttattatttaatctctcactgtctaatatcatagaaatcatacattcacattcatccagagagatagttattattacctttttcacatgctgaaacagaggttacttgtctgagacctcttgctatcaagtgttaaaggtgagactgagtccaggtcttatatgactccatatgcccagcactcttcaaacggccaaatgcctcgtcccacagaaaatagaagcccacagtcctcatatactataaaacttaaatagaatacattatctcatgtggacagatggttatgactttataaactaggaaatcctatgtaggcagatgtttagttgatgaaaagaagtgtaaacatgaccctaatgaatacatgttctgcaagttattggttgctattaatacagagatagttatgctgtattaacggacaaataaggcatatgtagcaagctaaaaagtgagaagtgaaacaagattctttttttttttttttttttttggagacatagtctcgctctgtcatccaggctggggtgcaatggtgcaatctcagctcactgtagcctccgcctcccaggttccagtgattctcctgcctcagcctcctgagtagctgggattacaggtacctgccaccatgcccagctaatttttgtatttttagtagagctggggtttctccatgttggccaggctggtcttgaactgctgacctcaggtgatccgcctacctcggcctcccaaagtgctgggattacaggaatgagccaccatgcctggcctgaaacaattttcttaaggcaagagaaaccactgggaactagccacatgtatttcatgacttcaaatgatactgagtttctactactagaggaatacatgcaatagaggaaataaaagggggtgatgggatcgagtgatggaggagaagatctctttagactggttggtgagggaaggcctctgtgaggagactattgagatatacctgaggaatgggaaggaggcagatctctgaaaatctggaggaagccctttctaggagaaggaacacacaagcaaaggccctaaggcaagaatgagcttggtgtccttggggaacaaaatgaagatcagagtggctggaggttgctgagcaaatgggacctggttaattcatgcatctggaaaggtagaaaggagctagatcctgcaagtccttgcaggccacagtaaggaatctgaattttgttaatatataagacacaaggtattggaagacacaaagtcatcggaagattttaagcgagagtgacaggccattggtattttttaaaaaatcactgtggctgctataaaactatcacttatggagcaactgtaggctttttgctctttttaaagattattgtgcattggatcattcatggatgccagacttgaaatgaacaagatggggaataatggggaacttctggaatatcagtaaaaataaagaagctgctaggatcctggctacagtgtgaacccttgagttgtggcagccgtgagagatggatgtgatggctgtttggtcctgcgagtcacttttctctatcaaatatacttgaccttcatgtgaccctttccatctctttgtgaccaagtaccaagtgataagcgttaattaatttttgggtcactgtgacagatcatcagtgtgctacacttttcaggtaacaggtttccgtgaaccatttgcaatgcccaaattataagaaatcccttaatatctgactctaacagagttgcagtttccaagtctatagcatcccactaacagaggggttggaagacaagatggagccacaaaggtagcagtggcaacccgtccacccctgcttaatgctactcctggtttaagacatgagcccaatttctctttagctggtaggatgacagaaaaagttttaacagcttttttgaggcataattgatattaaaaaggacacatatttcatgtgtacattttgatgagtttggacatatgcaattacctgtgaaactatcatcacaatccagggaataaacatgcctgtcacctccagaagtttccttgtgcccccttgttgtttttgtttgtttgtgtggtagaacacttaacatgatatccaccttcttaacaaattttttaagcgcacaatacagtattgttaattatagggactgtgttgtacaacagatctgtagaactcattcacctttcataactgaaaccttctacttgttcagtaataactccctatctctccctacccccagcccctggcaaccacgattctactctctgcttctatggttttgactattttacaatcctcatataagtgtgaccatgtagtatttgtccttctgtgactggcttatttcacttagcatagtgtcctccaagcttatctatattgtcacgtatttcagaatttccttttttaaggctgaataatattccactgtgtgtatagactatattttctttattctttcatccatcaatgagacacttaggttgtttctatatcttgactattgtgaagaatgctgcaatgaacttgggcgtgcaaatatctcttcaagatcctgatttcagttattttggctatatacccagaagtgggatcactggatcatatgatagtgctatttttaatgtttttaggaatctctgagatggtttggctgtgtccccacccaaacctcatcttgaattgtagctcccctaattcccacaagtagtgggagggacccagtgggagataattgattcatggggatggtttccccatactgttctcatggtagtgaataaatatcatgagatctgatagttttataagaggttttccctttcccttggctctcactctctcttgtctgccaccatgtaagacatgccttttgccttccaccatgattgtgaggcaccccacccccagccatgtggaactgtgtgtccattaaacttctttttctttataaattacccagtctcaggtgtgtctttatcagcagcatgagaatggactaatacagtaaattggcactgcgagggtagggagctattgtaaagatacctgaaaatgtaaaagcaactttgaaaccaagtaacagggagaggctggaagagtttggagggctcagaagaagacaggaaaatgtgggaaagtttggaacttcctagagacttgttgaatggctttgaccaaaatgctgatagtgatatgaaaaatgaagtccagattgaggtgttctcagatggagatgaggaacttgttaggaactggagtaaaagtgactcttgctatgttttagcaaagagactggtggcattttgtccttgccctagagatttgtggaactttgaacttgagggagatgatttagggtatctggcagaagaaattgctaagcagcaaaccattcaagatgtgagtttggtgctgttaaaagcattcagttttgaaagggaaacagagcataaaagttcagaaaatttgcagcctgatgacgcagtagaaaaacccattttctgaggagaaattcaagccggctgcagagatttgcaaaagtaacaaggaaccaaatgttaatcaccaaggcaatggggaaaatgtctccagggcatgtcagataactttgctcccattacaggcccagaggcctaggaggaaaaaatggcccccccacctgctatgtgcagcttagggacttggtgcccggcatcctagccattttagccatggctaaaaggggccaaggtatagctggggccatggcttcagaaggtgcaagccccaagacttggcagcttccacgtgggcacacagaagttaagaattgagttttgggaacttctgcctagatttcagaggatatatggaaactcctggatgtccaggcagaagctttctgtaggggtggggccctcatggagaaccctttgctagggcagtgcagaaggaaaatgtgggattgaagcccccacacagagtccccacaggggcactgcctagggaagttgtcagaagagggccaccatcttccagaccccagaatggtagatccactaacagcttgtatcgtatgcctggaaaagccacaaacactcaaagccagccctgaaagaagctgggaggtaggctgtaccctgcaaagccacaagggtggggctgcccataggaacccacctcttgcatcggcgtgacctgaatgtgagacacagagtcaaaggagatcattttcaagctttaagatttcactgccctgctggattttggacttggatgggacctttagccccctcattttggccaatttctcccatttgggatgggtatatctatccaacgcctgtacccccattgtatctaggaagtaactaacttgcttttgattttacaggctcataggcagaagggacttaccttgtctcagatgagactttggactgtggacttttgagttaatcctgaaatgagttaagactttgggggactatagtgagggcatggttggctttgaaatgtaaggacatgagatttgggaggggccgggggcagaatgatatggtttggctgtgtccccacccaaatctcatcttgaattgtagctcccgtagttcccacatgttgtgggaaggacctggtgggagataattgaatcatgggggcagttcctccatactgttctcatggtagtgaataagtctcatgggatctaatggttttatatgggttttctctttcacttggttctcattctctcgtctgccaccatgtaagatgtcctttttgccttccaccgtcatcatgtggaactgtgagtccattaaacctctttttccttataaattacccagtcttgtgtatgtctttatcagcagcatgaaaatggactaatccaatctccatactgctttccatagcagctacaacattttacattttacatttccactaacagtgtacaagggttccagtttctttacatccttgccagcacttgtctttttgataatagtcatcctaacaggtgtgaggtgatatctcattgtatttttgatgtgcatttctctcatgattggcaatgttgaccaacttttcatatacttgttggccatttttatgtcattttttgagaaatgcctgttcaagtcatttgcccatttttaaatttgtttattttcttgccattgagttgtagtaggagttccttatatctcttaggtattaaacccttgtcagatatgtggtttgtgaatattttatcccatttcataggctgccttttcactctgttgattgtttcctttgctgcacagagctttttaatttgatgtagtcccacttgcctatttttgcttttgttgcctatgtttttggtgtcacatccaagaaatcattgcagagaccaatatcataaagttttgccccatgttttattctaggaattttatagtttcaggtcttacatttaagtctttaacttactttgagttgatttttatatggtataaagtaagcattcaatttcattcttttgcatataagtattcattttttgcagcataatttatcaagggactaacctttctccattgtatattcttggcacgcttgttgaagatcagttgactgtatatgcatgaatttattgctccactgtctcttctgttccattgatctatatgtctgtctttacgccagtaacatactattttgattactctaggttcgttatatattttgaaatcaggaagtgtgatgcatccatttttgttcttctttctcaagattgctttggctttttggggtcttttgtggttccatgagaattttagtattttttttttctatttctgtaaaaaatgcccttgggattttgatggggaaagcatggagcctgtagatcactttgggtagtatagatattttagcaatattgtcttctagtccacaaacacagggtatctttccattttttatgttttctttaatttatttcattgatgttgcctcagtttcagtgaataatcttaaaccttcttggttaagtttatcctaggtattttattctttttgctgctattggaaataggacccctcccctcccctccccttccctcccttctttcactctgttgcccaggctggagtgcagtggcacaatctcggctcactgcaatctccacctctcaggttcaagcaattcttctgcctcagcctcccaagtagctgggattataggcatgtgccaccacacttgcctaatttttgtgtttttagtagagacggggtttcaccatgttggccaggctggtctcaaactcctgacctcaggtgatccacccaccttggcctcccaaagtgctggcctcccaggtgcaaactaccacacctgaccaggattgttttcttaatttccttttcagatagttcagtcttagtacagggaaatgcaactaatttttgtatgttgattttgtttcctgatatttcactgaatttatttattagttctaacagtttttgtgttgagtctttagggtttactgcatataatatcatgtcatctgcaaacagagatattcttacttctttctttcctgtttggatttctttttcttgcctaattgctcggattaggactttcagtagtatgttgaaagtaagtggtgacagtgggcatcattatcttattcttgatcttagaagaaaagcttttatttttcgttagtataatgttaactgcgggattgtcatatgtgaccttttttatttttatttatttttttgagacagagtctcactctgtcacccaggctggagtgcagtggcgtgatctagacttactgcagcctccgcctccccagttcaagtgattctcctgcctcagcctcccaagtagctgggactataggcatgtgccaccatgcctggctaattttttgtatttttagtagagacggagtttcaccatgttggccaggctggtctcaaactcccgacctcaggtgatctgcccgccttggcctcccaaagtgttgggattacaggcatgagccaccacgcccagccaacttttttatattgaggtaaattccttctatacctagtttgttgagagttttatcttggaaggtcagatgctttctctgcatctattgagatgattgtgtgatttttgtccttcattctgttaatgtatattatatcaattgatttgcatatgtcaaactatcatcagatcccagaaataaatcccacttggtcatggtgtatggtacttttaatgtgctatggaattctgttttctagataggtgagactttttacatctatgttcatcagggatattcgcctatagttttcttttcttgtagtgtctttgttttgactttggtgtcaaggtaatactggccttataaaatgagtttggaagtgctttctctccttcagttatttttttaagactttgggaaggattggtgttttaaaaaaatatttggtagaatttgccagtgaatccataatggaaatattgtatataggtaatttagtaagtcaagaattgtccctcaaaaggtactagaaaactcagttcttacttttaagactcttctaattatcctggtggaatggcttctggaatatcaccataatactgaaatttactccataatactactgaatggaagggatccagtgctggaaactttacatttgaccaggtgcagccctcaatactaggacagtttggctagggggctacccccacaggtagcagggaagaaggctgcattggtttgactgggatggaagaagaataagctaagtagtctgtcagagtttgccaggttaaagaggaaagatgatagcacaggctggagggaggtcaaagtcacattctggggaaactagatgtatgttgaccagtaggggcaagcctagtatggaatggtgggtgacagtgaacattgagggccaatgagatttagagaatgaattgaggagtgaggcttaggggaaagaaggccgggcacattagaaggctcagaggtctaagaagcatgaggaagattgtcctccagagagctgtccccttgaaggaggtgcgttggcatgatcttgtcatgaatttctcaccctgtcagaaacatcttatgtagattttttaaagggcaacagttttcctgctcactctgagtacctgaaccttgattctaagacttaggtaaggttcacttggcctggatgtttataaatgccagtaccaaggggagtccttgaaatggcatagaagatggcaaagggctctgcagagccacgaaacccaaatttagaaatgagaattactaacaatgcatatacaacatgtctacaataaactagaaaggatgatatagtttctgataacagtctttgaactttccctacctatgaaatggtattaacccttaatcagcagctcaggaaatagtccacggtagatcctcatctttgtatttcctttactgtctggttacttactgaaaagtggtagctgaggccgtatctcctaacctgcatgctctccctctctattttctttgtctcccatgttctccctacaaagttagcattcattcattcattcttattttctttctttctctctctctctctctctcactctctctccccctccccgttttcctgtggtattgaaagcttattgtcaggatgagccccttattgcttggaacccaatctgtgtccatgaattgcccatttcacagaatcacgaaagccacgctgcttcctgagcaacacagctaagtggcattccccacccctgctcttagcaaaagttcctcaggacattattgttgaattactcaatgcctattatcatagaacctcatgttcacgctgggaggtagttactactacctttttcaaatgctgaaacacaggttacctgcccgatacctctctgctatcaaatgtcaaaggtgaaattcagcccaggtcttctgactctacatccagcattctttatagagctaaatctctcttcccacagaagatagaagcccacagttctcacatacttacaaaacttaaatagagtacattatctcatgtggacaggtggttatgactttataaactaagaaaatctaggcagatgtttagtcaatgtcaagaagtgtaaacatgaccctaattaatggatttgctgaaagttattggtctctccttgtcagaactgttgttttccctgtcacttctcagattggattagaaaaaattaagcatgaagaaaattggcatttaaaatgtgtttattcttcactatcaagacagatagaactttccattcaaaagagaatgaaaagttcattttggcatggtgaatcataaataagaaaaacagaatagagaaatcctaggacgatcaatctctcataaaataaagaaatcgagattttatcgcaaagaattctgcagcacataaaggcccttaggactggactgatctccgagttcaagcgttacacccagtatgctgcataaaccctattcagtgtttgggctcattctcaagaggttgacatccttcccattttcatatcacctccctggtccacctttgctaggtcacaggtttttcaggcactttgcattctgccctccctcctctcaaaagacttcccggcatgttttcgatagcttcacacctagcagatggcagtttttcttctgaccttctgccagccctcttccttcctcagcttccttcctctccacagcttccatttaaggtattttggaagtccctcgaaatgggtccttggtgagtaaacccctttattgagtctcggactttaagaagttcttggcttcatgggacccccttcttctagttgacacttttggggattgatttcaagaatcatctgttgctgataagtcagtgtggcttctattgctgcagaagcaaggaagaaactaggcatatagtggaagaaaatgcgcttaattagaaactggtcctcattagggattcttaaaggaagtgctcaatttgcacctatgttagcagagcctcacacggattaattaaaagctgctactctcaccagcaacacccttcatggctgggttgaattgtttgtagctgtcaactctgtgccaagggcaacaaggtttgaatctgagttctttgaaatgcaggttctttcactcactatgcagaatctagggatccagactctcaagaggcaaagctctggaagaacaggtggagtgagtatccctctggcttctgctcccgccagatgatcaccatgcctctcaactctacactcttttccctgcctgtgctccagttcacactctccacatccctggggccaggctatacctagatccttctgcttgatctctcaggctccgatgtttcaactcgtcattccctaggctattaacttcaagcccttagatggcattcaagctccttggtgacctctctgcgtccgtctccatccccatctgcttccgtgagcttcataggcaagccactctccatagttatatgtccctcaaatacccagcatccccatgccatcatttcaaccagactgtcctttttcttttcccacctaaggaaattctattagttcttcatggctgggttcaaatccacctccttcactctccaggaagactacattattcttttcctaacactcctgaagtgcttgtcctctacagcattgctgcacatattttgttctgttctttattacactagtccatatggctttactccctgctgaatttaaactcttcaagggcttgatctctgtcttattcatctctgtaacctcacagtacctaatcaagttctttgaacaaagccagtgttgaaaagtgtttgttgaattgagaacagcaagccagactttctgatgggctagaaagatatacctagaaagatagagcagagtagcatttctaaagatggaaaggacaagcctggctaaaatcatgctcaaagaaaggttttcttttagggtcctcatcacatcacaatagcaaatttttaaaaaaagaaagggccgagcacgtcagtatagttaccgagcgtacttgtgtactgggcaaagtactgagcgcaatagaaagttactaaaagaaagaacagatgctttttctcctttagagctggtcccttttcaaaataaggcctcaaagtgcatcccattattaaccctgaaatagtgggacacaaacgtccagatagatatgtgcatgccaatacgtgtttaaaaatctggcgtcacacagcacactccagaggaagccaagcctaagagacatgaacacagtaacacggtagggagccgtgtgatccagactgtcctaagcagaagaggccccgggtggagaattctcacactgacagccgcagagcctgccttccccagtgtactggttttcccagggcatcaaacattttatttaataagctacatgtttgagtcacaagcgtagacttgacacccctgtatggtcaactccagctgtcgtttgttctcctcccctctcttctggcacagtggctggaacctgtatctggtgtatcacaacgctccatttcgctgatcacacacagccagaagtgacagtcgcttctctcactgccaaggacagaggagactctggctggacaggagaaattcaggtcgaaccaaggcaagtgaacgatggaattaaaaacggctgagaaatcccatagacttagaattactcatatctgcagactagagggaaatgagttggtcctgatgacaaaacaaccctttcttttctctagtctgttaaacttctattttcccgtcagactgttttaacaatgccctctactgggtattttcaaaactgcagggttctgcaggcctgacctgctcttgttctccttgagtaattctttctgcaagatgaactgaacccaaagttttcttcacataagcaagatgttactgatgtatagtttcttaagagcataaaaagtggaccagtgcatcccctggaaggagggcctcttgccctcttgagagatttctttgtaaaggtgcatgaggaattgaaatctcaccacctcctgaactggcccagagctgtcctggcatggatgacacagggaccttgacatgggctgatggattaagaacaatgttacattttctgaacgcatcacttttccaacagctcttgatctcacatgtgaggctctttctcatccctgaaggctactgacttttccctggatatatttgtattgtgattattctgcatatctaagaatttcatccctttctaaccgctcctctgccaaaacagaaaccaaaaaaagccaaaacatcactctgtgctagttagtttctttgacccctcttaaagaaactctaaacaaaaaatctgcgtccagttatatccaagggggtgttcttactgggtattcccgtcagaacctcccatctgtctattttggttcattctttgccattatcatgtaacaagttcaagataattgtgtttcatctccagttattattcatagtccctctgcatgttgaagattgctgagacagcacagaaaaatagtaaagcaacagatgaggtctgtttgcaaaaaatgtagaacaattcgaggtgcaggatgttcttcaaattgtgatggggtgaggttttgaaaagttcttcggatgggctagtgtttgttttctctctccctctccctctcttcccccctcccctttccgctttcccacttcctctctcctccttccttcctccccatccatttctcttaaatagaaacaaaattccatatattcttagaatccataggatccatatattcttagaatccataggatccagcattgcattttatttaaaagcaaatgccgaccaagtagtcagtagcaccctttcagctccaatagttggtgctatattctgtactcagcagtagactcatttcattattttggagtatggacctgaagaaaatgaatatcagacatgggctaagccaaggccagttaataaatattttaggctttgcaaaccgtatagtctctgtagcaactattcaactctgctcttatagcaccaaagtagccacaaataatagtaaacaaatgggcatggctctgttctagtaaacttacttgtggaaacgggacaggctgaatttggcccacagaccctcgtttgccaatccctgggctaagctattgcaggggtactgctgatggatatgcgggctgtgtcctgtgtgacagtgcctagccaagggggcaagtgggacctgaaatacaacccatgctctgcttctccacgccttccaccacaagaggtcctttttgtaattcagacagaggtaccatttgttcacaggctgtctccaaccagaataagcacatttcctaatggattagggtacttaacatggtttgcataagtgggaggaagagggacctgattttcctgtattaggataagggttacctttgatcccaatggctgttattgaaatgactaaagccacatggttcaaacatggctgccttagcccacatctacagactgggagtaggtggtgggagcaattccaacagagatgtagactgggaaagtgccccaggtaagaggaaccccaaagaaggtgagtttattggttagggggcttgttggatattattaccaaagccatagtccctttatgaagtttgttctgtccaaaaatgtgatttaggccactgtatgagtccattctcacattgctgtaaagaaatacctaatgctgggtaatttataaagaaacgaggtttaattgggctcatgttgctggaggctgtgcaggaagcatggtggcatctgcttggcttctggggaggccttgggaaaacttagaatggtggctgaaggtgaaaggaggagcagcacttcacatggccagggcaggagggagggagagaggggagctatcacacactgttaaagaaccagatctcgtgagaactctatcatgagaacagcaccaaaggggtggtgctaaaccgttcacgaaggatccaccactatgatccaatcacctcttaccaggccctatctccaacatgggggattacaactaaaatgagatttgggtggggacacatatccaaaccatagcagccaccactctccatcttagaatggtagaataataaaattaggaggaaacttggtatgcttttgcatgcattttaacatcagaaccctttgttcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaccctttgttcaaataaaatcttatctagaactccagtatacgcaactgtgaaaaagggagagtgctctggtgcagctggagaggaaagacaaggagtgccctcagtaaccccctccccagatccggctggcccagagagagctgctgagactcccccaggacccagtttggagccactgatctcatcactgcataggagggagagagagaggggagatatgaaacaacggaggcaaaatgaaataaaataatcttaggtgacaacattttttaccaggttttgttggtataaaacaccctttccttttcagttcccctacctgaaagtctttggttgcttatatatatttaggatgtttttatatagggtaatatagaattgtaaggcttaatataatattaatatttgacattctattggatttaagcagccagtgggaagagagtaaataaaaataactacacaaaggaaactgctattagcgtttgttaccatgtgaatgaaatagcacatcagctgtgcatttaaagatctggatagaagtttgtttcagttatttgtttgttttgaggtacatttacatacagtgaaatacatagcttttaagtacacagtttgatctgtgttgactatacttacgtaacccacagctctaccaaaatcaacaacatttccatcatgcgggaaagttctcttattccccttcccaataaatctttcccacccagaagcaatcacagatgtgatgtctatcaccacacttggttctattctaggactttgtataaatggaatcataccatatgtactcttttgtgtctactttgtttcacttagcataatatttttgagatttatccatgttgcagcatatggccatacctttttcctttttatgcctgagtagtgttccattgtgtgaatgaatatgccagtttatccattctcctgtttatggacacttggaatgtctaaaagctgccatgaaaagccttgttcaaggctttttgtggacatatattctcatttctctaggataaatgcctaggagtagaattgctgagtgataagagtgatgcatatcttttaagaaaaaaactatcagagttttcacaattatccattttacacatccatgcaatatatgagcattctgattgttccacatccttgccaacacttaatattatcagcctttaaaatttcagctattctatttggtgtgtttctcatgtagttttaatttgcatttctctgtaataatgttgattgccttttctaagtgcttattggctattcacctatcttttgtcaaatgtctattcagatgtttgccctttaaaaaattgtgttgtctttttattgttaaattgtaggagttctttgtaagatacaggtctgggaaatattttctcccaatctgtagtttgcttattttattgagattgtcttttgataatgagttttaaattttgcagttaaatttatggatatttttctcttatggttattgcgttctgtgtttgaaggaatcttgccttcctcaaagtcacaaagatttatcttatattttcttctagaatatttatacttttaagttatacatttatgtctatgattcatcttgagttaatttttatatacaatatgtggtaagattcaaagttcttttctttttccacatggctatctagtcattccagctcaatttcttgaaaagatgtttctttttcaattgaattgctttgatatctttgttgaaattgatttggccatatatatgtagggctacttttgggctttcagttttatttcattgttctgtttctattttatttcactaaaaccacactcttgatttgtatgtttatagttaatcatgaaattagatagagtaagtccttcaactttgttcttctatttcaagaatgtttgggctattctaggtcctttgcatttctgtataaattttagaatcagcttatcgatttctacaaaacgtcttcagaaattttaattgagatctattaagtcattagataaacttgaaaagaaccaacatcttaagaatattgagttttctaatccttaaacatggtatatattattattattattattttttttttatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtggtattccccttcatgtgtccaggtgatctcattgttcaattcccacctatgagtgagaatatacggtgtttggttttttgttcttgcgatagtttactgagaatgatgatttccagggacatggatgaaattggaaatcatcattctcggtatatattatttatttagatcttctttaatttctctcaacagtattttgaggttttcagtatatatctcacatacctttcattaaaattattcctaagtactttctgttttgggaagctattttaaatagtattttaacatgttacattgatgaattctttatgtagaaggtttttttttgaagattatagaattttatgtatctaccaggtttgctaatttgttttagtttatttatatctttgattaattatagccttgtaaaatattacttaatattacatactggtcatttcctgttctgtcttgcagatgattttatagctgacatcggtcaagaactacattatggtgggataaaattttaatttactagagtattatagtgagggaagttttttctttcttatggagagtttttattatgaatgctttttaaaatgctttttctgcatctatttagatggccatttggtttttctccttttaatctattaatatgttgaattatattgactaattttaggatgttaaacagcctttcattccagggttaaacttcacttggccgtgatatattattattattatgtatgtgtggatacatttgagtttttaatgttttgctaatgatttttgtgtttgtgttaatgagagatattgtcattaatgttcttttttttttttttttttttttttccccccctctgagacagagtctcgctctgtcgcccaggctggagtgcaatggtgccatctcagctcactgcaagctccgcctcccgggttcaccccattctcctgcctcagcctcccgagtagctgggactacaggcacccaccatgacatccggctaatttttttgtatttttagtagagacggggtttcaccgtgttagccaggatggtctccatctcctgacctcgtggtccacccgcctcggcctcccagagtgctgggattacaggcgtgagccactgtgcctggccctaatgtttttataacttgcttgtttcagtgtctgggcaacactggccttttaaataattggaaatgttctctcctctgtttctcagagaatttgtggaggattttactattttctttctcaaacatttagtagaatttgccagggaacctctccaggttgggagagttctttgtgggaagtttgtatttatgagtgaaatttctttaattgacacagggctattcaatttttctatttcttcttgggtaattttgttcttttcagtctttgaaggaatttgttcatttcctgtaagttgttaaatttattggcataaatttgttcatacaatttccatattaccttttattgtgtctttgtaggtttttatggtagcatctttatagagatataactcacatataacacagtttaccatttgatgtatacaatccagtgtttttaaagagatttagctatacagctaattttagaacatttttatcaccctaacaagaaatcgtggtgccataccagtccttcccaccctatttacccagccttaggctaccactcctctcttttcagtctttgtagatttgcctattccagactttttatataaatgagataatataataagtggtcttttgagactggcttctgtcacttagaataatgtttttaaggtttactatgctgctgttaacattcatgtacaaatgtttgtgtgaacacacatttttatttctcttgggaatatacctaggggaagaatttctggatcataacgtaactctatatttaagcttctgaggaactgatggactgttttccaaaataactgcaccattttagactttcaccagcagtgcaggaggatttcaatttctctgcatccttgctaacacttggtgtcatctatcttttttattacagccatcctagtgggtgtgaagtagaaactcattttgctttggatttgcatttccctgatggctaatgatgttgagcatcttcccatgtgcttgatggccatgtgtatgtatctttcttggggaaatatccattcagccttgttatcctttaatgactgtagaatctatagcaatatcccttctcactttcctgatatcagtaatcttcatttctctcgtttttttcttaatgagtctaaataggagtttataaattttattagctctttaaagtgccgacttttggttttatcatttttctcttttgtttgttaattttatatttcatttctcctttttactacttcattcttttacttaccctgagtttaatttgctcctcagattatttagatcaaggatctaaatttctaccttaagaaactagctttttctagcatatgatctatcctagtcaacataccatgtgaacttgaaaagatcgatgtattgatagtagcttttactttttctctatcttttttttttctgatactattgattgcttagaagaactgctttaacatagatttccaaactctatacccataaaactggaataggttacactatacccaatttatagataaaaaaatgaaacttgaggctcagaaaggtgaaatagattgctggtctgaaacttacctagagatgaaagttaggtagactccactgcttaggttggaagaatatgcagacaggaaaccagtgggaaggggacagtacaatgtacctgcagacctgattattccagtatagcaaaagcattctgtctcagcctgtcacactttgataagatatatttgggggaatatcatgagtttttggcttatttgttaaacacctggatttttatggtctaactttagttgttgactaagcaaagtatttgttgactaatgtgactgagttgtgaaacgtctcgaaatggcatttcaattgtcagtgaagggggtggcatagacatatgattccttcatatccactcaactgagtctggcgtctccttgaatgcaggcatgcggaatgtccatgtgcctggcatcttggcggtggtcagtaaatgtttgtcaaaaggagctgaagtgtataccgtttctttgacttcttctgtgagtcaagcaccaggttcatctgagtgaaaaaatgcaatgtggatgagactgtgatgtgtcctgtacactgaaagagatcttgatcgttactaaatgggtattaaatgaggcagtgtggccatgacagaaatatgcaagaataaaagaagtgttgtagttcgcagaactttagagggggaaaatatgatttatttattacttgtggaatctcttgatttgatacactggtggaacatagcattatagtcaaagcagcagtgatagcttggcttgtgtgaaaacaaggtaggatttgtaataccatctgatattcttctccgagtttcagattcagaaagaacagtatcaacatgtaccgagcaggggaaacaatataggaaagatataaaagaaaatatgcaatccttgaccaatgtaaataaatgggaacttttgatttatttgtcatgtactcagattgatgggtttcgtagtgaagtaaatgtgtgtgcatccctggttcaggagagagtgttttgtgtatcattctagactactccagactgacatttcaaagcaacgtatcatcagtgaagtatgtatttatcgttagctcttgaaggatttttttttttagttgatagagtcatgtcttagtttctcaatgtggagaagctaaaactgtgatcctgtttctcattttctctctcaccacataggaaactatcctggtcagaagctaccccttggttgtatcagtttgctagggctgtcacaacgaagtaccacaaactgagtcacctaaacagaaatttgcaatctcagttctggaggccaaaagttcaagactgggatattggcagtgttggctcctaccaagagctgccaagaagaatctgtgccacacctcttccttagcatatgttgttggctgacaagctttggcattccttggcttgtagaagcatctctcccacctctgccctcatcttcacgtggtgttctacctgttgtatgtctccaagtccactcacactggattagggacccacactactccaggacaaccttaattaattacatttgcagaagccctacttcaaataaggtcacattttgaagcactgggggtggggacttcaatatatgaattttgggggacatgataacatgctgcttataggtggaaaataatttctacatatttattaataaggaacctctaagatgaacagatttggaaatctagtttatcttcagtttgttctaagcatctgtgtgacctggaataaattacttcattatcccaacctcagcttcttcatctgcaaggtggaagaggtgatacttgctctcctatgttatagagtcgtagtcaattataacaatagctgctgccatttattgagtggtaataagagccggcactatcacaagagtggacaccttttacaggctaggaaacagtggcacaaagaagtaaagtaatttgcccatagccaattaagtggcggagccaagattcgaacccaagaagaatggctacagtgccaactctttcaaccagggaaccaggagagcatcactatataaattctgtgtaaagtgcaagacacaatgcaaaagttcgttgtcactaaaaggagaactcagggcaaagtcttgtccttcccacttctaattctttttttcctactccagtgtttatcaaacttttcccccttttagaatacttattggaaacccatacaaaactcatatctcctctgatgtttttgaaatttcagaacctgcatcattattgaagtaaatccaagcaatcagaatttgaaaatctagctttccaaacggcctcagaggcccccaacacacacatacacatacacacacacacacacacacacacggacacataacacacagtgtgttaactcagtccttcctgccttcagtttctgtggtacagccatgatatggcttggctgtccccagccagatctcatcttgaattgtagctcccataattcccacatgtggtgggagggacccagtgggaggtaattgaatcatgggggtggatttttcccatgctgttctcgtgatagtgaataagtctcacaagatccgatggttttagaaagggctgttcccctgtacgtgctctcttccctgccgccatgtaagacatgcctttgctcctcctttgccttctgccatgattgtgagggctccccagctatgtggaacagtgagtccattaaacctctttttatgtctttattagcagcatgagaacagactaatacaagccataaaaggccaagatcatcattcctttacctacattctttttttgttatttgcccttgcttttcatcatgcaccacatcatttatgtaactaaaaataccaacttccaggccaggtgtggtggctcacgcttgtaatcccagcactttgggaggcggatgcgggtgggtcacctgaggtcaggagttcaagaccagcctggccaacatggtgaaaccccatctctactaaaaatacagaaattagccaggagtgatggcatgtgcctataatcccagctactcaggaggctgaggcaggagaattgcttgaacccaggaggtggaggttgcagtgagctgagattgtgccattgcactccagcctgggcaagagtgagactctgtctcaaagcaaaacaaaaacaaacaaacaaatgaaaaaccagcttcccttagattcccccatgagtttctgactccactacctaattcaataaaggcatttttaagaaatataaatcatatttattcatggttatatgtacatgatacaaaacatttcacagcagaaatggactcttttttaccccatcctcaatcaactaatttccttccctataaaaatctattatttgttttgtgttgtgtgtttcagccagagatactctatgcatgatgcaaacatattagcatccatatgctactttcatctaaaaagtagcatactctccacagtattctaaacctcttctttcacctattaagatatcatttctctattgtaagacttaaaatttaatgtagtgcctttgagcccaaaagtcttgagtttccctacttctaccagatattccccccaaccttcccaaagagaaaggctccctacttaaatggttcctctatcatctgggcctgctgggccgtacccattcctcaacctaacaggtttcacctcccggccagcccatgacattagtcacatcctcctgtaggaacctgaggacacctctcccccttgttactacatagccggcctcccacagcccttgtggtttgctctgctgtggactgtagcccctgtatggtgaacagtgtcctcctcccccaggctgcaagtgtatgtgactagtaaaccacgatctgtctcttttaagtggtgtggggtgttgtttgtctgaccttctcatattatttagggcagaggatccacctttaccaactgggtgaataggaggtgattagaactagtccatattaccacatagagcaatcctttgcttttcctaataagtgcacagaactctatagtatgaataggaaccaatttacttatcttgttccctgttggtagacactgggtttttactctttggttccacagcaatgctctagtgaattttctattccacattttgcatctgaagtcatcttgcatctgaaggagtaaattattacaagtaaagtatgggtcaaatgctatgcacattaaattttaataaacattggccaggcgcagtggctcacacctgtaattccagcactttgggaggccaaggcgggagtggatcacctgaggtcaggagttcgagaccagcctgaccaatatggtaaaaccccatctctattaaaaatacaaaaattagctgggcgtggtggcatgtgtctgtggtcccaggctactcgggaggttgagacaggagaactgcttgaacccaggaggtagaggttgccatgagttgagatcgtgaaactgcactccaggctgggcacagagcgagattctgtctcaaaaaaataaaataaaaaaattaataaacattgccaattgcttttcatagaatgtgtaccaatttagacccccacaggcagctggacagtctatttccccacatcctcatcaacccaggacattaccaaactttctgatcttggccaaggggagaggtgaaaaatgtcaagtccttgtggttttagtttacagttttacaagaagtgagggcaagtgtcttttcatatgcttacaagtcatttgtatttctggcctttctcttattgactcgaggaagcttttcctttattgaataaattaccactttttctatgatatgaagttgaaatatcacttatcatttgtctttgtttatagtaggttttgctgcctagatttgtattttatgttatcacatttaccttcttttgtggattctagtgttggggttacatatagatgcatcttctccagtctgtgtaggagaatctcattttattgtgcgttctttgttgtgattcacagatatcacatttttttacaaattgaaggtttatggcaactctccattgagcaagtctatcagtgccattttcccaaaagcatgtgtttactccatatctgtgtgtcatattttggtaattctcaaaatatttcaaactttgtcattatcattttttcttttatggtgatctgtgatcagtgttgtttatgttgctattataattgctttggggcaccatgaaccacacctgtataagatggagaacttaataaatgttgtatgtgtactgactgttccaccaactggccattgcacatctctctccctctcttcaggcttctttattccctgagacacagcaatattgaaattagaccaattcataaccctacaatggcttctaagtgttcaagtgaaaggaagagtcatacatctctcactttaagttaaaagctagaaatgactaagcttggtgaggaaagcatgtcaaaagctgagacaggccaaaagctagacctcttgggcaaaataattagccaagttgtgaatgcaaaggaaaagttattgaagaaaattgaaagtgctactccagtgaaaacaggaatgataagaaagcaaaacagccttatcgctgatatggagaaaattttaaaaggtcaatgcctggcttcaaaagacaggctgactctcttgttaggggatagtgcagctggtgaagccaatgctcatttaccattccaaaaatcatacagcctctaagaatgacgctaaatctactctgcctgtgccctaaaaatggaacaacgaagcccagatctgtttacagaaggatttattgaatattttaagaccactgttgagacctactgctcaaaaacaaagattcctctcaaaatattgatgctcactgacaatgcacctcatcacacaagagccttatgaagatgtacaagaatgtgtaatacaaggcatgttgttttcatgcctgctaacacaatatccattctatagccctggagcaaagagtaattttgatttccaagtcttattatttaagaaatatactttgtgaggctatagctcccatagataaggattcctcttggatctgagcaaagtaaattgaaacactcctggaaaggattaacagttccagatgccattaagaacagttttgatttctgggaggaggccaaaatttcaacattaactgtagtttagaagcaattgattccaaccttcatggatgactttggaggggttcaagacttcagtggaggaagtcactgcaaatgaggtggaaatagcaaaagaactagaattagaagcagagcctgaagatgtgactgaactgctgtgatctcatgataaaatttaaacaaatgaaaagttgttccttatggatgagtaaagaaagtggtttcttgagatggaatatgctcctggtgaaaatgctatgaacattgttgaaatgacaacaaagtatttagaatattacataaagttagttgataaggcagcagcagggtttgagagattgattccaattttgaaagaatttttgtgtgcatgtggaggtaaaatgctaccaaacagcattgcatgctacagagacttatttcatgaaaggaagaatcagttaatgtagcaaacatcattgtggtcttattttaagaaattgtcacagccaccccaaccttcagcaaccattatcctcatcagtcagcagccatcaacatcaaggcaaaacctcccaccagcaaaaagattacaacttgctgaaggctcagatgatccttagcatttttagccataaagtattttaaaataaggtatatacattgttttttagacataatgctattgcacactcaatcaactacagtataaacataattttatatgtgctgggaaaccaaaaaattcatgtgacttgctttattttgatatttgctttattgtggtggtctgaaactgaatgcacagtatttctgaggtatgcctatagttgcattaaaaaaaattctcctgatgttattgtcaagattttaatggcttcacttttacatttaaatatttgattcatctggaatctatgctgatataaggtatgagataaagatctataatttgtttttacagttgattatttgacaataattcttttttccattaacatacaatgtcatatttatcaaatactgagagactgtttctgatctgtgttctgttccatggatctgtctcttcatgcacaaaaatgagaatgttttaattattatatatttaaaatgttttaatattgattattatgtatatttgtcttttccttattcttgtttattttgttttccaaatgaactttaaaatcatcttgcctatgactccatgaaaaaattatattgctgtttttggattcttgaaaattcatatactaaagtaagaagaattgaatctttaaaatgacaaattttccaatcaaagactgtgacatgcatgttatttctttaaaggtcttcatgccctgatagtgttttagagtttagtttatatagctcttccacatgtctcattacatttattcctaggtatttaaatagtagtctttccttcctttgagactttctgactagtggtaatttacaaatattaaggctgctgatttctagatatgagcttcccccagccatctaattaaatgttttattattctaattttccaggtgtacagtgatatcatctttaaatatgatgattttacttcccttgcttcaatttttgtagtccttacgtctttctcttgtttattttgggttggccttcagaacgatgctgagtaaaggataaaggatgtcttcatcttattcttgattttaacaaaaatgcttctgtagttcccctaccgcaaatattgagtatccatgatgttctaggcaccaggatgtagcaaatacaactgtccttcaggactcaactcaaatccaccttcttccaaagccccctgtgatcatctcaaacagaaattgtctttgcctcctccaaacttcatattttccttccctttactgtcctactttttatcttgctttagaattatcagtatacttgtcttaaatagtccactaaaaatcggtatgctcagagaaggcaggatctttgacaaatcatctagtcatcctcagaactctgccttgcccacagcaaatgctcaacacagtcctgcttaattaattataaattagttagtatgaaaatttgttcaaatatatttgagcaaatactaagtaagcatctgctcagataaaaatgcaggattctcatacagagcacttggccatgagtaataaatgtaagtccggctctcaaaatatacatgtattcctatttggcactagccaaaagggggtgcaatatttacctttaaattattatagagagaatgagctagaaaggaaaaagccagttggagccagaaagcttggagtctttgaacctccctcagttctctaaatctagatgaaatgatatgaatcatcaagtcatttcatgccttttacacttcactttaggatctttttctctaaaaagcctctctcaacagggataatagggtgagtggccttagtatcagtgtttggtttctttgcgatgtgtaattggttttagctagtgtggaatgtcctcttgattttaaattcctatttttagctcctctgtatattgtgttatgtgttcactgttgctccccacacccctccttgcaagtctatacagaagcatttcatgtggaaccggagctgttctagggaagcctgtcatcaaggctgccctttgctctgcacctccccagcaccctcagaggtcagagcgaggctggtgtacagggcagtggatgtgagagcttgaatttcttgccaccttgttacaagccaaagtaggaagaaagtgtatccagaccaggaaacatgatttgtaatcgtggttgcaaatctagcaccctaaacctagcacaccatttggcacatactcggctcttaaatgtccatttaatgcatgaatgactaagcagataagtgagtgagtggatacatatgtgtcttattgggagacggctcatgaactgacattcaccatgggcttttctaagtttttcagtgggatcaatgttggtagtttgtatatttgcacttggtttagaaaactttcctttacctaatcctcaggcgatactgtgaactttgggttgcttacttgataaatatagttttattattaattcatgcatttgaaataacacatgcattgaaagcagcagcaaatccttttaagctctgtgctcttttaaataggttctttctctcatgctcaggaaaaaattcagtggagatgatggcaacagactggtccctcaaatctctggccatagcccaaggaggagagaacccacaattgcaggccatatgtattgccctgtatgatcagtattaaactcaaagtatgtctttgtaactagagacatattctgggtagtgtggctgttagtttgtcccaatctttattttaaggcactatccacatctctttctcttttcctttgcccctaacattgatatcaactgagttttcagggtgccagctgcccatgtcagctctttgagagagcagcctctctcctccttctgcctctcaatcctttcctctccgccagctcttctcggcatgttggtcattcattattgatgaccctccagcaccttctccaccccggtgttcccatagccctgtgcactgctgagcagagccaggtgcaggatctagtcggggtccaggactgctgctccaaggccgccaagactctttcccttcctggctgtcagagaggatgcctggcactagagatacagcagcagcggcgtcagccgctggtcttgaggagggtttgtttctctcctctgtcttctaggaagcaaaaggttaaactgttcattttaagagcctccctgggtataaaatactgagctttgtctttctggagtgagccgattcctaggccccttgacctttgctccaacatgtctgctgcccatcccttagagtgtttttctttgctttctatttagtcagaaggaatgaggctagtgtctgccgttagcttaattattggggaaaagcgttggaagaaaagaaactgattctctccatttttctaattgttacttaaccaagtcttgacaagatacaatttggtggctaatatgcatggagtgccctttctgaaagcagaggctctgcttgtggattctgcagtgaaggctggagtcacaccttggaaatgactgtccaccttcacatttgcacacatcacttacacacatggagctccttccaccaccagcctcccctgagccttcataagacacaggctgctgctttaaggaacattaacaatccagacccttccagggacccatgtgactccagcttctcccacaatagtcagaaatcgtaattgagagttcagaattcataggtaccaggataatattgcagaaagataatcaggcacctacttcccagttccctgaaattaaaacaggtattcatcttgtcagaataagaaaacagggtcctgctgtgttccagccacctggcaaccttgttcttagaatacagaaagggagggaagcaatgtgtgcgatcactctagccgaagaatgtagagagaagcgaagaccatttttttagtcctaatttcctacaagggacaatgcacctaaagtttttcaagccttgctcagaatcatctcacaaaaggaaaggccctttgcttcacaaaatattttaatgaaagcaaaacagtgactaagagcctcatgtactgctggttctgcctgtttcaaatcttgaaaggcctttaataacctccattatgtgactatgtgatttttatcacacaatctcagattcttacattttttaaataactcaccagcaagaaccaatgtcagaactaaatgctaataagatttggcctgggagagtaacatagtaagattgttaatgtttaatgcactctcatcaaagtgggataatcctacggctgaaggttaagtgagccttttgtaaaaaaaaaaaataatagggaagaaaacattattgtagcttttccattttactcagtcaaatgaattcaacataaacttgttatagccaagcccaggctagacatttcctggtgatctggtaatttcccttgtattgttcatgtggtttgtctctttcctcttcctctttgtttctaatgatgatgatgaacagcatctctgcaataggccacattctcaaagtgctccattcattgtcacttgaaaagaccactgttgggttttattgccatcattgatatacaaggataatttacatacaaaattgtggtttggttttagagccatggcaaccagagtatcacttctgatgggaaaaggaagaatggccttcagtgatggagtaggcaattgcaaagagttctgctcccagttctcttgctaaatcaaaagattgcaagggtcaagatcgatttcttcattttctttaggcagcaatctgaagaggccccagcagaaaactccagccttaggatttctggtaatcagaaaaagaagcaactgttcttgggtaacatgtggtgcccataaaagggcatcagctcttgggggcagcctgaggttaccaggttcacctttgctcattctgcgcaaggatcgctcccctcagagtttctgcaggggaatgtgtactctggtgttcggtattaaagcttctacatgaatttatagagttgcttacattggctgagaaattgttttttttttttttttttggtactcagccctaattttccctggcaaatattgctctgtaactttgagatgaatgtacccatcaaaaactccagaagaaattctcatgcagttctattattgctcatcattttgccaaggaacgttagtaaagagagctatgaagtggctaaagaagttgtgttttttgtttgtgtgtttgtttttccttttcatcgttttatgtcttagtaggagaagaatccaagatgaaaaggacaggctctggttttagctttgccactaatttcgtgtgtttccttatgcaagtgtccagatcttcttgggaattaatttctttatttgtcaaagggagctaataatacctgccctggccaacctgtaacatagttatgcgtaggagtaaaatcacagatgtgaaagtttgcaaaattctaagatccttaggtagctcatgcgtcgacaggagtaatgaattatacacctaccgcaaaaggtgattgtggggatccagtgtcaaagggcttagaagagagtgtgacacataagtagcatttggggatggtagctggaagaccaagcagcaagggtgttaccatcaaatcccttccataacccctctcccatacaaagcaaaggggtctaaatagccccagtgctcacttcaatgctactcatattctttggctttggagactttgcttttttggagcccctcattcctactttccagacatttgcagaattcagctgtgctttctaagagattctctggcattaacacagaatgaccttgcagtgggaatgaccttggagctgcagcgacttgagtttaaattctagctctgccccttactagctgggtgggattgattccaggtaactgtcagtaccttgtgtctcaacatcttcagttggggatagcgtcctaccatctccctcatagaggagttaacgagttgaaatgacacagatgctacagtcaggagatgctacgtaattttctgggcccagtgcaaaatgaaaattcagggccccttgttcaagcatattaagcacttcaagatggcaacagcagagcatgaaaccaaggtctaggtcttctgagctcagggtcttgtgcaactgcataggtcacatgcccttgaagcccaccctggccactgatcccatagtggcagcttgccacttagtgggcactcagtagagaccgcttgcttttctttcttcctctttctctcttcttctcttgatagccttaaatccctgggagggggggcttgcatttactcttacacttcctgccacagtttctccccttatgatcgttccttctgctggttaaattgccgcttctcttttgcccctgaaatcagggagccaagtgattaagagaagctagcttatctacacgagcctcccatctctatgtctgtatttcccaagttctttcaaagataacccaataaaataaagaactaacagcatcatgatacatacaaaggggctatggtgtatgtgtggcaggctggggagtaaggatggagaaggtattttgaggcaaagaagaaagaacaaaggaaaatgaaggtattagaagataaaagcttgcacttcacagaagatattattttgctgccatgtatctaagcacaattgaggcagattagttgtaaaatcacctcatttacttttcccagcttttttcagccactttcactaaatcaaccaaccaaaccttttctgtgcccttatgtcccttgtctctgaacttcatcaactaaatatttgttatgcattattttattcagcattcacagtatctgtgggtttgggtatgctacttctttcttcattttatagagaaggagatgatagagtaaccgtccatagttactgtgttcattggaaatgttttgtctccaagtagcagaaagcccaacttacagtgtctgtgttcggggttggaagttggggagaggttcctcctaatgagatgcttggaggcagaccaccgcctcaggggttagacagctcactgacatcctggctcctgtctgctgctctcttggcttttccctcataatcacaagatggctgctgtgggtccaggcatcacaacatggtcaggagaagaagaaatgagggaagaaacagtatccagcctattgttgtcttttcttgggaaagttacactttctcaggcatccactggcttacagacttctacttatgtctcattggccagaactgtgggagtttctagctatagaaatggcggagaaggtgagtgtttagcttttcccgcctttttcctggttgggggagacagctctagagtgaagcacacaacagtatatactttatagtgacaaagatagcaaggggcaaagacagaacctgaacccaggtcctctaatcttgagtttagagattttgccattctgccacattgctcttcttttaaaaatactttcagcaacatccagcttgtccacttcctgctgagacaagccaacaggtataactccaagttatggaaatttaaaacaggaaatatgtttatactatgccttcccttaaggttcctgagagagaactttctacaagttatgtaaaacagagataatgtggcttatagaaaatttattcctcacatgataaattctgtgcatgtgaagtttcgtagaactcactgtagcgcatttagaaacacacgaccagaaattgtgtgaaacattgctttgggatggatggtgcccgtctgaccttaagctatccttcccccactctgctgctcttcaaaccacagccagtttattttttggtagaaactatttacgtatgaagatcgtatttggatgcctttagtaatttattaaactcactttcctaaagcaagatcagagtttaaaacatatgtaaatatcagctgagagattagaaacaaaagccaagaaggaatttctccactgcaattaccacatgcagttaccatggcagggaagctgtgcgggataattcagtccaaggtagagaaataacagagtctggaaatgtaaatatgtttctgttagagatacttgaaataacgtttacactggcttcttcctttttagctatgggatattgtgcaaaacttttttgttgtgttttctttaaatgctccgggcagtaaattggaagtatatagcacctgctacatgtttagtcagtagtcgaaacattgaataaatcatgaaatctgtaggtgaactgaataatagctgccctggagagaactgtaattcactgttgacaaaataaatccccctgcatttttctggggaatcttttatttttagcaagagtgtttgatactcctaagttaattagtagttttaacagagtggaatgttattgaacctaccagtgttgtttaagagctaatgtttatgtgccaggcgccagattaggtaattttataagcatagatcattacattctcgcccagccctgtagggttcctagctctgcttttccagatgaagagccaagacccttagaggttgtaactagtccagagccacatgggctaggaagaaaggaagacctttcaccacttatttacacaagtaagttcttcccaggcagtgtggcagactcagcagattggcccacttaactcttgttccacccccactctatcttgtctacttctaccacagaggccagaaaccacaaatccccagcctcctgtggcttggcttggggtagcccaaatacacagttctgtccaaccatgcataggcagaattccctggggaacatttctctctccccaagtaggtaaagcttctttgccctttaccgtttgttgttccttttcttccttcatggaaagaagagtcactttcaagacatgcagcaaccaccctctaacaatcagaaggaaatacatggttaagattgttgaaacaagaagtaaaagaagtcaagttgcttgacgatattctcttttgtctttttattttttttattttttaaattatactttaagttctagggtacatgtgcacaatgtgcaggtttgttacatatgtatacatgtgccatgttggtttgctgcacccattaattcatcatttacattaggtatttctcctaatgctatccctcccccatgcacccaccccacaacaggccccagtgtgtgatgttccccaccctgtgtccaagtgttctcatcattcgtgtcccacctatgagtgagaacatgcggtgtttggttttctgtccttgtgatagtttgctgagaatgatggtttccagcttcatccatgtccctacaaacggcatgaactcatccttttttatggctgcatagtattccatggtgtatatgtgccacattttcttaatccagtctatcattgatggacatttgggttggttccatgagcttgatgatattctcaaatagattccctagccctaggctgcctgccattgcattccttattacacaagaataatcatctcttattgtattccaatcattgattggcattattttttttctgcatagcaaaatacatggccaaatcagtaaacctgaacttctcaaagtggccatctggtagctactagcttataaactgttccctaggtatagagaattgaaagcaggtgaagtgtgtgtgtgtgtgtgtgtgtgtgtgtgtgtgtgtgtgtatttcacatatcactcaggtcaatgttcctttgaaaatggagaatgcaactctattaagataatagtgtaaatttggtaactgatcacttacagcaattacaacaaaagatgcaaaagtcaggcagaactgggttctaatgctggctgtagcactggttggttatgtgaccttgagctcattagttagccttgcacacatttcctcatatatgattgaggataagagtagttttatctcatagagatttgaggggcatttggcacaggatcaggcacaaagtaagcactcagtggtattgctgccaataataataacaataataataataatagaattatttaagacttgcagattgagggaatttgatgaaatatataacaactgaggttaaagtgttctaattttctgtctagattcatcttttatggtccctttttaatctcacaccagtgtccttccagaattaaaaggtcaatgattttacttcctagagaagcttccttaggggcttatgaatggtgaaaatgtgcacgtttgcctcgactctctatttccattgtcgaaggccttcgcaaatttacctagtgattctagccaagtgcttcctgacattcttaggggctcgaaggtcaatacttgatttggattttttgttgttgtttctttttccctccagcctcctgtgttgtgttgatttgtaaaatggccattgtaaatgttaaaatggaaagaaaaccgagtctgttataagctttgatgtagtaaaaacagcatggagcatcttaaattttaagatgtcatcagaaaagaagctcttcccagtttcctcttgaaaatcattgtattagtcagggttctctagagggacagaactaataggacagatatatatagaaaggggaggttattaagtagtattaacttacacgattacaaggtcccacaataggctgtctgcaagctgaggggcaaggaagccagtccaagtcccaaacgattttatttgacaaaagacaaaaacagaagttatttacaatagtttttgctcaaataattcagtgggggcaactgtacttttcctccaggtttatcttataaccaaacccaagcagaggctgccccaccccaacaccccattttacacagctgggaatgccaaccagaattcagcagcgtggctccctcacccctcaccaccctctattgctcagtgtacagtggggagggaaagatcccacctcagcccaagaacttggagctgaagaacttggaatctgatattcaagggcaggaagcatccagcacagtagaaagatgtaaggtgggaggctcagccagtctagccttttcacatttttctccctggtttacatgctggccatgctggcagctgatttgatggtgcccacccagattaaggatgggtctgcctttcccagctcactgacttgaacgttaatctcctttggccacaccctcacagacacacccaagatcaataatttgcaccctccaatccaatcaagttgacactcagtattagccctcacaatcataaaacagaaaaatgagtgaaaagcataaattttgctttcaaaaagctgggagattctatatccatgaaccacaatatatgacgtaaggctggccaaatgcagtggaacgaaagctcaggaagggctaagagacaatcactatgatcaggttatagattttgacaaagcaagcaaaaaacacgtctccaaaactggtacttcagagcaggcataccctaaaggatgacgccaataagcctttgtttggaaaatggcaagggtattgcaagactggaagtagaaaacctccctggaccctacctgctaccatgtagtagcaaatgaaactgaaagggaaatgcacagtcatcctgtgtgtataggaagcagtccattgttgtggcactacggcagcctgttggccgagaagaagcagtggctaaaataactcatcagcacacaaccctttgtaataagacttaacagtaaatcaggtaaatttttaccaactcacaacatcctgactcctatcccacaaaactgtcctctaaatatctgaatcaagaagtttccacattcagaggaaagtaacaataaaaaggaaccagcacaggatattgtaatatgccatacatgacactacaaagatattataatataaaaggagaaaaaactggaaaatagatggtaaatgcagaacactcactataggtgattccaacagacaaatcaaaagataacattaccatgatcttgacgacttaaagaaaccaccaaagagctcaaaacagaaataaagaggtcaggggtaatatggtgacgtgagaagagaagaaacatacactgatgtagctctccagagaactgaagggggaaatttttttttttttttttgagacggagtctcgccctgttgcccaggctggagtgcagtgacgtgatctcggctcactgcaacctccacctcccgggttcacgccattctcctgcctcagcctcccaagtagctgggactacaggggcacccaccaccatgcccggctaatttttttgtattttttagtagagatggggttttactatggtctcgatctcctgacctcatgatctgcctgcctcagcctcccaaagttctgggattacaggcgtgagccaccgcacccggcctgaagggggaaaatcatcacagatatgaagatgattttgaagcagccaaagtaaaatagacactagacactgccgaacatagaatagaggatatgatgggcaggattatcaaagcaaacaaaacggaaacaacagcttaaaagtattagaaagaaaatagtatatttgggtgacgaggaagatcccagagatacatcacaatatatccctgaagaagagaattaaacaaatgaaacataaacaaagatataattctacgtaactttcaataaataaaagatttgaatttatagattgaaggagtctactatgttacagaaaatttgctaaagaacaatcaatactactctgtattatagatgtattgatagatcttggagataagaatgatttggtcacaccagcaggaatatcaagtaacctatacaagaccacagtttaaaaaaaacctcaggctaacctaagccttccttacagcaacattccaagattgcagagagtaatgcccatgaagccctcagtgaaaaagtatgtggccttagagttttatgcacagccaaactgtcattcaaatgtaaaaacaataaataaaacgtgtccaacatttaagaacccagagaagatgattcccatgagttattctttaaaaaactattggctgggcgtggtggctaacacctgtaatcccaacactttgggagactgaggcaggtggatcacgaggtcgggagatcgagaccatcctggctaacatggtgaaaccacatctctaccaaaaaaattaaaaattagctgggcgtggtggcgggcacctgtagtcccagctacttgggaggctgaggcaggagaatggcgtgaacccgagaggcagagcttgcagtgagcagagatcacaccactacactccagcctgggcaatagagcaagactctgtctcaaaaaaataaataaaattaaaaaataaaaaataaaaaactattaaagactttatctaagagatgaatgaagaaaccatggcaaaaggattttcagtgaacactgagtctgttttgcttttagactgggtctaaataagtgcagaaacttttgttatagaaaaaaaaaactaagctctgaatgttcataaatattttaactaatataaggataaggtggaaggtggtatgtagattcattcatcatctcatttaaacatgataaatcaagtatatttaaatatacttagcatacttactaaagtatattagtaaattaatatatttactgaagtatattagtaaattaatatatttactaaatatactaagtatatttaaatatacaaaaataagtgtaggaatgaacatatatgttagtttgaaatatatatgtaatatataaggtacatgtttaatatgtaaacatataatatatattaaaccaatgtttagtgcctattaaccaaattcaagtgatagaaggaagagaaaataaagaacaatttgtattgcttttagtggaaagtaaaatgtcagtgtttcaagaaacagagaagttaaatagctaaataagggttagttacaaaggtgatcactggaaaaattaaccataatacaaacctgcccaaatagcacaaggaatactcacaaaaagaaaatatagaccaaagagtagaagatttttttaaaaaagcaatagaaacagaaatcaaaatactataaagtaagaccaaacctgtttctcatatcaacaaataaaagtgggctaaactcccatattaaaaaaaaagattctgaaatcgagtaataaagtaaaacttaaccatatgctataccccatatatacctaaagcaaagtgtctcgcaaacttgaaaatagaaggatgagcaaaggaatattatcaaatgccaacaaaaaggaaagtagaggccaataatcttagaataaaacaaggttgaatttagaacaaaaagcattaaacaagaaacataaagacaattgtgtgataagatgtatcattcacaaggaagatctaatagtcattaagtgtttctgtatcaacgtagcctgaaaagttaagcaaaaactaccaaaaagataaggaaaaatagaaagactttaattataggaggcttaacagacaaaatagacccaaaagatgacatagatggcctaaataacataagtaagtagtaaagttacatatatcaatctatccctgaaaactaaaaatatgtcatcctttcagatgtccataaaacgtttcccagaactgactatactttagaccacacagaaaacctaaataaactccccaaatcagaaatcacactgatattgtcctctaatcactatgagtcaaaaaggaatccatgtgaatgtatagaatatttaaaattaatgataatgattataaccacattacatatcctatgggctcaactaaagcatttgctcaaaagaaaatttgtatacgtaagtacttaaattaatgaacaaaaaataaaggaaatcagtgcatatgtcttctactcacgaaattaaatataagaaaaataaagttaacctcaggaaaatataaggtagctatgataataaaagcagaaaataggaaaaaagaataaatctttaagttagctctttatgaaaaatcaataaatcattagtaaacaaaccaaaatggttgccaataagttattttctaggaaaatataaaattaccaggcatgaccccagatggagagaaaacaacaatctaaggaaatgaattagtatagaagaaatacagaatgtggagaaaaagcaaacctcttgaaagaaaacaccagtcctggaatatttcacagattacttctaccaaacctataaggaaaaaataggtccaatattatttaaaccaagtgaaagcatccaggttatttttctgaagctagcatgcatcatgcatattctgataaatagagcacacaaaaaagcaaactaaggaccaatattgcttatgaatatcagtgtaaataatcctaattaaaatattagaaaacaaatctaagagctcacaaagacaagaatttgctatgttcaaatgggatttagtcttaaaaaagtaagactatttcaaaattcacaactgtattaatttaattcataaaatattgtcaaaattaagaatcactttatcatctccataaatacttgaacaggtgtttgataaaattctctaatcttgatgaaaaactcataataaaatgctattttattatacagacagagacatacacacatacatataccaatacatacttagtaacatggtcccaaagctactgatacaactgctgaagaaagtgtcattaatgtcggctacaaggaaagataccttaatcaatagcattaattaacattattgctccagagagcctagctagcctaagtaaacaaaagaaaaaaataagcagagtaattttaaccaggagttaaaattatcatatatgcagatgatatgattatgtactgtaaaacacaaagaatcacatggaaaaaatagtataaacaataaggaaatacacttaggtgattgagtacaaaaatactactcatgttaatctttccacaaacagaaactggttagaaaatataactgaagagatcccatttacaataagaataaatttaacaagaaatgtgcccaaattacacaaataaaatttttaaatgctactgagaaacatgaaaaatgacttaaacaaatggaaaggcatactctgtttaacataaagatgtcttatctaaattaagttatacaggtaatgcaatgcaataaaaaaaaaaacaatagaatctacaggggtagattctaaagttcaagaacaaataaggaagcccaacccaaaagtttctgacaaaggaaaattaagaaagggggattagccctatcaaatattaaaatgtattgtagtccgggtacctgaggtcaggagttcgtgacctgcctggccaatatggtaaaaccctgtctctactaaatatacaaatattagctgggtgtggtagtgggcacctgtaatcccagctacttgggaggcttaggcaggagaattgcttgaacctgggaggcggaggttgcagtgagcccagcggcgccactgcactccagcctgggtgacagagtgagactccatctcaaaaaaaaaaaaaaaaaaaaaaaaaaaaaaaaaaaaaaaaactattgtaaaactacagaagttaaaatatatatgtctccatatctttttttatttttaatttttatggccacatagtaggtgtatatatttatggggtacttgagatattttgatacagacatacaatatgtaatcatcacattagggtaaatagagtatccatcacttcaagcactcattacctctttgtgttacaaacattccaactgtactctctcgttattctaaaatgtattacaaattgtcactgactgcagtcaccctgttgtgctatcaaatactagatattattcatttatatctctatatcctaacaaccaggaagctctatgtaagtgtctagaaatagaccaaactacatatgacaaattttttatttacatatcaataaaaaaatcagtctattcaaaaatgttattgaaacaactgaatacctctttagaaaaaaattaacaagcacaaacaccataaacaaaatcagaaaatgatatactgagaaaaatcatttacaaaggactattcttttttttttaatttaagttctagggtacatgtgcacaacgtgcatgtttgttacatatgtatacatgtgccatgttggtgtgctgcacacattaactcgccatttacattaggtatatctcctaatgctatccctcccccatccccctaccccacaacaggcccagtgtgtgatgttccccaccctgtgtccaagtgtactcattgttcaattcccacctatgagtgagaacatgcggtgtttggttttctgtccttgcgatagtttgctgagaatgatggtttccagcttcatccatgtccctacaaaggacatgaactcatccttttttatggctgcatagtattccatggtgtatatgtgccacattttcttaatccagtctatcatggatggacatttgggttggttccaagtctttgctattgtgaatagtgccgcaataaacatacgtgtgcatgtgtctttatagcagcatgatttataatcctttgggtatatatccagtaatgggatggctgggtcaaatggtatttctagttctagatccttgaggaattaccacactgtcttccacaatggctgaactagtttacagccccacaaacagtgtaaaagtgttcctatttctccacatgctctccagcacctgttgttccctgactttttaatggtcgccattttaactggtgtgagatggtatctcattgtggttttgatttgcatttctctgatggccagtgatgatgagcattttttcatgtgtgttggctgcataaatgtcttctttcgagaagtatctgttcatatccttcacccactttttgatgggttgtttgattttttcttgtaaatttgtttaagttctttgtagattctggatattagccctttgtcagatgggtacattgcaaacgttttctcccattctgtatgttgcctgttcactctgatggtagtttcttttactgtgcagaagctctttagtttaattagatcccatttctcaattttggcttttgttgccgttgcttttggtgttttagtcatgaagtccttgcccatgcctatgtcctgaatggtattgcctaggttttcttctagggtttttttggttttaggtcttacatttaagtctttaatccgtcttgaattaatttttgtataaggtgtgaggaagggatccagtttcagctttctacatatggctagccagttttcccagcaccatctattaaatagagaatcctttccccatttcttatttttgtcagttttgacaaaggactattcttcttaacatgttaaaaatctcttgaataaaattaaaaaacaacccagtggaaatagatagggcaaataatataaataggtacttcccaaaaagaaagaaacatgatgtaaaccattgaaaaaatgcacagtctcactcacaataaatgtatattaagactactgagagatgctgatttaaaaaaaaaagcctgccagatttcacattgacaaggatcaaaaagtttaatcacacattgttggcaacactgtagggaaataaggtaccctcatacatctttggtggacccatgaattggtacaatgttgattaggagcaaattgccagtatttatcatgcaacttgcatgtatctcctgactcagaaatttcacttctaggaattcctcctacattacacttgtgcaattgtgtgtacttgcacttgtgtgaatgatgtatgtacatgaatatgctttgtcatattgtttgtgagaaccaaagattacaaaccaccaaatgctggccaatatacattcattaccacaaaggtctggtcaatttagagaaagaaatcctatgtccacgaaggatataatctctaagaaaacaaagtgctgacagcatcatagagtatgttaccattattgtaaaatggcaatagtaataattattatataaatatatgcttgtgtatgaataaaatgccctgaaagtatactgatagagtttggatatttgtccctgcgcaaatcacatgatgaaatgtaattcccagtgttggaggtgtttgggtcatgggggcagaccccttatgtcttggtgctgtccttgcaatagtgagtgagtgctcacaagatctggttgtttaagtgtgtggtaccacacactcctccttgcttctgctcctaccacatgaaatacctgctacccgtttgccttctgcggtgactgtaagcttcctgaggcctccccagaagcagatgccagcactgtgcttcctgtacagcctgaagaaccatgaaccagttaaacctcttttcttataaatcacccagtctcaggtatttttttctttcttttgagatggagtctcgctctgtcccccagactggagtgcagtgacgtgatcttggttcggctcactgcaagctccacctcccgggctcacgccattgtcctgcctcagcctgccgagtcgctgggactacaggcgcccgccaccatgcccggctaattttttgtatttttaatagagatggggtttcactgtgttagccaggatggtctcaatctcctgacctcgtgatctgcccacctcggcctcccaaagtgctgggattacaggtgtgagccgttgcgcccggccaggtatttctttatagcaatgaaagagtggcctaacacgtatacattagaacctgattacagtagatgcctcttgggaggggacttaaatggccagggttggtgataaaaagtattttttaatgtatccccttttttatctgttaatttttttatgtgtatatgtattacctattcaaaaagttaatcaattttaaattaacttagatcccaattcaaactccacatctgctacctccagctttgtgacctagagcaaactgcaggccagctgccttctctgtggagcagggactgtcagaactcccccatcccagggtgtgatcagagctacatgagataatcatgggaaagtacctggaaattacatgtaattgcttagtaaatgccctccgcttctttccccccagaattaaagtaagctgcatctaactattacaacttaataaggtgcattattgtgctttgctgtgtttttaattttcttgtcatacctgaatggtttaaacatctggcttccttaaggcataattaagtaaaagagagagcagcgtacatcaccagtcaggtgtacttctttccctgttgtaaaagtgatgctttttattcagagccaagtctagatattcaccagtccttggcacgactagaaaaagatttgaaggactaaagctgctagagcataattatgtattggctgtggacttgagatgcctgggttctgtccctcctgactgtgacttagcagccgtttgtcactggagatgttttatgacttctgcaggcttccacagtatcacttgtgaaatgggaataactatttaatagctcacagaggtgctgtattaggttctccagagaaacagaataggatttacgttatatataacaataggatatagcctagatatatagatatatatatataaggatttattgtgggaatttgttcacgtgtttgtagaggctgagaagtgccacatatgccatctccaagctagagaagcaggaaagccagtggtaaaattcagcatgagtccacaggcccaagaaccagcagctctgatgtcccagggcaggagaaaagctggatgtcccaggtcaagggaaggagggaatttacccctcctccttctttttgttctatctgaaccctcaatggattggaagatgcttgcccacaccagtgagggtaatctttactcaatctactgattcaaatgctgttctctttcagaaacacactcacagtcatacccagaaataatgttttaccagctatctgggcaccccataacccagtcaagttgacacataaaattaaccatcacagacactgactagaatgcataaagtccatctagaaaagcacccagtacataataagcactcaacaaatatttttggaaaagtatcaaacactctgtgcaaggagcaagaaatggttcctactttcacggtctacacaaattaatagggagatgaaacaatggcccaaatcactagatcaccaagccatttaggagaagaaactgaagtgaagggggtaggcatgactcataaagagtaatttcctttccctctctaaggccccaccagtgaactggtggccacgttgactaactggagacaggataccaaggaggacagacatcattgtgaggtcccattctacgtaccccaaaccaacagagtcctctggaaggcctgagagctgttaggaacaagacgaaatgggtgtgagattgaagaagtcacaaaatgcagacattttaagctattctcccaaaatacattaaaaatcttactgagaaaaatgtgaaatatatacaatactcacttgcatatactatttcttattttattttatttatttattttttgagacagagtttcactgttgttgcccaggctagagtgcaatggcacgatcttggctcactgcaacctctgccaccctagttcaagcgattctcctgcttcatcctcccaaattgctgggattacaggtgcccaccaccacacctggctaattttttatattttttagtagagatggcgtttcaccatgttggtcaggctggtctcaaactcttgacctcaggtgatccacccacctcagcctcccaaagtgctgggattacaggcgtgagccactgtgcccaaccaacactatttgttattttagatgttgggaagttttcatgaaaattctcttgtccattctcatttacatgcacacacatacatatgcacatgcatgaacacatgcttcacggcgcttcttattaatccttattgggtaaaatcttattgagggacaataaaccagataaaatctccaaccactccctggtgccaagtctcttgggcccctcacactccaggtgggcaaggcagcatgccagtggacacagcatcacctgctcagagggagtggttgtggaaagcacagaggcaggcggcctggtggccaaggtccacaccacatcctcccaggtgggcactgtcctgagtaggcttaaactggcattgtctgtccagtaagtccttttctaaggaaagcaggtatcaactaattagcaacatgcaagtgttttcattttaggaaaagagaagaactctggaattatggggcctggtaaaggttcatttaagcgtcaagatcaagttggctaaacccatagtgtggaagcactctttgcgtagggtgagccaggtggagcagctgtgtgacagatcttggaggcagtctaagggcaatgagcacctggagaacaaagagggaggggctgcccacctgaggaggaagggacatgtgcaactgtctcctagatggggccctgagaactgccgggagacatcacagggcagcccctctccccacctctggctacacagtctcctgcccttctctactcagtgaattctgaggtcaaaggctactgtgccaaactttcaagtagagtgaagcctcctccgtggtgaactataaacttggatggcatcatgtccatttttgtgttcttcacagcacccaacagcaggttcacagtcaacgttagtgagggaccgagattgtagaagcaaatatttctccagcatcaggggtgttgcctcactaggatctaccattgggatcccaacccaggatgatggtttgaaaccttccggtccagttctcccccatttgtcagtctttgtccttgacaattaatgctgtaaatgcatgtactaaatgcccactgagtgtgtgtaacacacaagccggtgatatcagagtggcaccggacagggagcaacacttctgcaaaggagcaggtattccaagtccttctcatctttcctgagcatctgtcatttgggtggacctcactgcacccttcagctattagcagtgactgtaaatggagaagaagttctcgagaaccagcagcaccctgaacactcattaactgagaaaaattggagactcaaggaggcccaataccctcttactgaatacccaccttccttgtgccagggaggtcatagggaggttgaaaaatcaagggttttgccatgtgtctgagtttgattcctccaaaagggcattaacttttcatattacctctgcagagtgggatttaaaatctgtgttagtgacacgatatttcatttcagatccacagggcccacatttaaaattaatattgcatgcttgtcagaatgaattccaaaccctctcacagcaggccccttgtgggacctagagaaggagtggccaattcattatcgtaacactgggatgagggttccatcccagcttttgactgacacctgcagagattttttttttctgagacattttaagtttttggtgtgccccatcttcccagacaagctgcacgtttctgtcactctgtgctgtttccaaagcccagtggtctgcagggtacctttgaggggcctcctctgatccagttaatcagttcctcattgacaacatagacagagcatctggcccaggccagagagggctttcggccgagtccctctggaggatcagtctgtagagggatgtgactaaggcagcagattccgccaggattctgttagacacagaggacacaaggtcacctggccaaaagtggaggtcaggaagactcaagatctgggtccacctgtttcattttctcttagcatctgccctggcctgctgtcgtaaatcatcatcaccgagcttaaaaccaccctgtcgttcaaaaaaaaaaaaaaaaaatgagctatttggtttttgaacactttccttacagtgcgtagcagtttgttagagaggtgggcaggcattaggattttgtttataaccttggaataaactaagccaacagactgtattcttgcagggttaatgtcccctgctttacagtatgggaatgcccaacgaagtttttattatagagggtggaatatggtgcagtattcagtggagacaattgccccgggagtgcagcgcagaaagccacagctgcatctccacttggtgtcggccgggagctgcctcacctggggctccagggtccctttgagaccgcagttccatagcccgtgggtactgtccttgtgtcatcatcctctctctctctctctccattccagtcattcactctctccccctctttttctctgactgcctccaggcactttctttagcacagagctctggtgatacctcccactggccttgggcacccttcttcaaggccactcaccctgcatggaggagaggaagggaaggagtggccaattcattttcgtaacaaacacccaattttgtttttctccgtggactatccagatgcatgcttcttttacagttcatgtctgcgatactttgtcccttagagaaaaaagctgtatacaaatgtgaaattattccaattatctaatctctgttgcattcctcagccctgcaaagagttaaatgatgtgtaaaatcacctgttagcccgcattagacagggctgtatttacacacccagaggtggcctgtgaattatttaaccgaagggactcttggctcagcatctggctagacactgttgagcccaagttccttaggaggtgcagcctgtggccccagagcttcctcttggctggggaaaccgtctgacagacacggtgggctgctgccagaaccaggtctccttgagaacaacttgaactaagctcctcccagctccagatggttcacaaactagagaggagttttgcagagtcctgaacgctttgccaaaaaagagcgttggccatcttccaggccaggcggtaggtttgcctgcatgctgtgaatgccaggattattgttggggttttagagagtccatttcataacacccccagttcccatctgaatttggaaccaatgagagaaaaagggaaagcagtgagatggatggagatcaaaacatcacttttgtcaccaactgacctctcagagaacagggggagagtgacactggatgtcccaactaggaaccccagagtagagacacacttccatgaccagtgctggaaacccatctgcctcatgccaggaggcaggatcttgggtccctgtaccctggtgcagggaacggaaaggagccataccttctgcaagcacccagctcctcacaggaagccagggccaattcttccacctctccttgtctcatctcacttttcaggtgagcttcctttctctcctaccaaggagagggtgggggctgtggcaagagatggaggcatctggggaaaagccttcctcggggaaaacagcattccatatatctcccagggagatgggacctgcatatatttggaggaagaagtcatagagattgcaagagctggagaggattttagaagccactggaatcctctcattttactgaaggaaacagaggcacacgggtgcagcgaaaccctcatggttatatagctagtcaggggcagggctgaatttgtgtggcagtctgcagtttaaagccggtccctcatggtatggagaacacagcagtgggcatttcacacgcataatctcaccacagggggccaggctgcctcttggtctatgggactccaccccactgtgggtttcagggcaggttcccactcctacctcatctatcccttcttgggaatgggagatgcttggaggatgcacagtaattgaaatgctattcctggcaaatgatcatttccgggggaaaatgtgaatatcatgatatcaagtcaaataaagctgttaggttgaggctttgtccttgagctttttagactctgaacaggcagttgggaaggcagtcagctcctgcctgagtcactgggcaggacagccagcccagggaaagatgagggaagtgggggacctgcgttggtatctcactgggaggatgctgtggcctccccattcgatggagatccttgtcaggcctgcttttgcaaatgctcagaactccaggcagctctctggccctcttctttctgtcctctccatgcagctcccactgctgtatttactcggttggcactttccgctgtcagaatcacatttctcccagccactcactgtgttgcagaatctgtgtattgtcttttcttcagctggtgttttgggcttaagccctgaaatgctttgttctgggccccactacagcacccatactgtgtgctagagaaaacaggaaagggccctcaccatcacacccatgaccttggggaggccagcacctttgttgtcatacttcccaaaaccctccatcccctccctgccagaggagctagcacaatctagatgcccactggctgaggtttatttccagcactgcaaggtaacaggtacacacatacgcacaccagatttccattcccattaaatctctgcatccccaaatgagctacctgttggcaaaagctttttatctgtcagaagttctcaagtggaagttgtctctctctctttgctgcacgtgtgttaccacaaatgcggattgtgccggcctttctccatctcacccacaacctccccttaaacctccatctccaacacccccgagtcttcaatgcctcaggagaattctgaagccagcatataattgctgtccagaaagaggccccgtgggaacggaaaggattttgtgtgtgctcacccctacatttaatggggccatccttccccataaggctcagtgctgcaaagccaggagcccacccccaaggctcatgccaaaccccaattatctggagggcaactggccctgggagctgggccaagcacagcccctcctagctgcggaaagagccttcctatatgtctcgtttgacgcctacaaaaacctggggaagctggcagggcagggggtggggaggttaagcccatagggtggacaagccacagggctctgctccctcccttccccctcatttcttcacccctcccccatgaaaccatcaatcaccttgatggcaggagggaggggtgcttggctgaattgacttgaaaacactcagaaacccaaattgcacccacagaggcactcagaattcagggagatgagggatgtccgcctgaaacacttttttgcagtaatgtgttccgtgatggaagtcatctaattcattcatgaggggactgagacctcagaggaaagtggtgtccctgaaactagcaagggtcagaactacttgcagagaagccactaggaaggctttccagatgagactctccccctactcccactaatattagagggactcccctccctccagcatctccccacagggtctggctgcctcaggcttcccttggctctcagagatgcccttccactcaactgctacccacatgcttctacctgctgcacacaccctttctgtctgcagcctctgatatggtttggctgtgtccacacccaaatctcatcttgaattgtacctcctataattcccttgtgtcgtgaaagggacccagtgggaggtaattgaatcatgggggggcaggtctttcctgtactgttctcatgatagtgaataagtcttaggaggtcttctgcacaagctctctcttgcctgccaccatgtgactttgctcctcgttcgccttcctccatgattgtgaggcttccccagccatatggaactgtgagtcaattaaacctctttcttttgtaaattatccagtctcaggtaggtctttcttagcagcgtgagaacagactaatacagcccctcccctaggctttccctccttagagttcatgttgcagaccacttttccttccttctccgctactgactgcccccatccctgtttgtccagggttctcctgttttctgggttccctgatgagagttagttccttttagggactaattcgtcctagggaggactagattaatagactaccaagtcccctttccaaactgacttgcattttaagatggaaaagtgactcccagggacagggcattggctcaacaggtgcttctacagcttggccgtgacagcctgtctctacatagaaagggccaggggctgcagtctttgcttggagctgtgtttgtagaacaagcacactgtttttaacgtggtttatggttttgtttaaatcaggagtgtcgaatcttttgtattccctgggccacaatggaagaagaagaattgtcttgggccacacataaaatatactaacactaatgacagctgatgagcttaatgttttaagaatgtttacaaacttgtattgggccacatgtggcctgtgggccactggctggacaagctcggtttaaattgataagatattcgggaagaagatctaatcactctcctgccagcctctaccctgctgctaaaatgctttcacaggatctaggtcactggctttgataatcaccacagcttgtggatgtcctcctaagtctagtgccggaagggaactcggtattcctcagtgtgaactggaagcagatgaaggaactccacctctcactcaggtcatcatgtttctgttaatgcatcctgagatcaaattcacctttttcttttgctgccatattatattacaatttttcagttgacttaattgcaaagtatcttctatttgggctactgagtcacttatctctcaaattgtgtgttgttctaactatatatctatgccataagtataagggtttacatttattccttactttatgtcatcttaaaacaaatgaaagactactctaatcatgccacttctcactcctgattctagaaaacagtgtctttcttgaccctcctagttttaaatctggactatgaatctggcattcattcttatcccctaacattagacagagtattggctttcagaaagctaagctttgaagtactatatgttgtgtggcttactggagatcagacaatatgcaagaagtcaaattagttagtttggctcatggaaagctgtctaatttggaaataattaggtgtcatctcctgagagagagagagagagagagagcgcgcatagggagaggcagtggggaagaggaagagagagaggacagaaagggaagatgagagaaaatagttttcattacatgttaagcagaaagagttggaaaaaaataatttctatgatctgcaaagtcatttcaggagtacattagcttgctagggctgccatagttaagtatcacaaagtgggtgggctaagtaacagacaattattaactacagttctggagaccagaagtctacgatcaagacagggttggttccttctcggggctgccaggaaaggatctgttcccagcctctctctctggcctgtagatgactttgccccctgtgtttcttcacagtatcttccctctgtgtgtgcctgtctgtgtctaaatttcccctttttataaggacatcagtcattttggattaagatccacactaacaacctcattttaactcgattacctctgtaaaggccctatttccaaatgagatcacattctgaggtactgaaagttaggacttcaatgtctcgatttggagtggggcacaattcagtccataacaaggggattcccaaagagttgtcataggaatatcacccatcaggcaaagctcctggaagcagatggagccaccattaggaaagtttcccatgagactgtggtgcttctgatgtggctcagctctggaactgactcccacccccatcacccatttcaacctctaacccccaccacctaaccaacaccccctcccctgtaaaagcctttcttcttaagtcaggggtaaactttccacattattatggtccgtgtttccaatgcagtggtttctcagatctgcatcgctcctctctacctcctggttccctgcaactccttaacccacaagcagaggaaggagaagagaaggaccctattgtttagagcagaggtgctgggttctccctctacttacaaccttgccctctctcatttctcctgatgaccaggtagggtagacagcaacatccccatccaaacatgagcagtgaggtgacctggccggttcgatgagtggtaggcagcacagccacaggccatctccctcctaaatggggctgggcccaggggttttcctaggccctgcctgactatgctgcaggctctgccttacacttgctcatcctcctgttgcagaagagctacagggagacaagctacaaaaaccttttaatctgtatgattaacagaagcaattggcaaatgaccctgctgctctcccaaggggaataaggggtttattttcagatgctggtatttatcccactgaatttcattgtgcagcctacagtccatcaaatgcttcccagagtcacccagggtttcttcttagattaaaatcagaattaaatcagatagatacatgctttatcaaatctcattttcttggggatgaaaaataagtttctctttcagtctgtgatttcaggaacaggaagcaaagaatttggaagtttaaaaacacctttgcctgagcctgcatagcttattttttctccaggcagatatgggcctccccttgacaaggtgctacctgtaggcaggaaagtcctgctgcttgtcctgccatgtaatggaacttgggccataaggtggataaagataaggctgctctgagaagctgtattagttttcacaatgctgataaagacatacccaagactgggtaatttataaagaaaaagaggtttaacagactcacggttccacgtggttggggaggcctcacaatcatggcagaaggcgaaaggcacatcttacatggtggcaggcaagagaaaatgagagccaagagagtgagagccaagcaaaagaggaaacccctttaaaataatcagatctcaggagacttattcactaccatgagaacagtaggggggaaacccatgattcaattatctctccactaggtcctcccgtaacatgtgggaattaagggagatacacttcaagataagatttgggtggggacacagccaaaccatatcagaagcacagaattagtgcagagttggttaatgaaataatcattttctacataggtaggggagttaaatgatcatattttgccttttaagagtatcatataggaactcttacaaacctatacaaactggggcttgttatgtgagaagtgacgttggtgatacctgcttggaaagcataggtctccaatcccagctgctgtcctctgggagctgcacaaaagaaggtctatcacatgcttctgaagggagctgtagaagcttctgtggttattcatttgctacagatagaagaagaaattaaaaccaattgtgaaggaaagggaaatgaacattattgaggagtgagtaactgtgtggcaggcactgccctgagagattttgcctgcatgctcacctaaattttagaaataggactagctttaaaaaaataaaaaataaatttgagaaataaactattatcctttagaattgataaaaagtagttcatggatattagagatattttggtaaatatcactgtaaagcataaagaaaagaataaaaagtacccatttgctatgatcagaatgttgtgtcccaccaaaattcatatgttgaaacccagcccccaatgtgatactgttaaggggtggggcccttggaggtgattaggtcattagtgttctacctccatgaatgagattagatttgaggaagcctgtttggctctgctggcttatcaggacacatggaaagtgccgtttaagaaagcagaacaagccctcaccagacaccaaatctgtcagtgacttgatcttgaacttaccagcctcctgaactgtgagtaataaatttctattgtttataagttaccccggcaaagatattttgctgatagtagtccaaaagaactaaagaactaaaatgccattgtaccttagcccattctgttgaatcctttggtggctggattgaagagctgggcagtggagagaccagccaatttagaaagactagggggtgcctggtcatgctgccttctatgtaaagagtgggaagtggggcaatgcagaggacattttttggtgcaggaacaccatgaggggaaggactccaagtcttcagatgagatgatggtctctgggcagtcagttacagagcaggaacagcactctgatgtcacttggaaaggcactcatgaaagcagcagagcctgagctggtgtgttcggaggcagcattaaaaatcagcaggaaaggcatgagacatgaaaccaaaaaagggatctttgctgctgggtctcaggcaacacaaggaagaggtttgtcctgggaccccctgtgaggttctaggacctcaggtgctgttgggatcaggcaggaatttcctgaagtcagccttgtggttgcacctccttctttgcggccctcctggggactgttcttcttttttagactcatttaaaatcctcaaggggcccctctgctataagaaagcaccaagggaagggccctgcctttccagtttcccagcacctagcatgcagtgagtgctcaaatataatttatatttggaatgagtgatgattctctctgcttcccctttgggactgaccttgatgctcatttctacctgattttgcttataaattgtgaggagagttctctacactacaatttatctcagtatccctccccagctggtggctctcatgtgctcactggagcagtctgggacatcaaacatgaacaatgacatagtgaaagaagaaaatgcctggggaagataatggcactatctggagcagggagcctgccatctaaggaaatggtaaaaagaaggaggctccttagggcaggtttcaaggggccagaggaagccccaaatgcgtagaatcacagccaggtgctcaggaggggcagcagaagcagccctcaggacgaagggtagtggtcatcgtgcaaggcagacaagggccctagggtgcaggcaggctgggaagatctccagagaatgaggtgggccatctgggggcatcactttgacctgtagacaaagtgaagggagaggggagggtctggtgatgacagcctcagatgcagactctttaagccttctcaaggctttccagtttttgcagctgctgaggaaacttcattctcacccttcttgttccatctgaaaatgcacttctctccagagctctgggagactgtgaaaggctctctcattgccctgaaatatttttttaaggaatgagtatgatcttttctattctctacttctgtcccatgcagagcagatgtagaggaccaggagtgattcagagatgagaactgaatcttccctccagaaagttatgttccagagggaaagaagcggaacttcagtaacagagaatatgaaattggtcctaagtagaggtatgtggctctcgtgactggagcagagggagaaagacttgattcaggttcttgcctcgcagccttggaatgggaaaaaggaataaaaaatatagaacatgggtattagttcattctcacactactataaagacatagctgggaatgtgttatttataaagaaaagaggtttaattgacttgcagttccacaggccgtacaggaagcatggctggggaggcctcaggaaacttacagtcatagtggaaggcaaagaggacgaagtcatgtcttacatatctgcagaaggaggaaaagagcacaaagatggaagtgctacacacttttaaacaaccagatttcatgaaaactgactcactttcatgagaacagcaaaggggaggtctgccttcatgattcactcacctcccacgaggcctctgctctaacactggggattacaattcaacatgagatttgggtggggacacagggccaaaccatagtaacatgtataatacatatgtatgcaagtactggaatatcaagtttcctggaggaagtagcttttgagcagggcctagaagcatgccaaggatttggatgtgtttgttgtgggtggatgaagtccatgaccagcaagcagactcaggagagttttgcagataagtgtgtccagaagcaaaacaggctgggaggagtggtggtgctggaaaggtggcagatgccgaatgatggaggaccttgaattccatagtagggaatttggcatttattttgtagctgtgggaagccatagcagtttttcaccaaagagataatttacatcaattattccaagccctcagattcactccagttgctagttcagttgtttggttcaaggaagcgtcagaaaggaaatgaaccagaaaggatgagtgatcctagagtccagggtgtccttggggtcagagggaggacaaggccttatgttccctgccttttccaggaggaagaaattgtagtaatattccaggacactggatggacttgtttttctttggaaacaaggttattgacctctctgccgcagtaagagaaaaatgatatatatgttagaacttgaatatttttgtagaaacttaatattaaaggccttatgttcaaatatgcagcatttcacagtgctggttgaattatttgggctaggttgccacatggtgttccatgtacaattctccttggtaggctgggttaaaaaatgtggctaggtaaaatgtgagatgagaaataaaaaaggatctttgttttttcatgcttgtgatacttaaataggctactgtgacccaattaagaagctcccagaggccaggtgtggtagcttatgcctgtaatcccagcactttgggaggccaaggcaggcagatcacttgagttcaggagtttgagaccagcctggccatcatggcgaaactccatatctcccaaaaatacaaaacttagtcgggcatggtggcacacacatgtaatcccagctacttggaaagctgaggcaggagaactgcttgaacccaggaggttgcagtgagccaagatcaggccactgtactctagcctgggtgacaaagtgagactgagactctgtcttaaaaaaaaaaaaaaactatccaggcgtggtggtggatgcctgtaatcccagctacttgggatgctgaggtgggagaattgcttgtacatgggaggtgaaagttgcagtgagccgaggtcaggccactgcactctagcctgtgcaacagaggctttgtctcaaaaaaaaaaaaaaaaaaaaaaaaagttcccagaaataacctctaagccacccatctaattggtcccagagagatcaaaaaaaatgcagcattgaaaatggcgtggaggcaatgacttagggtttatagacaggcatcttccctgtcgtcatccctgacatcttccccaagtgggctaccacaggtcctaggtgatgactggttaggccatgaagctgttcagagggacagagagctgcagagtttggggaaatccaccccctgcttccccagaaggagaagatgcatactaatctgttttggagacaatgcagaatactgattagccaaatatttgctggtgatggggatcactgtgtgtattcgttttctattgctgctataacaaattaccatacacttaatggtttagaacaacataaatccattcattatcttatagttctgaaggtcaggaatctgaaaagatctcactgggctaaaatcaagttgctagcaggactgtgtttctttctggaggctctaagggataatcttttttcttgccttttccagcttccaggagctgcctgcattccttggcttgtggccccttcctctattttcaaaatcagtaaagtcccatctatctgaccccttttccatcatcacatctgtctctaaccaactatagctgggaaaggtcttctgctttcaaggacccatgtgattcactgagcatacctggataaccagggtcatctcccatcttaagatccttagccttaatcacatctacaaagtcccttttgccatgtgaagtcacatattcacagattccagggattaggacatggatctcttttgggggaacatttttctgccttctatagtgtgtattaaactttgatgcttatggcatggccccgttttcgtatcttcttccactcagctaaagccttaggtgagcccgggccaccctggcagctgccctggccagctgatgtggtgatccatggagccagctctggttcatgccaataatctcatttatccagcagtctcacttggccttgaacaatttaccgttcccaaatatcagcatgtttttctgtaaaggagtgatggttcccaacaagaagaggttgacacactcaaattcaggtaatttgaggagattagaataaaaggattttaggtcttctgcggttgctagaatatttcattggccagtatctattgtcctcatccgcactgttgctggccatctgcggtcagagattcctcagtccagggcctgaccaaaaggacttgctccacttacattgcaaagcaaacaacagattcttaaacaagaaagatgatgccttctaaagcttggctattccagccaagctcaggggaaagacattttccctaaagtatcaacaagccatttgatctcagacttagaaggtcattcttgtctgcttttttctcccattagatgaaagaaaatgaaatgttttccgtaaaagtaatttatgaagcactccatatggcaatattaaaactgtaaaagtaagcctccaggggacaaaacaaataatgctgtgtcatccgtctgccctggtactgtccctgggtaatgtcaggcacagaacgttggggaactggctccccactcaactggtacttggatgcctttggagcttttccttgaacattgttgctaaggttcatgaaatcttcagatttttgttatggaatccattcgcaaagcaaaatgatcttaagtgtaaatactaaatttactgtaaattgcagacatcactacctccaagacccttttaatatattgagtcccactgaatgctggaatccaagataaagttctttaagaatatagcactcatgtcattcatgtattcattcgttcattgatgcagtcattcaagaaatatttactgagtacctattaggattcagtggtgagcaaaccactctaatgggtgatacaaatgcaaattagagcgatcgttgatatggagaaaagatagagggtttaataagagcttataacaggataagcactgggacaccatggacagattttaggtaggggagttaaatggtcatattttcccttttaagagtatcatataggctgcagtgtgggaaacagatcagagaggcttcagggcctgcccaaccatcctttacgagtgttgtttaacgcaaggtctcgtggtagacagtgttacatggttaaccccatttccattctcctcttgccctgcttccatgtggtatagaggctggaaaagttaaacaccttcttccccacctcctgtgcagctcagtgtagtcatgtgaccctgctctggcctgagacttgagcagtgatctgttgaggtcttctgggaaggaatatgcttttcctgataaaaggaatgagtgcagctgttccccctccccctccttcccacctttcacagagaagggatgactagagctgggcagccatcaggcaaccacaagggaaagaccaagatgttggtgttcatagaatagagcctctgcagcaatgtcagcaccacacacatatggactgcttgttatgtggaaaatatcagcccccatctttggagattggatttttttgttgtggttactttccatgaaaagcattctaaacagatacagtgattcaaacataggcttagccgaaaacaaattaataggcattttgatcattgtcatagttagcgggtggaatccccaaattccacttgtgccattgaaattgcagcctttgaatgggatgataaaagagggttggaaagaagaagggagccgtgatggttttcttccacaggcctgtggtggcattcctcagtgtttcacttccaacctccttggaacccatgcttatcttagcttcagcctccaacacagccttaactgtaagcctagttccctgagtcactctgaaatgtattagtccatgaggaaggagaacagattctgtcttctacctgttttcataactgtagaaatgaacacagtgcatggcacttggtaggtgctcagtgaatgtccactaagccagtacgtacacacaaatacatgcaaaagttgaaaatcgcaatgcattgtgtctttaaaaataaaaaagagaaatagcctgatcttttggaacacatatggggcagagcctgctcaatgaagcatgcacattttggattaagaaatatgattatcatttgtcagctctgatttctgcctctgggctgataagatggtgtccgaggagtcattttcactcctttgcagacaccaaaacagaaggggtctttgctgaaaggtagactctgacgtgacagtcattagtagctagaaacaggcaactgattgcaaagtcaagatgaagtgcttcagtaaaaagaaccttcatgcttgaggcatactctttgcttctttgttgaagttgtggtagatttttttaaaaaacaatcacaatatagtttgctatactttaagtttttaacatctccactggggaaaaattgaaggagctaagtaaattagctcattggatcatgaatttatagaaaaaaaattaatattgccctttgtcgtttctgttaggagtgtcacgggtcaaagcagagacaagaggcatggagaaggagcagtgtgagggcctctccgggtcatttctctgtctggcttctgatgctatctgcccaacacagtttctgaaaacatcagaaactccccagttttgcccaacatgcttcccctaccttgcacctcttagtgcagagacatgttctgtgagaatccacctggtaagacagacaacatggagaggaagatctcagagacctggcttcctttcctgcccttcccttgcagacagagttttactttgtgaagtctccagtttcagaatgagaaacctctgttaagcaaccaggcctatcactgtagggatgagaaaagtgaagtccagataggtgaagcaacttgtcccaggtcaacacagcatgtcagagaagctgaggccagccagtctcctgggttctcccccatgttcttcctactgcccctctgcggcttccatttgtaaagagaggattgcttctcctcactcctctcgcacactcttgaggctatttcagtgaattgtgtctatctttttatatttcccatttaaaagaaaacccactctatggcataatggtttccagtgtcctgctgtttggaagaatgttttacctgcctgtcagtgctgagctttgagctccttgaagaaggacattctcgtggctgtggcccatccaggcagaaccagcctagctggccaagtggtttctctgcatcgtttggctgtcagataagggccacctgcttattgattggcacagtgacgcttaagtccaaacatcctccctaatgacacagaacttcatattaaaggatgtcagggaattgattttgctcttctttaggaacaaaagatgtcagaagttagaaggaactgaacagtcaggaaaacgtaagtctctataccttcccatcaccccatccctgacccacaagccatgatcggccagtggaagataaatctaaccaatcccatgggacaaagggagagagccctgcacagcaagacagcagcagtcattgggcagaaataaatcatgagatggttgagaatctgattctctgggtcaatttctctgcatcctcctctgcccttttaggcctgtgctaaactttccctttgatgcaaatggtattaagtgccttgtgtctgaaaaggttgttggcaggctttggttgagaacataaagatgaatctttgttctcttgtctataaaatggggatataataatctacctcctgtgagaattcaataattttataagataaagctcttagagcagtgcctggcccagagtggatactcaactaatgttaactaagaaaatgaaaatgaaaatccaggaatagtctctgcctgcaaaatgttttgaatgtaaggagggagatgagacgctgtgtatatatgcctctgttctgtatttttaatcaactactaaggccatagagaacaaagagttacccctttttaaggtaaaataaattatactcattgtccagcaaggaagaaatgaattgaaaatcctagaggcagaaaagtgcagagtttggagactaccaggtggcactgagactaaaagctttatttgccatgttcagctcaagatttaatgggttgtatagtgtaaggggctaactccaggatctgctggaactcactctgggatccacagcaaacaaagcactaaccttggcatatggcgctgcgagaagtttcctaggatcagccaggctctgggccactcactgggttcatgcctctgaacattaccttccaggagctgcccccattactgaacctaatacgctactcagaagttttgtaaccaaggttttctaaaagtctgagaaatagaagatgaactttagatttgataaacagggctgtacactggagtcaggtagaggtgagtaggaatcctggccttgccacttactagctgtttgaccttggataaattgcttaacctttctaagcctcaatttcaatgtctttattaaataacttttatgaccgggaaatcaattaaataatttatttaaaatacttagggcagtattgatcatgaaatagatgttctgaaaatacttataatgattttgatcagttcctgagagcccacttgtaattttcattgggtctgtactcttgggacttctccagaaaccatgacaaggaattttagagagtattacccgatattgtagtggactgtgctcaagaatcaaatacaacaatgtcaaaaatttgtctgacacaacaaagaaatggactacctgaaatagtatatatagtccctaagagttttaaaatagatggtggatggtaataaattgaatttctgcgttcttagaaagggtgattcagagataccccaattctaagagtcactgacactgaatgtcaagtattttttgtggcttcagaaatttctgataaatgcattttttcagagtgttgttgtatcataactttgctgtagagcaaaccacttcaaacttagtgatctataaaaataaacatttatggccgggcgtggtggctcacgcctgtaatcccagcactttgggaggccaaggtgggcagatcacaaggtcaggagatcgagaccatcctggctaacatggtgaaaccctgtctctactaaaaatacaaaaaattagccaggcgtggtggcaggcgcctgtagtccccagctactcaggaagctgaggcaggagagtggcatgaacctgggaggtagagcttgcagtgagcctagatcacgccactgcactccagcctgggtgaagagtgagactccgtctcaaaaaatatatataaaataaaaaataaataaacttttattgcttgctcatgagtctataggccagcttaggtttggctgatctagcaatgggttcagtaccatttgctccagatgtctctcatcttccttgaaataacaactattctgaggcgtgttcttctcatggtaagagggcaagagaagggagtaactacagccatgcaggtacatagcaagtccctgttcatatcacattcaataacaccccagtagccaggcaaatcatatggccaaacccgaaagggaaaaggtagacactgctcactatgaggccaaggcaagtattcaggtgtatattaataccatgggggagtcaggaactggggggcaataattccttcttccacacctgtgatgttgcagactgttgctggagtgtagtcttctttctgttagttgaggggattgtttttttgatctagctgtaacccctgatgagtgatgtacctcttagtaaattgtgggcaaacataaggaaaaaggacctctttagtaaatgagccttctaagattcagtcgtgtggtgaaataactaaactgagtggaggacaaagaagtcacagaaccaatccttcaaatccagcccgcagcagcagaggtgtaaacagttactatctaatgtccactccggggtctacctgaattgaattgttggtttccttccaattctcaatgattttctggccattttcatagaaaccatcaatgtaactgatacttctggtttcaaataatatgctagatcaaaagcataaattaccttgaaaatgtgaccatttttctagctctccttggctatcaataaataatactcaaattgctctaaattgttggattgagtttaggagacaaaggccagcagtaactgagatgattaacatgaattgggataaaactccctcttcagttttcatctaacagaatgcaggtcttcagagaatgattgtcttttctagcataatactcatctacctcctgaagggctgggagcttagaattctttctcactctcagtacttcttagagaaacccagaagagtccagtgagaatggtttccctgtttggctgattttctgggaggcagaatggctcaggggttagatgccattctgggatctatggctggattcaaacttggctgcacacctgggtagctgtgtgaccctgcgaaagttgcaaaggttggttaacctctgcagttgtccctgatgttgatcacagatcttcagttcccctttcctcctgtcacccagaggactgagtccctggctcctttgtggttgggtggtgctatgtgaccagttctggccaaggattgtgagcaaacatgctctatgtaacttctggattacactatttaatacccagtgagaaactctccagaattctctcttgtccccctggcacattgaccagcaacatgcaaggtgatgtaactccaatgagtagggttcccttgttgacctacactagacatgtagcatgacagagaaataacctttgtgctaagccactgacatttggggggttatttgctgccataacttaatccaccctaccctgattgatgcacctcactatatctttgtttctttatgtgaaaaaatggagataatagtagaatctatttcatcaagtaattatgaggactaaacaggataatgtgtgtataatacttagaatagtacctagcacataataaatttttaatatattttagctatttatgatgatgatgatgatgttatgccgtgctctaactttgcctctaacaagttatctatttctatcaaacaagttattagtcatgtgtcttcaagaaaatcacttatcatcaagttgcaatcatagtatgttagaataagtgagctgtaagactaatttctagccttatgatgtgagcctctattaagaactcactcagagactccatcctggtgtttcaaagatatttctattggttaggaaaataaaacgtgataatactaaacattattttctccccttcagttgctctcccttccccaaacaaaaagatgtatccttattacagaattctttctgtatcctgttctgaagatttctgctcaggaaattactctggctcgtaaattattaactacaaattggttttccggtttaggcacctacaccctcatcagtccatccccattctctgttctgttttcaccagtaggatgtcaacagtccactatgatcttttttcctgatagcatggtcttaccaaaaggagaagttcctgtccttgaccaccttagtccaggctaaaatagctatccacataccaccactcatgaccactgagacctgttttccaacttcttcagatcagagctttccatatctggtttttctctcatgttactctagatgtatccttctctagtcccaaaggtagccctgtctgcaattcccaatagcagcatgttaatctatgttaacatattatattgaaccataagaaattgcctttgtggaaggggtgggggttgaatatagaaatttcatatggttcaacctatatgtaaacccaatttggaaaagaaggagactgtgatcacatacctattaaattacatgttggatcccatcaagaatcctaatgtatttcttcctccataccttgttgaactgggatcttgttccaggacatgacttatgctctgtatataaccttcagacctccctatacccagcacttggtagatagcagatactgatgctgtatttattgaccaactagatgggagctttttgtgatatctattgttgacatccatgtttatacatttgggctgtttaaaaaggtaccatttataattacattatgggagaaaataacacttcttttctttaacctctttcagattgaagacatcattacaaagatgcaagatgacaagacagggggtgtgcccatcagaacagtcaagagctttctctccaaaatccccagtgtcgtcacaggtaacaccctccttgcaaggtgttggtaacagtcagaactaccaaagagttataagtctagattgcggcctgaggggtgtctgaagatctgtgaatagtaaaaatgaaacattcagtgtgtttcttgactcaggtcccatcctagtcttagtttccaggaagaagctacttgttgcccatcattaagaatgaccttaccatgaccagcccttcaagtgcatgtagattgaggctgctgggaataaataaacccattaataaagtggcgcatcagcaactttgcctgtgggatacacacaagcacagaaatattaaagaaattaaacaggtttttaagaaagtgttatattcaaattctacaaaatgcttttattttcagttttttaactcagtgtacttgacctcctgaaagagaggttttaaactatttttcttcattccttatattgtgctttgtgtgctcatctttcttttaaaatattttattgtgaaatatattaaaacacatgggtagttcaaaaataataaaacacagtacatgtacctaccatcctgccttataaagaacattattatcaatatcttagagcccccttgggtacctactgtattgcatccacttccctaaacactatctgcttgtatactaatcaattcattgtttttcttcatagttttactacctaggtatgtatcttttgctatccaaacaagtaaccaaataaattaagataaaattttagatgattctcttaatctgcctatatgcttttcaaaattcgggaaccaaaggacttagttttcactatataccttttagaatggctaaaaataaaaatattgacagtaccaagtggtggtgagcatgtgaagcaactggaactctcacatattggtgatacgaatggaaaattgtgcagctactttgggaactagtttggcagtttcttacacagttaagcaatgcttaccatatgaaccagcaatcccactcctgggtattcacccaagagcaatgaaaacttgtgtttatacaaaaacttgtatgtaagggtttatagcaacttttattgaagtatactgaagaatatagcaactttattcatcatctccaaagactggaaacaacccaaatgtccttcagtgaacgggtaaatggataaacaaactgtagtctctccacaatcagcaacaaaaaccagggaactattgatactggtagcaacttggattaatctctaggtcatttttctgagtgaaagaagcagtctcaaaggttacatgctatgtgatttcaggtatacagcattgtatacatcacaaaaccgtagtgataaagattagatcagtggtttccagcaactggcatttgcagggcgagtgtgactgcaaaagacaacaggagggagttttatgagatgatgatgatgaacagatgaacagttctgtatactgattatggtgatggtaacatgactctatacataggccaaaattcatggaacaggccaggcatgatggctcatgcctgtaatcccagcactttaggaggctgaggtagggggatcacctgaggtcagggggttgagaccaccttggccaacatggcaaaaccccatctttactaaaaaatacaaaaattagccgggcgtagtggtgcgtgcctgtagtcccagctacttgggagactgaggcaggagaatcacttgaacctgggaggtagaggttgcagtgagctgagatcgtgccactgcactccagcctgggtaacagagcgagactctgtctcagcaacaacaacaacaacaacagaattcatggaacagcacacacacacacgcacacacagggtcaatattactgtatattaacctaaaaaataagtagacccagttgaagtaagtatcccagctcattattgagactgtcactctttgaactcaggtactgtcttactcagctcaggctgctagaacaaagcaccctacactgggtggcttataaagaacagaaattcatgtctcacagttctggaggctggaagtctgagatcaggtaccatcataggttctggtaagagcccattccaggttgtagactgctgacttcttcttgtatccttgtttggtggaaagaaagctagatagggggccgggtgccgtgactcatgcctataatcccagcactttgggaggctgaggtgggtggatcacctgaggtcaggagtttgagagcagcctggccaacatggcaaaaccctgtctctactaaaaatacaaaaaaaaaaaaaaaatagctgggtgtggtggcacgtgcttgtagtcccagctacttgggaggctgaggcaggaaaatcacttgaactgtggaggttgcagtgagcagaggtcacgccactgcactccagcatgggcaacagagtgagactccatctcaaaaaaaaaagtaagctaaatagctctctggcctctctgtaaagggtaataattccatttgtgaggggccctccttcataaactcccccaaaggactcctaatgccatcatgttggggattagatttcaatatatgaatttggaggagacacgttcagtccaaaatagagcccagatagatttgggtaatgaaggatacttgtattgttagtgttctctaattttaaaatttatgtaaatgaaattttactatatatattattcatgtataatatacagtataatatagactatgtatgtaattttactatattatttttcacattcctggattttgttcaataatgtttaagatgtttgtatctatttcacaggccacactgatctgttgtttttcttaccattgttgctggtttgggtatcaaatttatgctagcctcataaatgagccatgaagtatctctcttttcttgatatcctgcttttctttgaaaaataattgtccctttaatccaggttttaagtatgtaatttcaattattttttatttttaaaatttcctctggttctttttttttttttagacagagtcttgctcttgtcacccaggctggagtgcagtggcatgatctcagctcactgaaacccccacctcctgggttcaagcgattctcctgtctcagcctcctgagtagctgggattacaggcatccgccaccacacctggctaattttttgtatttttagtagagacagggtttcaccatgttgcccaggctggtctcgaactcttgaccttaggtgatccgcccaccttggcctcccaaagtactctggttctttttacaatatacttggtcattcatttttttaaatttattcatttagatatttattgagtgttcactattttctaagcattgttaaggacttgagattcagaagtaaatgaaacagataaaaagttctaccctcatggaatttatattctagtagaggaggaaataagtaaggaaaacttgcagaattttagattgtgataaaggccaaggagaaaaataaaatacacaaaaggatgggaagtgttggagtgttgcagctttggaataggtgctcaagaaagagctcctcgagaagatgacatttgagtaaagacggaaaggagatgagggattgaatcatatggatattgagggagagagcatgccagacagccagagctcagtgcccaaggcaagagagttcctggaacattgaggatctgtgaggaggagccagggcagctataatagagtcaagaaaataaggagagtggggatgaagccacgtgagaatggtgagcttgatcacttagcctcttatcactgcaggattttgcacatggcctgacatgctctgacttacctttcaatgagatcactctattatattcagaattccctgggggattgaggggttaggtgccagataggaggctattattaaaatggtgcctcagactaggtgatatggtttcactctgtgtccctacccaaatcgcatctcaaattataatccccacatggcaagggagggacctggtggtaggtgattagctcatggggaaggttctcccgtgctgttctcataatagcgagtgagttctcacaagatctgatggtttaaaagtgtggcacttccccctgctctctctctctcctgccgctatgtaagacatgccttttttcccctttaccttctgccaggattgtaagtttcctgaggcctccgcagccatgtaattaactgtgagtcaattaagcttctttcctttataaattacccagtctcagatcattctttataacagtgtgaaaatggactaatacactaagctatcagcactggagatgtgtgaagtagtcagattcggattcaagtctgaaggtagatgatatggtttggccaagtccccacccaaatctcatcttgaattgtataatagttcccataattcccacatatcatggaagggacctggtgggaggtaattgaatcatgggggcagttacctctatgctgttctcatgatggtgagtgagttctaatgagatctgatgatttcataaggggcttttccctgtctttgctctgcacttctccttgctgcttccatgtgaagacaatgtatttgcttcactttctgccatgattgtaagtttcctcagccgtgctgaactgtgagtcaattaaacatatgtcctttataaattacccaatcttgggtatgtctttattagcagcatgagaatggactaataccgtaaattgttactaggtagtggggcactgctgtaaagatacttgaaaatgtggaagcagccaggcgcggtggctcatgcctgtaatcccagcactttgggaggccatggcaggtggatcatttgaggtcgggagttcaagaccagcctggccaacatggtgaagccctgtctctactaaaagtacaaaaattagctcagtggtagtggcacgcacctgtaatcccagctacttgggaggctgaggcaggagaatcacttgagcccaggcagcagaggttgtggtgagctgagatcacaccactgcattccagtctgtgagaccctgtctcagaaaaaaaaaaaaaatagaaaatatggaagtgactttggaacatgggtgacaggcagaggaaggaacagtttgaagggctcagaagaagacaagaatatgggggaaagtttggaacttcctagagacttggagggcttagaagacaggaagatgtgggaaagtttagaacttcctagagacctgttgaatgactttgaccaaaatactgatagtgatatggacaataaagtccaggctgaggtagtctcagatggagatgagaaacttgttaggaactggagcaaagataaccctcgttatgctgtagcaaagtcaggtggcattttggccctgccctagagatttgtgaaactttgaacttgagagagatgatttaggatatctggcagaaaaacatttctaagtgcagagtgttcaagaggtgacatttgacatctctggacacaagagagcataaaagtttggaaaatttgcagcctgacgaaccagtagaaaagaaaaacacattttctggggagaaattcaagctggctgcagaaatttgcataagtaaggaggaaccaaatgttaattgccaagacagtggggaaaatgtctccagggcatgtcacagaccttcaaggcagcacctcccaccacaggcccagagacctaagaggaaaaaatgtttatttttcctcttaggtccagggccccactgctgtgtgcagcctagggacttaatgccctgtgtcccagctgctccagctatagttaaaaggggtcaaggtacagctcgggccatggcttcagagggtgcaagcctccagccttggcagcttccacatggtgtttgtcttctgggtgtgcagaagacaagaactgaggtttgggaacctccatcttgatttcaaaggatatatagaaacacctggatgtccaggcagaggtgtgctgcaggggcagagccctcatggagagcctctgctagaacagtgcagaagggaaatgtggggttggagtccccacacagagtccccactggggcactgcctagaggagctgtaagaagagggccactgtcctccagactccagaatggtaggtccacccccagcttgcactgtgcaactggaaaagctgcagacactaaacaccagctgtgcaagcagccaggaaggaggctgtaccctgcaaagctaccgggtcagagctgcccaagatagtgggagcccacctcttgcatcagcataacatgggtgtgagacatgaagtaaaaggagattatttcataactttaagatttaattagttacctattggatttcagacttgcatggggcctgtagcccctttgttttggtgaatttctcccatttagaacaggtatatttacccagtgcctgtacccacattgcatttaggaagtaactagcttgcttttgattttacaggctcataggtggaagggacttgcttagtctcagatgagattttggacttggacttttgggttaatgctggaatgaattaagattttgggggactgttgggaaggcatcattgtgttttgaaatgtgaggatatgagatttgggaggggctggggtagaatgatatggtttggacatgtccccacccaaatctcatcttgatttgtaattcccatagtccccatgagtcttgggaaggatgcagtgggaggtaattgaatcatgggttggttacctccatgctttcctcatgatagtgagtgagttctcatgagatctgatagttttataacgggcttttcctctacctcactcttcacatctccttgctgctgccatgtgaagaaggatgtgtttgctttcctttctgccatgattgtaagtttactgaggcctttccagccatgctgtactgtctgtcaattaaacctcttttctttatttcccagtttcatgtatgtctttattagcagcatgagaaccgactaatagagtagaacagatattattagcggatagatcagatatggaatgtgagaggaaaaaaaggaattagccatgatccacactttttggcttcagcaactggaaaaatggagttgctattaatttcaatgaggaatactataataggggtgccaggggttggggtggggggcagttgttagctgaagggtaagaaatcaaaacacaaattttaggtcaagttttagcgacctattagacattcagttggagatgacaagtaagtattccagtatgtggatttggattttaagggagtgtctgtgctgggttcataagccatcagcatgtagacagtatttagagccataggaataatgaggtcaccaagggagtgagtgtagatagaacacacagtccaattcctaaaacacagggtactccaatctatagatgtgagggagagaataagaaaacagcaaaagaaatagaacaagtggctggagacaaggaggaaaaatcaagaggatataatttcttggacaccaatttttctagaaagtgttttaaggaagagtagagtgacctactatagctatgctgagaagctaagggctgagaattgatcattgcctttagcaatgctgaattcattgctgaccttggtaagtgcacattctgtgaaacattgggagcaaaaatccttattgggtgtgtccaacctgagatgaggagagtgattcgaggtgctaagacagttaatcttggaaggagtttcccttgtaaaatgaagaaatgcagtcatatctagaggggtacgttaggtcagaacaggtagatttttaatttaataaaaagataatatgtttgtattatagaaatgactcagtgggggtgggggagatgatgtaggagaatgggaaaacttcaaggagttatatcaaagaataggtaagagaggattgaatttaacatgcatattggtgagtagtttcagctagaaacacatacaatttattcatagaaagaagaaaggaggcagccgggcacagtggctcaggcctctaatcccagcactttgggaggctgaggtaggcagatcacaaggtcaggaaatcaagaccatcctggctaacacggtgaaaccccgtctctactaaaaatacaaaaaaattagctgggtgtggtggcgggcacctgtagtcccagctactcgggaggctgaggcaggagaatggcatgaacccaggaggcagagcttgcagtgagccaagatcacgccactgcactccagcctgggtgacagagtgagactctgtctcaaacaaacaaacaaaacaaaacaaaaaaggaagaaaggaggcataatagatgcacagaggtacaaataagtgggcagatgtgatgggaggtggtggaagcttatagatcttctcattgtctctatgttcctagtaatctggaaaccaaaaatggtagagattttgcaagttcaaggagagatcataagttataaattagtcaactaggaaagtagagattgactggactagggaaatagaactttgattgtgactgatatggtttggctctgtgtccccactctgatttcatctcaaattgtaatccccataatccgcacatgtcgagggagatacctggtaagaggtgattggatcgtgggggtggtttcctccatgctattctcatgatagtgagcaagctctcacgaggtctgatggtttttataagtgtttgacagtttcttcttcacagactctcttgcctgctgccatttaagacatgcgtgcttcccttttcgccatgattgtaagtttcctgaggtctccctagccatacggaactgtgattcaatcaaacctctttttttttttttttttttcataaattacccagtcttgggtatatccttatagcagtgtgagaatgtactaatacagtgaccttcttaggatgattaatatttttgaatttaaagacaggtaatttttttccccatccacatttagctctgtggatttgggcatgcctcaggtagaaagtggacttaattgatgttatagcaagtttgaggttataatagatcaagacagaggcacagtaactaaaatgattgcccattacatttaattgagtaaggatgaaaacaagaacatgagatggatgaggaaccatgaagagtagtaattaccacaaattgtaagtcaagtggcaaagaaattttggagttttcagaggcaagagtaagagagctgaaaatatagtagatggtgattagatggtggcatgtttgaaattgagattctggaaagattgtgattattggcagggacaataatataagatataaccataggaacaaggcattgaaatgggataaagtgtaagatttttggaggagaggaggttaaggaactgagaggccatgatactggaagactgagctgtgtgaatattgaaatcactactgggggagtgttagagaaggtggttgtgagttaaaatctttatggaatgagaagcaaaggaccagggatcagcagatgactttcacaataagaggtacaggtggtttaatcagatggtatgggagtcaaagctgagtgtgttttagagaagagggaggggatgaaggtgatctgaaagcagcagttagtagcaggacagtcacttatctacctgtaaaccccatggtatataaagtgtgggagggaaaatagccaccacgtaagagggctgcagggaagcaggaccactggggaagaatgagaagatgaaaggaatattaactgattttatttatgattcatcatgagtccaagagggcaagtggaagggtttcaggaggagatggtgagtttatgacttgagtaataaatgcctgctgttgctatgtgccaggctctagagtagtcacagacgatataaagatgaacaaagacttgacccctgctcttaaaaagctattaatctagtgagagaaacagacacaggtagatcaatgatttatatgagctatgtgccataatagaagaatggacaaaatgctgtttgagtccaggagagagaatcatgaatttttattgggtatgtctagaatatttctctgagaaggtatatcagttatctatttctgtataacaaacccacaaactataattgcttacaactacagtgatttattgtttcttatgattatgattccatgaaccggcaatctgggcagttctgctggtctcagccatgaggccatagtcatctgatggctcaactgaggctggagggtctacagtggcctcactcatttgtttggccttggtgcttactcttaaactcttaactggggtctcagttcttctccatgtcaccttgtatctgccaataggttagattgggcttcttcacagcctcttggtcttagggttccaagcaggacaggataaaaactgcaagacctcttagggcctaggctccagaactcatacaatgtcaagtgtgccacgtcacgttcttcaaggcaaattacaaggcaaagtctggattgaagaggatggagaaaccaactccacctcctggtgtaggagtggcaacatcatgttgacattgggagacacgattcattggagggcattaccataacaatctaccacagacaataattgagaaccggaccttaaacataagtggaaacccaggaaaagtcattccacgtagagaaaatagaattttcatagcctcaaatacatgacaaacatgccaggtttcagtaagtataagcttgtttgtgtggttggagtttaaaacacatttatgtgtgtatgtatttgagaagaggagcatattggcagaacagccacaggaatgaaaaggatacaagaattacacctaataatatattataaaggaaagctgacttgtagactttgttccaaaggtggggctgcttttatctcaaaggtaacccatctaccctgctcagatggactgccgtcagaggttttaaatatgagggaattcacatccatgaagtggatggaagtttaagcaggaagaaatgaggagtgtggagactagttatggagtctagatgagggaatgtatgtgagaaataaggccatattaacgacaaccacagcatcaactgaaaccatggctgtacagccacgcatcattaaatacttataaaaaccccatgagatagaaaccgttattatctctaccaagtaatggaggaaactgctaattcaagagtaacttttccaaggtcacaccactagtaaatagcaggatctgttcctctgggccacccgtgtaaggatggtagcagtagggttcaaaagatcagaggaaacagtagaaggtatgattgacacaacctgctgacttgaaatagagcagagggtaactcatccaaaatggatacaccttaatatcatggattgaatacattcatttaactttttctcttctgaaaccccacaaaaattatagtaaaagatttttattttaaaagcatgatctaaaagttggaggcctctattacagtgatctaccatgggaaataaacatccttaaaaatcttgaaaagatagtccagtacaaagggcagtcagtgcctcactctcaagatgtgcagatgtgtgaaagactcatggagaatagtcttccaacacaggagacaatagccacaaaactcaagaatctgaaaaacaaatggatgagtggtaactgacaatagccctgaaacaatctaaccatcacttgtcagtggacaaggctaaaaaaaaaaaaaaaaaaaaaaaaaaactctatatttatatgatggagttctcaatgggctcagaaactggtaacatcagcagacttttctatctagttagaatacattttgccaacactctcacctacttaactactgcacagaccaatcactagctagtgtctattgtttagcaatatcagatcctgcacttggccagcacagctcaggctggtgttgaggtggttcctaagaccagtcaagccccaggacagaagacaaatctcatgcttacctctagttgctggcactagagtagagaattacatagagaaaaaacccaggtcactgagacccatgggtaccaaacttaaagttgaaacgcattaatacatggccaccctgttactgtggcaagagaagctgtatctacatgggacagtaatcagcccacacttcagcctttccaccagctcagcagcctccatcagactttctagccatttgagaaatagccagtttcccatcacaaaccagcagataccagcagatactccaacattggagcttccatttcaacagcaacagctgggggaataactttttctcttctctattgggaccccagttctttaataaaaattgaaagtaaagatgaaagaataatggacattataaggctggttaatcagcagtgtctttatttcttgcactgctacataacgtactgtccatacctacatgtgactttgctaaataaacagcaagtgatttcaatggaagaaggcaagaagatggagaccaatggcacgatgatgacagtctgctggtgaaagcttctttccaaagatgatattgatgaggaatgcatgagcatgtcccagtgcatccaagactctgtcactctcagaagctctgggaagctgcttgtcaccactttctcagcaacacagtgaaagtcagagaataatgttgataaaaagtagtatcttgctgcaaggcccgtctctacactgtcaagttaccacattgagttgaaaattttgccaacatatccagatcatcccaaaggcgaaaagagaagcaactgttaatgacctacaccaaataaatcaacaaacacatagcaatatgcggatgtgtacctttgtagtggatcaaatgagcctggacaagaaactctaaatggaaagttttagagcataaagagaacattctagaaaaagaatgtacttgccaaaaaagtcaaaactgagataaaggaaaaattgtagacctggggaatgtgaatttggaaaaataatttatgggtactgaggatagagataacaggggaggtatagctataagcagagcagaaaattgatatccagttttccagaattcacaggtgacatagaagggaaccattgtaccaagtgatacacaaagatcagagttgaagagatgtgatttcgtccacgagtccctttaaagctggctttgtggtgtgtttgtttacaaccttcctaaggtgtcgatgtctaccagttggaacagtgacacaagagatggtaggcatttcttgactttccatctcacaaattaaatttgtttggtgaattcctgaaggatccatacagagcctggactgaaagcacctgtttcgatcttatgtgctgaaagcaaaaccttttctcatcaaatgtttctcttctttgtctttctggctttcatatgtgtgatctaacttcattggttacatctttattaataataaatatctaataaaaatgttaataaatttaaataaatacattgaataaaaataacctatattcatctaacctgttttgggtaaaggaggttcctatacccaagataaggacttgaggaagttatgggtttgggagagaagacacaagatcagtcttgattatgctaagcttgaggttttgaagggttatttgggtagcactgtttaggagaaacttggaagtgaggagccaaagtcctggagaacattttatgtaagagatatgtatggatttgggagtcatcagagtctgagtgacccgggactccagggtcatgactgggaactataattttcacatcttcttctataagccatgtattagtctatctgctacccagccttgagataacatgctcacccaccccacatcttctatgattttgagtttgaaattttcccaccaatatgtaagggaaattatcttccctgctcagatcaggacaaactcataggtgaattcacaggtattgctgggatgaagagggagaaggaatgcctgttggttcacctgtgggttcgaaatgttgggattgggaaggttggcccagggagtaaatgcactgagttaggggatagatatgtttgggagaaggccaaacacaagagataaccattagaatataatctctgtcttagaaagtgaaaaattaagagctgtaaggggtgaggtttagcaaataaatatttctgagcaaaaatagagaattggagagagaaggaaatacggaagaaagaagaacccaacatcagatcaaagtccaaggctcattggctttttgcaggggaagtcacatacaaaccatctcatcttccagaagcttaagatttctgagcaaggtgcccacagaaagggtacttcagagccaccctaccaatcccttttcaggactacagaccaacctcctcagaccctctttgaatagtaagtaggtaacaaagatgatcactggagccaagatggtgagtcttcggagtttccaacctcagcgtgccagctctatccacgccccacctgccctgcaggtgatagacatatcctgggcagaatgcctgccagccccaggaaagcagccagattgtgcagctttgcccagctgtcatagacagtcattccaggataattctccatcacctgaatgtcatgaagaattttccagggactttggagatttatttcttccagaccaccctcagaaacacaaattcctagcatgtaagagccataagatgcatctagtctcacttattcttgcagtcaggaagattgagtaccagagacatgatgtaatgtcctcaaaaatcacagttaaggacagaaccaagactggaatctggattcctcactaccattgcaaactgttcccatgatctcatgcacaaaattatagactcttggattgcagcagtttcttaaaggtgtttgatgcgttctccctgaacatgagaatcacttgtgtaacttgttaaaaatagatttccaggacatccccatgggtctggactcgggatcctctattttcagcagcttctcatatttatctcctacagcctgtatgaatttgggaatgtgtaagacccctacagagtgctctctagcctctgttttaacaatctgcaatgatggatgtcatctctccttccatctttggacaactttgaccttgagaaacttttttttttgtaataaacctaccagcctcctcttgcttcactgcattagtcccaattctacctctgtatcacaaagaatagaggaatggatttgattaaaattatgcccacctagctcttccttatgaaattttcttgcacaaataattttcagaaaatatccaaggtatatacatgcatttttattttacttaacacatttttttatgaatacatttctgtcttttcattatccacaaatttatttttaatagctttatgtttacctaaacatttaaaagtattattcttacagtttcttggcaatacagtttggagtctaggctccaaacagcctatgtgacctgggttggtcactgtgtgaccttgagctagtcaccaacctctttgggcctcagttttctcacctgttaattgataggtttggattaaatgatatttgtagtccattctgactctgatcttctgagattcttcacaggatatgtataaaggcctgtctgaagttaattcttttcactttttctcacgatgttctaactgaatctacctctgagttaatttaggccaccagttttgtcttaagatgtgtgtctcagtctgtcttctgctgttgtaacagaatgccacagactgggcaaagaagagagaaatgtatttctcacagttttagggtctgggaagtccaaaagcatggtgccagcatctaatgagggatatcccatggcagtaggcagaaaatggaaggtgcatgtgtgtgaactggggatggggggtgcaaactcagcctttttattgggaacccactccttggatagctaacccactcctaggataactgcattaattcattctgtagttaatgcttctcactttttctcaagatgttctaactgaatctacctcatggaaccctcatgatctagtcattcattaatgatcccatctcttaatattgttactgtggtaattaaatttcaagatgagttttggaggggacatccaaaccattgcactgtggtacttccagattagaaaaccaaagaacaagaaacagcctctgttttaataacgtgcgatgatggatggcatcatcactcattccatctttggacaactttgacctttagaaactttttttataatgaacttccctgcctccctcttgcttcaattcattcatcccaattctatctctttctcacaaatagagaaatagatttcccaaattagtaattccctgagaattgcccaaagttaatcagtattcttagtctttgttactcttcttctgcttctgtatcactggaaggaagaactttaaaaatgcctcaaaatagagataatttgttggatgcatgtagagggctgaataatggccccccaaaatatcagcttctagttctttacatctgtaaacatttgttgataaagggtctttgaaggtatggttacattaagtatcttcatatgggtaggttattctagatcagggtgtctaatcttttgacttccctgggccacactggaagaagaattctcttgggccacacataaaatgcactaacactaacgatagctgatgaactagaaaaaaaaatcacacacacacacaaaaatctcataatgttttaagaaaattgactaatttgtgttaggctacattcaaagccatcctgagccacatgtggcccatgggccatgggttggacaagcttgtcctagattatctgggtgtgccctaaatacaatgacatgtatccttacaaatgagagtctgaggaaaatttagtatagaaagaagaggagaaggccatatggcctcagaggcagagattagaatgatgtggccagaagccaaggatgccagcagccaccagaagattccttagcacctccagagcaagtatggccctgccatcaccttgattgtggcctggtgaaaccaactgtggacttctggcctccagaactgtgagataataaatttctcttgttttaagccacaaagtttgtggtgatttgttgcagcagccatagaaaactaatacagtgccaaaattacactaagcacattatagtttaaagtagatgacacaatgattttttttagaaaaattgtgattcattaactgaaaaaagaaacaagcaaaaatttagttttcttccaaagttttatttgaaaaaatatagattataatattaattttgaaagcaaattatactaacatgaacttatgtagtagaattatttaataagcattcagcttaaattgcttaataaagttataaattgtatttgtccaggtctaatgtagtttaaaatatcttttggatatcataactaatcatattatttccacgttcgtgatggaattaaatcaattagttataaaataaaatttattcttaattagtatgccaaaatttatacatacataaaataatctcttaaaatattcacttcgaaaagtggtatatttatttcagtaatgcttccattgctttgattttttcagatttttttctccagtaagagcttttagaacttgtttaaatatcctcaacagaagcaaagccatgaattcataaccatatatacatttatataatcaaaattgatttggagattctgctttggagaatggtagactagcctactcagaccaactgtctgaatgagaacaattacaaaatctggtaaaaaaaaaaaaaattcacttgatgtcactggagagttaacaagagaataaagagttactgggccaagattcatgctaacataaacatccatagatatgatggtggccttgggtgctgtttttgccctggggacatttggtaatccaagagagcacctgtcagacgatgcctttattaaggcccatggacattatctcctatgccataggggttgtggatttgctagtttaaagaaaacacatgcaaagatgagagcttatttacctgactctggtattgactattaggttttaccatggtcagcagctgtgggctgtgtcaggtttgggtcagggagatgaggaacaaggaggctacatcttaaccgcacggggaggggacgttttaacaaggccaaaggtgatgaggtacatcagggtaaacatgtgttaggcctaaaaatggatgtcaaggcagcaactatattaaacaaatttatgatgggcagtgattactgtttacctctaaggggcagggagtatattgtgattgggacagtacctgcaagagactaccagagtgttgaaaaaaaaattttttaacatcaatcatggtaacatgattaaaataatgtaaactgttcccacagtatttcttcttagcacttttctgtttgtataatatttcacaataaaaatagctttccttttcctttttccttttgttttacaaaaagtaatttgaagtcagttcggtgaataaagtctgtaattaaagagggaaatgccaattgtggtttaaataaggtgtgactctgggtaaatgaagtcagttttcttgttgtccttaaaagctgtttcataagtttatttccaaagagcatttccaaaaacatttgtagcacagccaatactgatggaaggaagggtgtggcttttttagggccaactctgaaaatgacagtgcttaattaaatattgattatgctgtggttgccttaacaaatgtaacttcactgtaacatgttttatttaaatgtatgaatttttcttcttatgggattcactttagtaacaacctcttaaaatcctgtcaacttataactgtgaaagcaaaggcatatctctgatgctcctggcctttgtgtcattaaaatcttactctaaatgtcgcattaattcatcttttcaacatttttccttgtttgatttttttctcctggaagaaaaaatgctaagtggaatgaaggaaggaaaagacaggcagtttattaaaagtcaaaatataccatacaaacccctaattgtactctaaaatttctttttaaacgtttctattaaaaaattctgggccgggcatggtggctcatgcctataatcgcagcacttttggaggccaaggcgggcggatcacctgaggttgggagttcgagaccagcctgactaacatggagaaaccccgtctctactaaagatacaaaattagccagtcatggtggcgcatgcctgtaatcctagctgctcaggaggctgaagcaggagaattgcttgaacctgggaggcagaggttgcagtgagccgagatcgcaccattgcactccagcctgggcaacaagagtgaaactccatctcaaaagaaattaattaaataaaacattctgtttccaataagataaaatttgagaagagaatgaaatccagatttagtgtagctgacccgggatcactgactcttttttagagaaggaactgggaaactgcagtggacatcatgctctggagcaacagtgactatggatttcactgtatcatcggtcgcagcatggaattctatacactaaaatcgctggatgagatgctggtgggaagaccctaacaaaatcgtgtttctgacagaaagtgtatacacattatgagcaaggagaacattagttttcagcttagctccttgtgcagttgaatttgttactctgttctgaagacattggtgccagataaaagctttaaacacaaaacgttgttactgacatgttaatataattatgccacgtattatatatacaaaactttaaaagctaaatttagaagttattgctgtatcatttatataggctttgttctccttaaacacgttgactttaataaggcatgttttgtacaaataaagtctaattctaccatcagttgcagccacaggaaatttgaagtcatttttatataaaatttaaattccaacacttaattcaggttctatgacaccattttctagatccaagaaggaaatcattggctcaggattttctacagcgatctatcctgtatgttcctcagataatatgcccctagaatattattttttataagaattaatggcagaaacatttgagcttatcactgatggcatttgttgactatcaaaattgtctaaaacctcccacatttatccaggtataaaagtaaacttctaggttgggtgtagggtaggttgggagtcaaaagaggacactctatagagtcacagttcataggttttcctaaagaacactttctaaatctaaatttttcctcccactaagccaaatgaggagggctccagggaaatcactggtgatgattaggggtcctacaagaagcagggtgttaaccttctcactgattggattcttgctgagctgttgaacccatagctcatccttgcttctgctgccagagaggaaaatatggaaaagttcatgggccatttgccagagtttgtggatgtatatgaactgagactcttgaggctaagaggctgcatggggcagcccacaccaaaaggcaaatagggcccatattgtagtgtgatgcttaaggagaaatatatggaacactgacctccccacccccaggatccctgtgactcttggagggtcaagggagcatcatcatggagacagaagacagagaaagagaggaaaagaggaagccgagcccacccttttcctgtctaggtcctctagacaaagctgtgaagggaaaaaaaatagaagataaaatgggatttaaattttaaactggactaaattgcaagtgaccagaaagctaaagggtctgctcaagatgtcataagggaaaagtaaaattatttcccattggtacctcatcgagttcatattgttcaagaaactggatataatacctagtgacaaagagactaggacttctgttttgttcttgtcatacagccaaatattgttctggtcacacagccataacaatacccattggggcagaacactgaactggtaagaaagtaagggaaatttttagaggccttaaaatagaaagtgagaattcaggaaagtagactcgttttagattagtcttttctcagaggacatctgtccatcctgggtagtctagggcatgaattttaaaagcctatatgagtatcaagtaaaaaaattgagtagggtggcagtcagttcagagactcctgaagagcaatacgattattagatgagtagggggagaaggctttagagaaggagatgatggaaataatcgttttgtctttggctattaataggtgaaagacaggagaaaaagtctccctagaaaattcctaattccaaattctaagtctattcttgttggcgtgtctcactaaaccccatgtggcccaaaaattcaagcaaaaatttaaattgtctttttttttcccccactcagtaaagatttaatgatgaaaaaatgcaagttttataatacaaatatataaaattatgaaaacaatttttataacaatcatttgatagtctttttttaaaagactacagaaagtttaaaatataattttgtaattatagatataaacaatgaagttttataaaattaatcatttgatatttttaaaaaggctatccaaaggaatttaaaatcagaatgttgttgaaactgaacaccaactgtatctacatttatttctttttttaaaatactttaagttctagggtacatgtgcacaacatgcaggtttgttacatatgtatacatgtgccatgttggtgtgctgcacccattaactcgtcatttatattaggtatttctcctaatgctatccctcccccctccccccaccccacgacaggccgtggtgtgggatgttccccttcctgtgtccatgtgttctcattgttcaattcctacctatgagtgagaacatgtggtgtttggttttctgtccctgcaatagtttgctgagaatgatggtttccagcttcatccatgtccctacaaaggacggcattattcacaatagcaaagagttggagccaaccctaatgtccatcaatgatagactggattaagaaaatgtggcacatatacaccatggaatactatgcagccataaaaaatttaaactttctctatttcagtactgcccccagctaccaggaagaagcaaacacatctcctctctggagaagcacacattaaatacagaacaaaaaaatttccagataaaaacaaaagtcactggaaacataagaaaacaaaacaacataaggataagtcagcaaagagcacaaatggcagaatccaacacataaagattgcagacattgtaattatattcagattatagaataattattagatcatacgaaattgccatttttataggtcaaagctggtaactatctgcagttccatatgcttaacataatgtttttaaagaaataagagagtactggaagtatgttgaagaaaagaggattaaggattctcaaaaaggactagaagctttgataagtagccaaatggaatctctgcaaatgaaaaatataattgaaattagagacttaatagaaacattaaacagcagatttgacacagctaaacaaagagttgataaactagaagataaagcagataaaagtactcagaatgtatcacggaaaggcagaaacaaataatatgaaagagaggttaaaagacttgaagaagagagtgataaattctaacatctaaccaaattttgagaagtaaataacagagaaaatgggaagagcaattcttccccattgtctttattatttccttccaaatttaaagatctaatagttgacagtttttctgagtggattaaaagcatcgggttccaaaagccaaaaaaattccaagcaggataaaatgaaaacaaatctatatctagctacattgatgtcaaatttcagaacactaaacacaaaaagaatcttcaaaatgactagagagggccagctgaggagacttcacctgtgttccaagcctgagaaacagcaccatgggccacccctggcagacacgtccctaggctggctgagcagctgtgcacccatgtcctgggcctgagaaagagccccacagactgctcctggcaagcatgcccccaggccagctgagaaaccatgtgcccctagacagagtaacagccctgtggtcccaaccccagtgagccagaccccaagaaagctgacccactgtgtgcagacatatgcctccaatctgagcaacagctcagcaagcccacctctggaaaagttgcaccgctaccagcacaaactgtctaagcctaggccactgagacattcataaatatcgctagtatggattacagcttaagaaactactggagactatactactgtgtctacccagaagcaaagccaatgcactgcattgagcccacaccccaacacccacataaatgaataaatcttttcctattaaacctactccataaaattggaagaggtgactgtttcatcagatgtgtagaaatcaatgtagggacacaataaacatgaaaaagcaaggaaacagacctccaaaggaacacaataattccctagtaataaaccccaatcataaggaaataaatgaaatgacagaaaaagaattcaaaataataattctaaacaaattcagtgaaatataagaaaatatattcaatgaaatcatgaaaacaataagtcattattttaatgagaaattcaacagagatagatatcatttaaaatgaaccaaattctatggctgaagaactcaatgagtgaaataaaaaatacaattgagaacttcaacaccagactagaccaagcagaatttgttcttacttgaagacaggtattttgaaataatacaggcaaacaaatagatgaaattaaataaataataaaaaggaattaagtcaaaggatttatgggatatcattaagtgaacaaatatttgcattgtggacattctggaagaagagaagggaaaaggtgcagaaaacatatttaatgaaataatacgtgaaaactttccaagtcttgggagaaagatccaggaagctcaaagaaccccaaatagatataatccccacaggtcctctctgaggcacattttagtcaaattgtcaaaagtcaaagacaaacagcaaaagaaaagcttcaagtcacatataaggtaatctccatcagattgatagcagatttctcatcagaaaccatgtaggccaggaaagaatagaatgataaagtcaaagtagtgaaagaaaaaaaataaaacttgccattcaatattatgcccagcaaagccattctttagaaatgaaggagaaataaaaattttcgcagacaagcaaaaattaagaaaattcatcaccactagaccaaccttacaagaaacgcttaagagagtcttacatctagaagcgaaaagacaataaccactgtcatgaaagcatgcagaactataaaacttattgatggagccaatacacaaaggagaaagaaaaagaatcagaccatatcactacagaaaaacacccaactgcaaaaataagagaggaagtaaggaacaaaggatatacaaaacaagtaaaaagaaatcgataggatgataaaagtcctcaccgatcaataataaccttgaatgtaaatagattaaaatctccatttagatgtagactgactgaacagattaaaaatacaagatacaatatacagcccacaagaaactcatctcacctataaagacacaaatagactgaaagtgaagtgatggaaaaagatactccatgcaaacagaaaccaaaagcaagcagagtagctgtacttatatcagacaaaacacacttcaagacaaaagctacaaaaagagacaagggcattatatgatgacgaagagattaattcagcaagagaatataacaattgtaaacatatacacttaacactagggcacctagatatataaagcaaatattattagatctaaagggagagatagactacaatacaataatagttggggactttaacaccccactctcagccttcgacagatcatctacacagaaaatcaacaaagaaacatcagatttaaactgcactatagaccaaataatataaacctaacgacatttacagaatatttcacccaatagctgcagaatatgcattttttttcatcagcacgtggaacattctccaggcttgaccgtatattaggacacaaaacaaatctcaaaaagcttttcaaaatcaaaattatggccaggcatggtgtaatcccagcactataatcccagcactttgggaagacaatgcaggaggattgtttgagcccaagagtttgagaccagcctggacaacatagtgaggctttgtctctacaaaagattaaaaaattaaccacccgtggtgctgcacacctgtggtcccagctactcaggcggctgaggtgggaggctctcttgagcccaagagggttgcagtaaggatgcagtgagccatgatcatgcctctgcactccatcctgggcaatagagtgagactctatctccaaaaaaatattgaaattttatcaagtatttaatctgaccgcaatggaataaaactggatatcagtaacaagagggacatttgaaactatacaaatacacaaaaagtaacctgctcctgagtgaccagtgagtgaaggaaaaaatttaaagtgaaatttaaaaattccttgaaacaaatgtaaatagaaacacaacataccaaaacgtacgggacacagcaaaagctatattacaggcaagtttatagcaataaattcctaggttgaaaaactaaaaagatttcaaatcatcaacttgagatgcatctccagaaaccagaaaactgagaacaaaccaatccaaagttagtaggaaagaaatgataaagatcagagcagaaatgaacaatattgaaactgaaggaaaaaatacaaaagatcaatgaaataaaaagttggttttggaaaagaaaaacaaaattttaaaaacctttagctacacaatgaaaaaaagagaagactcaaataaatcagaaatgaaaaaggaaacatcacaatgaataccacagaaatacaaaggatcgttagagactataatgaacaactccatgccagtaaatttaaaaacctagaggaaataaattcctgaacacatacaacctatcaagattgaaccaagaagaaatagaaaacctgaataggtcaataacaagtaataagattaaatcagtaataaaaagtttcccaaaaaagaaaagcccagaattggatggcttcactgctgaaatctaccaaacccttgaagaaaattaatgctaatttttcttaaactattccaaaaatttgaagtagaggaaatttttcctaactcattctatgagaccagtgtaactaactagataaggatgcaaccaaaaaatgaaaaaggttatacaggttaatatccttaatgaacatagacacaaaaatcctcaacaaaatacaaaccaaatccaacaacacatcaaaaagataatacaccatgatcaagtaggatttatctcatgaatgcaaggatgattcaacatatgcaaatcaataaatataatacatcacatccatagaatgaaacacaaaagttatgtgattgtctccaaagatggagaaaaagcattcaatacaattcaacatcccatcatgataaaaactctcaattaagatggtatagaaggaaagtaccttaacataataaaggccacatatgataaacccacagctaacatggtactgaatggggaaatctttaaagctttttcactaagaactggaaaaagacaaggatgcccactcttaccattcttattcaacatagtaatggaagccctagccagagcaattggcaaaaaaataaataaagggcatccaaattggaaaggaggaaatcaaattgtctctgtttgcaggcacatgaacttatatgtagaaaaacctaaaggctatatcaaaaaactcttagaactgataagtgaattcagtaaagttgcaggttacaaaatcaacatacaaagatcagtagtgtttctgtacttgaacaatgaactaatgaaaaagaaatcaaaaaggcaatcctacttacaatagttacatttaaaaaaaacctaggaataaacttaaccacagaaatgaaagacctttgtaaggaaaactacaaaacactgatgaaagaagttgaagaggatacaaatggaaagacatctcatgctcatggataagaagaattaacattgttaaaatgaccatactacccaaaacaaactatggattcaatgcaatctctaccaaaataatgatattcttcacagaaatagaaagaatcataaaaatgtacatggaaccacaaaagaccatgaatagccaaggcaatcctcagcgaaaagaacatagttagaggtatcacactgctagacttcaaaatatactacaaagctgtagtaaccaaaacagcatggtactgttataagaatagacacagagaccaatagagcagaagagaacccagaaattaatccacatatctatagccaactgatttttgacaaagatgtgaagaacactcactgaggcaaaacaaaacagtatcttaaataaatggtccccaaaaaatcagatatccatatacagaagaatgaaactagacgctcatctctcatcctatactaaagccaactcaaaatggatcaaagacctaaatgcaaaatctgaaaatataaaactagtacaagaaaacataggagaaatgcttcaggacattggcctgggaaaagattttatgaataagaccccactggcacagactacaaaagcaaaaataaacaaatgggattatatcaaactaaaaagcttctgtacagtaaaggaaacaagaatgagaagacatcttacagaatgagagaaaatatattcaaacttttcatctgacaggaggtcaatatccagaatatgcaaggaactcaaatatcttgacagcaaaaaaaaaaaaccgaacaatccaattttaaaatgggcaaataatctaaacaggcatttctcaaaagaagacatacaagtgaccaaaaaatacatgaaacaagtgttcaacatcatgaatcatcagggaaatgccaatcaaaaccacaatgaggtatcattttaccccagtcaggatggctattatcataaagacaaaaataacaaatgctggcaagaatgcagagaaaagggaacttatgcactgttgatggggatgtaaactagtagagccactatggagaacagtatggaggttcctcaaaacactaaaaatagaactactatagcatccagcaattccactactggacatttatgcaaagggaaggaaatcagtatatcaaagggacatctacacccccatgcttattgcagcactattatatagccaagatatggaatcaacctagggtgtccaacaatagatggatgaacaaagaaaatgtggtatgaatatataggtatatgtgacggaatactattaggctaaggaaaagaataaaatcctgtcatttgtggcaacatggatggaactggaggatattatgctaagtgaaataaggcagataccacatgttgtcactcatatgtggaagctaaaaaatattgatctcatagaagtagaaagtagagcagaggatactagaggttgagaagggtagagagggggagagagttgttaaaggatacaaaattacagatagaagtaagttctagtgctctatagcactgtagaataactctaattaacaataatatatagtttcaaatagctagatggagaatattgaatgttttcaacacaaaaaaagataaatgtttgagatgatagactatgctaattactccaatctgatcactatgcattatatgtatcaaaacatcactatgtaccccataaatatgtacaatttttacatcaattttttaaataaaataaaacaactagaaataaaagacagattgcctatcaaaaaacgactgacagctaacttctatgtaaaaatggacgctacaaggcagtagaagaccatctttcatgtgctctgataaaataacaattagaattctacatgtaatgaaactatctttcaacaagagcaaaattatcatgcaaaagaagtgaaaggaatgtatcactaccctatctttaccaaagaaatgtctacaaaatatattttaggaagaagaaaaattatctcaggatgaaagtttgagatatcaaaaggaatgataaatactgtggtaagtggggcttaatctaaacaatcatggactgtataaagaaaaagcaataatatccactatgaggagttaataagaacccaagtgacttctaactactggaaaataagagcatgcaaattgggaaaggatataaacgtcctctattgttcggaaaaatggtaaagctacttagtagttttagactggtaagaacactcactggggcaaaaaaacagtgtcttaaaataaatgttgctgggaaaactggatatccagatgcagaagaatggcttcttaaaaagccattcttctgcatagctttttaagttgaaattaattaaagtcatgtagaatattaaaatttagtcacctgcattaataaaatttaaaacttatgctcatcaaaagatctattaaagtaaaaagaagccacaattggaagaagatatttgcagcacacaccaacaaagcattagaatcatgaatatataaaagacttctaaaaattgagaaaacaacaaacaatgccatagaaaaatgagcaaaaccatgaacaaacatttcatagaagagaaaatatacatgaccaataagcatacaacagttgctcaatgtcattaataatcatgaaaatgcaaattaattaaaactacagtgagatatcattttaattcactaaactggaaaaaattagactctgaccatgccaggtatgcacaagtgtgtggaacaaagggaatgctaatcgaatgctggtggaagtgtgcattcgcaaaccacattggaaaacgttgtggtgatgcctatggaagttgaactcttacatatttatgacttggcatctccactccaaggaatatattatagactagagaaacaattgtgcaagtgattgaagacactcatcttagcagcattgttcgtagcagcaaaattctggaataatccaggcatgacgtttggctctagaatggaaagagaaagcacattatagtcatatggtagaattatacaaatgaattagctataggctttaacaaggatacaattcaaaaacaatattcctgagaataagcacaggatatctcatgatcccaattatgtaaagtttaaaatcaggcaaaagtaagcattgtattatttagtgattcatgcatatttggttaaatggtaaaaatacatacttgaaaaggaggactaacttttgtggggaaagtagacaacaagaaatgtttaggtgtggaggtactcggtatcaatctcaaagtatactcataatgttttcttctttttactgggtggtgggtacctttattattttagaatacatctttatacttttacatatatgcttatgttgcattttgcaattaaaattttttcaagagtttacagttatataaacatatatactatatttacagccatgaaaaaattgtacatatatatatatatatatatatatatatatatatatacacacaaacacactagtatgtgtgtggatgggagagggagaaagattgattttaaaggaatataaaataaaggtgtatcacgaggtgggactaaatgaacacatttacttgcagaagatgaatttgactttactgtgcttttttggattgtgccgactcataaatctaactgggcttttagtagacaggagacgattgaacattattccatcttatgtattttcaaacagactgtattattttgggtgttgtgtgtctcacccacactgtcaagattctgtaaacctgcaacgtgatccattcggctgcgctctagttattatccaattatcatccattctgcttattaacaggcataaacagacagtatttctgcatggagctgataccctccattatgggtcaccggtcccgttcttaagtaggattgtgaaggaaaaaagcagagaacttcatcttcagtactaatttctctcacttaattccttctgttttactctttctcaagaatgggcatttatcctctactggtgaagaaagggcagagttgtaggagccatctacggtaaatgcaggctttcaaagggtggggggggacggtagagattttaaacgtaataataaaactgaacaaaatttgatctgctgtatgttatcactatgcaattctaaacagtgttagcatgaaaatattcctcccctagaaattattttgttgatctaagagtactgaattgctacagttacttttgcattgtaataatatatctgtaagcttcaaatcagcatattatattctacatggacgttaactcagagaaccaagagttgcacagggactgccagcacactcagtgacacacacacgttttgatcgtataataagtgcctaacagggtggaactgggcacagggcatgtctcagacctgtatggtacttttaaaaaaataagttaaaataaacactggggcatggtgatggaaaagatgaaaaaacagaacgtaagttatttcaatgttgtcactcggtgtggccacttggagtttatatttgcattttactgttgcatttgaaaattgttaaagtgaaagtgacaagtgcaagacacactctttttgtttggtaaatatacatttcagtccacacatgagaatagttattgaatgttagaagtatcttttaaaatgaaatgtatgttttttcctatcttttggttttaaaagtgaaagaaaaagaaattttagaaaatttaaccttatgttacttactagtataatttagtggttgcctaaattgtactgtttgcatacgtttcagttttattaaagatcacttattggctgttgtcagtaaagagaggatgttaaaaatgatgtgttctgagtgtcaaatccataggtgtactctgtgatcctcttttccgatcagttccccgagtgtcagtaggaaatctaaacagctaaggaccaagcacaggaggagatataaccaatggacttttaactgaggggacacggtttgcatattttttttatttttattttttattttttgagacagagtctcactctgtcacccaggctggagtgcagtggtgcaatcttgtctcactgcaatctccgcctcccggattcaagtaattctcctgcctcagcctcctgactagctgggattacaggcttccgccaccacacccagctaatttttgtattttttagtagagatggggtttcaccatcttggccaggctggtctcgaactcctgacctcctgatccacccatctcagcctcccaaagtgctgggattacaggcgtgagccatggtgcctggccggtttgcatatttgtaacggtgtctttagcacctgcccgtcatctttcctaaacttggtctgcttgagaacacaccttgcttgccatgtcgtttataggataattttccatgaatggaattatttgaatctcaaagattttgtcaaaaaatatattcaaagcttgggtgtaatagacattacacctgaaattacatcctttgcggttatctcaatgtactttaaaatgtttagacattatgctaaaaatatgttaaaagggggcgtcattttttcaatttctcttagggatcacacaaggaagaaaagtttttcaagactgctgatgtaaaatagtgttatcagacagtgttcacatttggagggattgttggtagccaagtctccttggtgtttcttgtgaaagaattcttgagaaagaaatatcaggcaattggggtatattccttaaacatatagtagggaatggggctggtgaatcagttctgaatgcctgttttcttctttaaaattccagccaatgatatgaagcccaggtatgtgggggccttttgatgacagtgagggtgagactaaggaagctgacctgccctgcccagggacacaaggctggctagcaacagagccaggacattagtcagtgtgtctggctctgaagcccccatgggggacactgtctcccatctcctttctcctgtgtttagccttgactttcaccttcaatgtcatgccagacaaagagttgctatggggcaagtgggaaaggcaaaactttttctgaactgctctttaatttgtcaatatagcccaaatctagttgcaatctggtacacttttagtcatgaacgagggtggaagaaagctaatatcacatgttgacctttcattttgccaccaagaagctctccttgaatattctgaaggagaacacgttcttgctgggggctggataaaccttaaaaatttcatgcccctgaatgagcatttcccctcatcacggacttgtccctggggctttcttaggcatgggcaggatgtggattgaaggaagaaacccagtgtcatgggcagcaaaggttgaatgtcttctgtgtctagtcctaacactgacttggagcccattcctcatcattttatcttactttctcccatctgaaaatatttacaaaatcatgtttgatgtcaaaatactaaatactatttggggggccgggtgtggtggctcacatctgtaatcctagcaatttgggaggctgaggcgggcagactgccagagctcaggagttcgagaccagcctggacaacacggtgaaaccctctctctactaaaatacaaaaaattagccaggcatggttttgcatgcttgtagtcccagttactcaggaggctgaggcaggagaatcacttgaaccctgaaggcggatgttgcagtgagccaagattgtgccactgcactccagcctgagcgacagagcgagactccatctcaaaataataataatagtatttggaggattttcccagagcatttgggaagcatttgtacacaaatgagtctgtgagcaaagggccaaggcaaggggcaggagctcagatgcaggctgtgttgatggggctcaaatccagagccccatgatccctatcccgtgctccactgcaccatcctattatcctattttgcattttatttttacattcctataaataaaaagtgcaatcaaataacttgaaatatggtattgcttttgtgcttaaaaataatctcagaaatacagcaaacatgccattcacttgaaattctaaaaaagggcaaaactatgttgacagaaaacagatcaatgatttcctggggtgctgggggtagcagtgggtaggaagagaattagctgtgaaagggcacttggaaactttttcagatgagagaactgctgtatcctgatggtgagggtggtttacacagctgtatacggttaccaacactcatcaaactgtgtgcttaaaacactgactatgcaatacctttatgcttatgtctttttataatttaaatagggagaaaaaatatgtattttgtaatatacatattaatacacattataagatatatataaatatcaataaataataccttatttggaaatagggtttttgcagatgtatataattaggcccaccctaaatccaatggctggtttccttataaaaaaaagggagagggggctgggcgcggtggctggcgcgcctaatcccagcactttgggaggccaaggtgggcggatcaccaggtcaggagatggagaccatcctggctaacacagcaaaaccccatctctactaaaaatacaaaaaattagccaggtatggtggcgggcgcctgtagtcccagctacctgggaggctgaggcaggagaatggcgtgaacccaggaggcagagcttgcagtgagccgagatcgcaccactggactccagcctgggtgacagagcgagactccatctcaaacaaaaaaaaaaaaggagagggatatttgagatacacagacacagagttatatattgtacattttacaaagaaaaaaatgtacatatatatgtatacctatatacgtatgacatccctttctattctgtcttccacaaatgtgagtataagtcttcacagtgggaagtaggaatgatcagagatggagtattagtttgccagcactgccgtaacaaggtcccacagaccagatggtttaaacaacaggaatttattatctcacagttctggaggctcagaatccaagatcatggtgggggcagggttggtttcttcggagacttctctccttggcttgtagatggccgccttctcactgagtctccacatcctcttccttctgtgtgtgtctgcatccaaacttcctcttcttgtggggacaccagtcatactggattcaggcataccctgatgacctcattttaacttattttcttctttgaggaccctatctctaaatccagtcacattctgaggtacatgggattaggactccacatatgaatttttggggggacacaattccacccataacagatggagaatagtgcttgaggtctttactaatttactcaccttggctctatttgaggttttctgccaggagcaggtattttataatttaaagtatacatatgggaaaacacacacacatacacatatatatatacacatatacacatatatatacacatatgtgtgtgcatatttcaaacaaggcagagatcatctgtgacccaaatatgtgctgatgagatcaatggactgtgctacttattggtcccataacatatcacttgtaacctctatctatgaccttccacgtcagtgcaataactaatacagccatcatacacagctgtgcaagagttaacattttattcttctgtgactgaacttctgtttcgagtcccccttttctcagagttgcatctcagttggtggggctgggggtgtctgtggtctcaggcagggaaggcaggcagctcttctggacctggccagagtacatggtcatttctccaggatggtctcccttagacagcctcattccctacctggccactcacatgtgttattgctgcaccctctgtcctgaccctcaggcttcttaagtttgactctgaagccgcactctctgggtttgaatcccagctctactcactatgggctctgtaccttggccacttcactttactttacttctttgtgctttgattacctcatctataaattagagctattcataatagtatctacttcatgtggctgttgggaggattaaatgagttagtatgtgaaaacatttgaaagcgtgtctgccccatagtaaaagctgtatactgtaagtgattcccattattagtagtagtagtagtattgttactgtgatgtcacatgcctcattggtgttttattttggggagcacataaagtactccatttgcctctcttagctgcaagagagaaattctcctgggttgtctcgggtccatgtgctggacccatatttctgctcctgcatcatgctgggaatacagattgtggagctggggtgcagggaggtgtatgactttgccagcttcctgtatttcccttgagaagtggagcggtgctaattgtccctgtcccggatgttccatcaactgtgtggtcccataccaacccctcaggggtgtctgcccaacccccaccccagctttctttccttctttacttagcatctactcctcaggagactgctttgcccagtatgccctaagataataaatgaccttctgagagtcaaatgccaggactcactcttggtctgtttgtcctcacccggctgctcccttgggggtaggccaggacacacactgggtgagaagcgtggtggaggaaaattatctgagttaatttatcaaaatacattattccccagtgacactagggaaaccttacagaggccccgccagcatcaaagagcaaggttctgtttcccatgttccgttacccgatccccagggcctgaaacagagtccagggaatatttggaaactaatcgtcatgagtggtagcatcctaagcagtaccattgtttacctcctaagatcccccaataattgtggttggctatttgttttctagtcatttagacacacacacaaaaattgtttttcaaatgagaaggggaatccacaacaaaaaactgtggctagcttattttcgagtttgaatgctttgtgtaaattaataaagttgaagtctatcccatgtgtataaaaatcttggagttatgttcattaatgagtctattgaattagttttcataaattcttctgattcaattgcatattcttaaattaacaacaaaagtccaacttgtatcattaaagactcaaaacagatggtgggaacagtaaagtgtaggaaagtgggaaaaatccttaaaaaataaacggttctttaaaataaatgaataccaaataaaacagaaaagtataaagagctatagttctttttttttttttttttttttaactgagacagagtctcgctctgtcacccaggatggagtgcagtggtgcgatctcagctcactgcaacctccgcttcccgggttgaagcgattttcctgtctcagcctcctgagtagctgggattacagatgcatgccaccacgcccagttaatttttgtatttttagtagagacggggttttgccatgttggccaggctggtcttgaactcctgacctcaggtgatctgcccacctcggcctcccaaagtgctgggattacaggcatgagccactgcacccggccgggagccatagttcttggtggaaagcaaagcttttcacatcagctagtgtagtgtctgaaaaagtcctcattatagatgggacaaaaagatttagtgggaagaagaaagagaacattgagacagttatgaaaagttttaattgtaaattttaattctcatgtgaaatgaaaattttgggatactttcacacacacacacacaaatgttatcctcagattaaaatatttatgtgggaaatgtttagaggtaaaatgtttagaggggaaaaaaccacttaccatgattgctgccagaaagggtaaaccttagaatcataatactgcagaatttaatgatcctttgtgagcttctggttcaacactcgttttacaagcaaagaaatggaggctcagagagattggttaggtgagccctgcaaggactcatggctaaatagtggtgaaatcagaagctaaagccaggttttctggcttttattccaggactgagatgtagtgacctgactctcgtaagtttctggcttcttccttttggagccacaggtaagcaccagtctagaaccttccactcagacttcatgctccagggttgtgaccagagcttacaagggtgttgtcctgggctggaagcagagactgtgaaactcaaatatacttaggcaaatgcaagcatatgaataaatcaccgaaatcaggacaaacagcttttcttagataaattgcccttggaaagaaaggtgaaaactaagccataatgcatgaatgtgttaattgtttttctcttctacagacactaatttattctgaagggaatgcttcatttccaaattctccttctactttaaagaaattcaaacttcaagaaaaaaattcaacaccatattgtgattgcttcaatagttaagaatttcggctgtcacgactgaaaaaaatcattagcaaaaactggccgtggaaaagggaagtctgtctagttcatgacaagcatccatcatcgtatgtgagttagtaatttctcacctctcatttgagagaggcaaggtacctgtgtgccattggggtgggctttccccgcagtgacagatccggatagatcaccagcctggctaagctccaagccttaaattcctttacttctcacccctgggccatttccgccacttttcctccatctcctttatccatttaacatctgttacatatatgtatatacacacacactttaagttctagggtacacatgcacaacgtgcaggtttgttacataggtttatatgtgccatgttggtttgctgcacccatcaactcgtcatttacattagttatttctcttaatactatctctcccctaggcctccaccccctgacaggccctggtgtgtgatgttcccctctctgtgtccttctgttctcattgttcaactcccacttatgagtgagaacatgcggtgtttcgttttctgtccttgtgatagtttgctgagaatgttagtttccagcttcatccatgtccctgcaaagggaatgaactcatccttttttatggctgcatagtattccatggtgtatatgtgccacattttctttatccagtctattattgacgtttaacatcttttatttatttttatgttttactttttgagacagggtctctgtcacccagactggagtacagtggtgcaatctcggctcactgtagcctctgtctcctaggttcaagtgattcttgtgcctcagcctctccagaggagactttgacaaatatatatatacacatacatacacaaatatatatatatatatttgtcacaaggatttgaccttatgcaattatgtttgctggttaagcagcctctgtgaggctgttgtctttacatctgaccatgagatgttggagcttgaagtccaagaggcaggtggtcagcagaggaagatggatatgaagtcgggagagcagggatgggctgggacccacaggcacacacagaacccatgaagacccaccggaactcaggtcagttatcgctgcctctctgggtgctatagttgtcctacaggatatgccggctcccatcatcacagacatacacacgcacctggcccaagagtcacagaagctgaaggaaaattcagggaaggtagagcagttgtgacttggctactgccccacccagcaacatgagccacagataaaacaggtgtgagctacagaatggctgccgcttccctgcctcctctgaatctcacatgtaagcatctcttgtggcccactctaacaagaaacattcaggaaaggagatctgggggagggggagcctctccaagctgacactttgcaagccacccagtctacaatgtggagaatggttgcaaagccttccacacttcttcctgccaatcctcaccctggtctccagggtcaagtgtgcactttctggggatgcagcctctccaccccacacacaagttgtaccgggaaaaactgagatttccagcaggcagagattgagaagcagcagctaataacattacaaggccatttggcagcagcgcaaaccttcaccattacaattagagcaagtggaggtaaaagagactctcttaatggccaaatcaaataaaaagtgacaggcttctgaagattatgttgaaccctgtatggcatgttaatgaaacaaagggtcagataccatttcatctgtggcttatctgcttagatagaagggatgtttttctgcctagtcctacctgaggatttccaagccacccctatgcatgaagatctgacacatttttgtccgcacttttctcagagtgttggggaaccaggactgagccagcagcgaaatattctgtgatgtaaggtggaatttagaataaaggtattttggtgatcaagcagctcaatggtccttaaccttgactgtaaccttgactgaatcacatgcaaagctttatagcctttctgatgtccaagctgcccagagatttttagggtgcacccaaggcatcaccagttagtaacgcatcccaggtgattccaaggtacaaccagagtctagaaccagggatctagtctaatccttttttcagataatgaagctaagtcatagagaagttaggtgtgttggccagtagtaaatacaaacagtagaacccaagtctcccaactcttaaacttatcaccttccactatatgccctgccatatctgctattgagaagagtgagaaacacacattaaaactgcatactctactgtgttccaagaatgggatgactttgaaatgcatgctatttgtagaatataggtagtgagactgatgcctggtcattcgcctacagccttaacacctcctggaagtctgattctttcagtttaccttgcccatagtgtgagacagagaaggaaaatagacgagtctcagaatgcattgttcagtggaatgcattttggaatgatcctacaaattacaggaaagctttaatcgccaataattaggtgtcttaaaaatggagttgtcttctggcgtatgctgacattatcagtccaagatagacttgagccaggagcctctgtgacagtatgctttagaaagagtgagagagggagcatgtgtaagctaagaaaacctttgtaaataagcaaagtcttattcaacctacagtctgtcctcagagctatcatttatcaggggaacccacccctgataattcaacatgagtccttttctattttccgtaagcgtcggccggtctgagaaacaaagggaaagagtacaaagagataaatttttaaagctgggtgtccgggggagacatcacatgtcggcaggttctgtgatgccccctaagccacaaaaccagcaggtttttactagtgattttcaaaaggggagggagtgtacaaatatggtgtgggtcacagagatcacatgcttcacaaggtaataaaatatgacaaggcaaatggaggtggggcgagatcacaggcccggggcgaaattaaaattgctaatgaagtttcaggcacgctttgtcattgataacatcttatcaaccgtaaaagacagacattcctagagcggccattttagagacctcccactaagaatgcactctctttctcagggatgttccttgctgagaaaaagacttcagcaatatttctcctatttgctcttgaaagaagagaaagatggctctgttccgcctggctctcaggctaccagacctaatggttatctcccttgttccttgaacattgctgttatcctgttcttttttcaaggtgcccagatttcctattgtttaaacaatttgtgcagttaacgcaatcattacagggtcctgaggtgacatacatcctcagcttacgaagatgacaggattaagagattaaagtaaagacaggcgtaagaaatcacaagaatattgattggggaagtgataagtgtccatgaaatcttcacagtttatgttcagagattgcagtaaagacaggcataagaaattataaaagtattaatttggggaactaattagcgtccatgaaatcttcacaatttatgttctgccatggcttcaaccggtccctccgtttggggtccctgacttcctgcaacaataattatttattttaaaagaaacaaaatcaaattattagacatttcaatctgtggtagtaacatgatattctggcatctactttcattatcacctttattaaaataaatttaaagaaaaatggcagtatgtttctgtgaagaccacgagtactcattttaaaggactcaagagttgcagaaaagtaaaaagaaaagagtaaaatcattttctaaatctcaccttccagaaataacgatgttgagcattaagtggacttcatttcatactctttcaaagattatgtaggcatatatatgtgtgtgtatatacatatatatggatacatccttagagaagttggctggctagatagacacactataaaaatggaatcatactctaatgccatttttaatttaaaaaatacatattcagatccactgtacttatatacagaagtaaatgaaactaaagtaacacgagaggaattctgaccctcatataattttttttactatccaacataattattttttttattatactttaagttttagggtacatgtgcacaacatgcaggtttgttacatatgtatacatgtgccatgttggtgtgctgcacccattaactcgtcatttaacattaggtatatctcctaatgctatccctccccttccccccaccccacaacaggccccggtgtgtgatgttccccgtcctgtgtccatgtgttctcattgttcaattcccacctatgagtgagaacatgtggtgtttggtttttttcccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgccgcaataaacatacgtgagcatgtgtctttatggcagcatgatttataatcctttgggtatatacccagtaatgggatggctgggtcaaatgatatttccagttctagatccctgaggaatcgccacaccaacttccacaatggttgaactagtttacagtcccaccaacagtgtaaaagcattcctatttctccacatcctctccagcacctgttgtttcctgactttttaatgattttcattctaactggtgtgagatggatggtatctcattgtggttttgatttgcatttctctgatggccagtgatgatgagcatttttcccatgtgttttttggctgcataaatgtcttcttttgagaagtgtctgttcatatccttcacccactttttgatggggttgtttgtttttttcctgtaaatttgttggagttcattgtagattctggatattagccctagccctttgtcagatgagtaggttgcaaaaattttcttccattctgtaggttgcctgttcactctgatggtggtttcttttgctgtgcagaagctctttagtctgattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaggaagggatccagtttcagctttctacatatgtctagccagttttcccaacaccatttattaaatagggaatcctttccccatttcttctttttgtcaggtttgtcaaagatcagatagttgtagatgtgcggcattatttctaagagctctgtccttttccattggtctatatctctgttttggtaccagtaccatgctgttttggttactgtggccttgtagtatagttagaagtcaggtagcatgatgcctccagctttgttcttttggcttaggattgacttggcaatgcgggctctttttttggttccatatgaaccttaaagtagttttttccaattctgtgaagaaagtcattggtagcttgatggggatggcattgaatctataaattaccttgggcataaattaccttggccattttcacgatatcgattcttcctagccttgagcatggaatgttcttccatttgtatcctcttttatttcatttagtagtggtttgtagttctccttggagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgcccgtttccaaagggaatgcttccagtttttgtccattcagtatgatattggctgtgggtttgtcatacatagctcttattattttgagatacatcccatcaatacctaatttattgagagttttttagcatgaagcgttgttgaattttgtcaaaggccttttctacatcttttgagataatcatgtggtttttgtctttggttctgtttatatgctggattacgtttattgattttcgtatgttgaaccagccttgcatcccagggatgaagcccacttgattatggtggataagctttttgatgtgctgctggattcggtttgccagtattttaccgagaatttttgcatcggtgttcatcaaggatattggtctaatattctctttttatgtggtgtctctgccaggctttggtatcaggatgacgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagagtgtatgtgttgaggaatttatccatttcttcttgattttctagtttatttgcatagaggtgtttatagtattctctgatggtagtttgtatttctgtgggatcagtggtgatatcccctttatcattttttattacatctatttgattcttctctcttttcttctttattagtcttgctagtggtctatcaattttgttgatcttttcaaaaaaccagctcctggattcattgattttttgaagagttttttgtgtctctatttccttcagttctgttctgatcttagtcatttcttgccttctgctagcttttgaatgtgtttgctcttgcttctctagttcttttaattgtgatgttagggtgtcaattttagacctttcatgctttctcttgtgggcatttagtgctataaatttccctctacacactgctttgaatgtgtcccagagattctggtatgttgtgtttttgttcttgttggtttcaaaaaacatctttatttctcccttcatttcgttatgtacccagtagccattcagcagcaggttgttcagtttccatgtagttgagcggttttgagtgaatttcttaatcctgagttctagtttgattgcactgtggtgtgagagacagtttgttataatttctattcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccaagtctctttgtaggtcactaagggcttgctttatgaatctgggtgctcctgtattgggtgcatatatatttaggatagttagttcttcttgttgtattgatcccctttaccattatgtaatggccttctttgtctcttttgatctttgttgatttaaagtctgttttatctgagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattagagcatttggcccatttacatttaaggttagtattgttatgtgtgaatttgatcctgtccttatgatgttagctggttattttgctcgttagttgatgcagtttcttcctagcatcaatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttgaaatgaatgaaatgaagcatgaagagaagtttagagaaaaaagaataaaaagaaacaaacaaagcctccaagaaatatgggactatgtgtaaagcccaaatctacatctaattgatgtacctgaaagtgactgggagaatggaaccaagttggaaaacactctgcaggatattatccaagagaacttccccaatctagcaaggcaggccaacattcaaattcaggcaatacagagaatgccacaaagatactcctcaagaagagcaactccaagacacatcattgtctgattcaccgaagttgaaatgaaggaaaaaatgttaaggcagccagagagaaaggtcgggttacccacaaagggaagcccatcagactaacagctgatctcttggcagaaactctctaagccagaagagagtgggggccaatattcaacattcttaaagaaaagaattttcaacatactgattttttacagatgccttatcaaaagagattatgaaagctattggaattgtaatacttttattaattaatggttcacttttatatagtatcagtgaacttcgagcaatgaaagaagatgattttaatgcttccttcatttctctatcacccacctcctgatttttatagatcattatcattcattcattcaaccagtgtttatttagagaatactttgtgtaaggcaccttcaaggtgctgagcctagagctataagctatcgatggaacagacaagattctcacacataatggggcttgcattttaatagaaagaaaaaataaatcactattttgacattgcgctgattctgttcagtaaccataagcctcataattgttcagtattgtttctatatttgaattctttctatgcatatacataagtagaagtctggcagactagagagatagccagactcacttttataaaaatgggatgatactataaattcacttccgtcgctgacagcccatcctccacctaccttcttatctctgatcctccctagcagccctatccaggtttccctggttagaaggagaagctcggtcttttccagattcacagggaaaggttcccaagcaggaggagtgaggaggagccaggtggcagggccaggccaggccaagcctttctccactgcttctctgcagaatttccttggctgctggttttggaagtgtgtgacattaggttatgtccatttccttggttggtggctgctgataaaaattttgactggtttcactattttgatgctataattcttcatttttttttaggcattgctaagttagataaatcttatgttcagtcttttctatcttatctttaccccaagtctacctccttaaaatacttttatgagcacaaatccctgatgtaaaatcaagccataatgtgtttcctggagtaggggcggacaaatatgttaactaaattctttttgcgtgcttcatgttggatcaattcttaaggaataattttgactgagcctcttttaagcttttccaggcctggcttgttttcctgaaaagcttcaaagcagagaggagaatctttgtcagttagctgggtgagtggttcacaagcctcactgttgtgacacactccgtcatttgtgagggcatcacagccattttgttaatagaaatacagagccaaaagtcaaacatgattttatatgtgtgagatgttgcccgagggaaagggcaaagaatgagaagagctggactgggcaactctcatgtgaccccaggtccctttcaaagttgagtttctctagcaagtttgggatttccaaatgtttctactgagaaaaaaaaaaaaaggaaacgtgcaattaaattagaaaactacacagctcttactgaagagctgaaattttaaaaagatgcttaaaataaagcaaggaagataaggagaaagaaacataaagcatccaaacctgaaagaataacattcagataggctaacactcagaaaagattggagtcttgccaaacatcctgaggtcagccgccaccacagcaaaaagactgtttgatttggagtgacaagaaagatgatgtgatctcagaggaaacagatggctcactaaagatatttgaggatattttaataaaaagaagattttaaaaggtgtgagtaggatacagggaaagtgacaaaagatggagcaagttggaacctgatgggagtaatctggggggaaggaacccatagcagaagtggtggctctcaatggtggagcccagccaatccgtgggatcgggcaggaagggagctgacccactgtctgctccacgacctcctggtgctgcctccccttggctgaacccagccagaaggcaaagagagacccattggtccattccgtccaagatctctctcagggctcagagcagcgtacagaaaggtagtgtttctggaggaacaaatagaagatatccagcagtaagggcaaggaggcacagaagtacttcctgcttcaaggggttgagtggctatggtagttgatgttgagaaggcagatgaagtaaaagcaacttcgcatatatctttcctatcaaagacaatggtctaactggaaagaaaacaataaacagggttgtgactaaaaactgggcaaatgatctaaacagacatttctcaaaagtaaacatacaaatggccaagaggtatatgaaaaaaatgttcaacatcaccatcatcagggaaatgcaaataaaaaccacagtgagatattatctcaccccagttagaacggctatgatcaaaaagacaaaaaataacaaatgctgacaaggatgcaaaaaaaacccacttatactgtgttggtaggaacgtaagttagtacagccactatggagaatagtatggcggttcctccaaaaaactaaaatagaactaccatacaacccagcaatcctactactaggtttctgtattgttttgttttatattttttgtttttttggttttttttttttttttttttttttgagaaggagtcttgctctgttgcctagtctagagtgcaatggcatgatcttggctcactgcaacctccatctcctgggttcaagtgattctcctgcctcaacctccccagtagctgggattacaggtgtgtgccaccacacccagctaatctttttagttgagatggggtttcgccatgttagccaggctggtcttgaacccctgatctcaagtcatctgcccactttggcctcccaaagtgctaggattacagataagagctaccatgcccagccccattactaggcatttatccaaaggaaaggaaaccagcatatcagaggaatacctgcaccccatgtttatcacagcactattcacaatcgctaagatattgaatcaacctaagtgtccatcgacagatgaatggataaagaaagtgtggtatatttatacaatggaatactattcagccatttaaaaataaaactctgtcattcatggcaacatggatgagcctggaggacattacgttaagtgaagtaacccaggcacagaaagacaaataccatatgatctcattcacatacagaagctgaaaaacagttgatctcatagaagtagagagtacaattgtagttattagaaactgagaagggtaggaggggaggagatggagaggttggttcaaggttacaaaattatagccagatcagaggaatatgttctagtgttctatagcactgttgggtgactacagttaaaaatttttgtatattttcaaatagctagaatagaagattttgaatgttcccaacgtaaagaattgaaaactctttgaggtgatggatgtgttaattaccgtgatttatcattacacattgtatctatcaaaataccactctataccctataaagatgtataattattatgttcaattaaaaataatgtaaggaataaacaatattgaaagcaaaagaaaaaatcccaaagtggtcaaagcaataagccaatacttaactcctttaagcccatctgcaggcctaaatgaatcttacctgagagtgctgaaagaaaattatgtttaatttccagaaagggtcaaaagagtacattattgaacctgtaataaagttactgaaattaaaaggaatgttaaagatctcaggtttcttgatttcaggaagctatttgatggagcctttcaaagtttggttggtaatgaatatgctggagaaacaccggccatacaagaaggtttccctgacctgggatggacagtcatgcacagtgtttactagtgttgctcgcatggcatgaggaggaaagggcacaggacccttctttttgacccactcctattcaagtttctatgaaggtcttgaatgaagataggaggtgtaggtcaaagtcgtggttatgactgtttcaaagtcagaaaggagaatcggttctgtggatcttacaagctcctttaagatgcctcaggctatgaagctgtgggagagctggaaattctggatggatgggataatatttcctgaagcttgagggaaggtgtttgctgaagtttgtccaatgtgctctgtatgaagccagaacccaatgtcccatctgccttgttccagcactgcctcggattccagatcctgagaaccaccctttaccccagggaaacccctgatgccaccttctctgctgccaaccattatgtggtgtgagctgtccccaggttgcaagtctctgccagcagccctgcatgcttcaagactctctgtgtggccccacagggcaagcacaacaaagaggtcaaatgacagaatttcaaaagatttcaactgatgaaccaaattaaaggacatgttaggtattggaattttccaatttacagagctagtttgtcctagcattggccagaatgaaggctgaaagagtggcagggctgccaccatggttactgcagcaggtggaattcgagtgcctgaattgagggaagtgggggtcctcctgcatcccgagatagcgagagcacctcagaagtgctggcttaggtggtggcacccactgtaagagaacgatgacaaatctcagtttctccctaggagagtgcccagcagggtgatgagccaggaagatctgtcaggatgaagagtagtgagaggaagggggaaccctggagaagagaagaacttaaagggattcacaagaagttgaggagggcagagctgaatgagacaaggttgcagggaaacagactttttaagatcagtgtaagggaaaaaaaaatccttgacaatcagaattgtttcaaaacagagtcagcagcttcttgagactgggtcgctgtgctaagaacgtaaagggggagctgggtggcaccagcaaagtggcaggaatgtgtccctgcagggtctttgctgccttccgaatcctctcctttgtgatcctgtaatttgtgagagagcctggagggtagcatggaaaagagagaggagaggacctgacagcagtatttccatcttgtcccctaacaattgcctaggcagtctcctctcagcagggaagcaaactggtcaccaaataataataattatccccctacatttccttaattatttaaacttctgaaaggacatcaaacacagcaaagagtcaatgacttgctttcagaagtgattcagactgtagctccacccataacagtgtcaccttgagcagtcacatatgccttaacatccttctttctaaagcaattccatcttcccaggttgattgttgagcgtttagacatgatgacatatataatctttatatatgtatatttacaagtatatgtttatggataaattttgactgcctgtaacccatgtggccttgtgtcatcacacataagttcactgaagctcccaacaaccagacttttggggaagtacaaacctccacattagcactaggtctccttgcctgcccctctgctggaagaatccctggcaggggccttctttggtgatgggattgaattttctatttcctgaaatgtaatcagctttcagtttcaatggtggtcacccccttgtaccttcttttaaagattggaacgctgtattggtttctcagggctgctgtggtcttcatagaagatgacccgcgtatttccaaggtttcctccaggattgctggggctgtctgcgtccagatgttaaggttactgtagacaataaatgggagagggtgaaggaaggaggatgtttagagaaaattatccagtcacctggaggaaaggctcttagctgcaaaagaggaaataagggccaggcacagtggctcatgcctgtaatcccagcactttgggaggccgaggcaggcagatcatgaggtcaggagatcaagaccatcctggccaacatagtgaaacccatctctactaaaaatacaaaaatcagccgggcgcagtggcacacgcctgtagtcccagctacttgggaggctgaggcaggagaattgcttgaacccgggaggcagaggttgcagtgagatgagatcgtgccactgcactgcagcctggtgacagagtgagactccatctcaaaaaaaaaaataagaaactgctatttagcacaacatcaaataagcagtttgttgcttatgtctgaacacttctgtgaaaacaggcaaaggcagtcgtgtgtaggttctggtgaccaggaactggagctgcacagaggtgtagaggctcccaaagctcgtcaattgtttatgaagggagtaaaggctggaagtcagggggtgggtgtcagtttctgccactagctaccagatttctcctaaagatgggaaagctccctttatagagctggagtgcaattttgtgttttctttgtgtttggcaatgtctgttactgacttgcaatagatatgcaacagtataggtatgttcatcttagtattttggggacaaaactcccaaaccagccaccacacaaatgtatttataggtaccagtaggcacctttggactcggagggaagtcagcctccttaaagccgtattcagtaaggagaatgaagggtaggcatggctgcagcttgggttgtgcccaccatgtggatatccagccatgatctcaatagtcaggttggtccacattgtccagatatctccatgtaacattaactcagactttatgaaaataaccggtgagaataaccaaagccacattgggtaatgaaaactgtatgtacaattttctttagttacattgatgttgttacatactgttcataattaattacattggtttgtaatgtatcatgtcctattgtattgtaggttctaataccaagaccctaggtgttcctctcttaaaagctggtgaccacctttaactcatgtggtaaaagaatgatagttctgggaggatctgcattctctctgtgtccatgcagcattgccccacactgcctgtgctgagctgcatgatcctcatagctacatcatagtctttgcttgtaggcttgtcgtttggagaaccgtcttggagtctttattggttgatgtcaatggaaagctctgcttccctctggatgtcctatggtattgctgttcctaatgtctttctaatgagtgctacgtgtctgtatgtgtgtataaagagatttatgtaaagaattggctcatgtgattacggaggctgagaaaccccaagatctgcatttgccactaagtactcagatatttggtcaaacatgattgtgagtgctgttgagtgctgtattttttaactgccacgtaatcccctcaaggtccgtgttattctagacagtaaaccgggagaggcttctaaagccccctttgtcaggaaatgttactttagaatctgaccttgtgtgaaacacagatgacagaacctctctagtgcaatgacattaaaatcctcccccagtacttgaagtgcaagggaaatagctcattgctattatggctggatcatctcatggcctctcaacagatcaagagcaccattactactgttgctttcttgacttgtgttttacttttattctaacatttgttgcagtctgtgttaaatagggaggtagaccaaactatgagaaggagccctatattggaaactgtatagccaactatgaaacctccaggcttactttgctttctcattacaggcggccttcccctctgctccactggagagagtcagagtaattggctcttgctttatatgaaggatatgctcccaaaaaagttgtatttaaatcaagttttaacaaaccgactcatgcttgtttatccacttataacacttactatttaaaggaaatgataaagagtccttttctgttgttacagcgtagttggcaaagctgtatcttctgaagactgacttgcactcagcagttttagatcaactcgagtctgtttatactaagatccacagacccctggtggttctcagatgacttgcaaattctactagtttttccaattgtgtgttttttgatgataacttaaaaattttttatgataatcttttcattgtttagtataataatgtacagataaaccctagatgatcaccttataactgagtgctgtcatgagatttcagtgcctttgttctcagtcctgtaggtaaccaagacttcatctaaaatcacatcacttgactttaaatgtttgcaagacacatctgactgtcattgggttgataaaatctgtcttgtcctcattttgtgttgtgtgggactctatcatcaggtacaaaagcaaaactcctttgccatgagcgttcacagttgaatgacttttttatagaccaagagtttagtttcttagagtatatattgaatcaatttggcatcatggaaatggcatagtacattagaggcacatactatgttaactgtcacaatctaatgataaagaacagaaaaggacatattacataatcggtgcatttctgttaaagtcatggcaagcttattgaactagttttatagcaatttggcaggataaaaatgatgggaggatggagtcatcatagggtgcctgccctgtagcatggacacctgggacacaccttgctggatgatgtcttctttgggttccatcttaatacatgacaactggaaataattctgtagcagaaagtagagtgtaaaatagaaaatgactcttattctgatgaatcaaagtttttaagccatatatgtcggagtacacttgaattacttctgtaaaaactagcacattatataaaaatcataataaaaacagagattccagtgaggggtccctcttgttcagagtcgaaagattcaagtcaacaaaaatggaacctgtaagttagtctttttgccactgttaaaagaaaaacactggacacaatacttttaacagagtttatgtgagcattagaggattcatgaattgggcagcacccagaaccagaaaaggttcagagagctctacccagcagcatgggtagtgagctttaataggcggaacgtggaagtaagacaaagaaaacatatttgatttgttagagtagaaagtccctagttagaggttagttggaggtttctgatggtaacttctctagtttcattttactgttcacattgggctttggtttgcttacctaggaacttaaagtgctgggaatgcttcggcttaatgacctcccaattaaaatttttttaacatcacttttatttatgatctacaaagtggcaactgcctatttttttttaattttattattattatactttaagttttagggtacatgtgcacaatgtgcaggtttgttacatatgtatacatggccatgttggtgtgctgcacccattaactcatcatttagcattaggtatatctctcagtgctatccctcccctctcccccaaccccacaacagtcctcggtgtgtgatgttccccttcctgtgtccatgtgttctcattgttcagttcccacctgtgagtgagaacatgcagcgtttggttttttgttcttgcaatagtttgctgagaatgatggtttccagcttcatccatgtccctacaaagcacatgaactcatccttttttatggctgcatagtattccatgttgtatatgtgccacattttcttaatccagtctatcattgttggacatttggcttggttccaagtctttgctattgtgaatagtgccgcaataaacatacatgtgcatgtgtctttatagcagcatgatttataatcctttgagtatatacccagtaatgggatggctgggtcaaatggtatttctagttctacatccctgaggaatcgccacaccaacttccacaatggttgaactagtttacagtcccaccaacagtgtaaaagtgttcctatttctccacatcctctccagcacctgttgtttcctgactttttaatgattgccattctaactggtgtgggatggatggtatctcattgtggttttgatttgcatttctctgatggccagtgatgatgagcattttttcatgtgttctttggctgcataaatgtcttcttttgagaagtgtctgttcatatcctttgcccacttgttgatggggttgtttgtttttttcttgtaaatttgttggagttcattgtagattctggatattagccctttgtcagatgaataggttgcaaacattttctcccattctgtaggttgcctgttcactctgatggtggtttcttttgctgtgcagaagctctttagtttaattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaaggagggatccagtttcagctttctacatatggctagccagttttcccagcaccatttattaaatagggaatcctttccccatttcttctttttgtcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtaatgcgggctcttttttggttccatatgaactttaaagtagtttttttccaattctgtgaagaaagtcattggtagcttgatggggttggcattgaatctataaatcaccttgggcggtatggccattttcacgatattgattcttcctacccatgagcatggaatgttcttgcatttgtttgtatcctcttttatttcattgagtagtggtttgtagttctccttgaagaggtcattcatatcccttgtcagttggattcctaggtattttattctctttgaagcaattgtgaatgggagttcactcatgatttggctgtttgtctgttattggtgtataagaatgcttgtgatttttgcacattgagtttgtatcctgagactttgctgaagttgcttatcagcttaaggagatttggagctgagatgatggggttttctagatatacaatcatgtcatctgcaaacagggacaatttgacttcctcttttcctaaatgaataccctttatttccttctcctgcctgattgccctggccagaacttccaacactatgttgaataggagtggtgagagagggcatccctgtcttgtgccagttttcaaaggtaatgcttccagtttttgtccattcagtatgatattggctgtgggtttgtcatagatagctcttattattttgagatacatcccatcaatacctaatttattgaaagtttttagcatgaagcgttgttgaattttgtcaaaggccttttctgcatctattgagattatcatgcggtttttgtctttggttctgtttatatgctggattacgtttattgattttcgtatgttgaaccagccttgcctcccagggatgaagcccacctgatcatggtggataagctttttgatgtgttgctggattcggtttgccagtattttaccgagaatttttgcatcagtgttcatcaaggatattggtctaaaattctctttttatgtggtgtctctgccaggctttggtatcaggatgacgctggcctcataaaatgagttaggaaggattccgtctttttctattgactggaatggtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagggtgtatgtgtccaggaatttatccatttcttctagattttctatttatttgcatagaggcgtttatagtattctctgatggtagtttgtatttctgtgggatcagtggtgatatcccctttgtcattttttattgcgtctatttgattcttctctcttttcttctttattagtcttggtagcagtctatccattttgttgatcttttcaaaaaaccagctcctggattcatttatttttttgaagggttttttgtgtctctatctccttcagttctcctctgatcttagttatttcttgccttctgctagcttttgaatgtgtttgctcttgcttctctagttcttttaattgtgatgttagggtgtcaattttagacctttcgtgctttctcttgtgggcatttagtgctataaatttccctctacacactgctttgaatgtgtcccagagattctggtatgttgtgtctttgttctctttggtttcaaagaacatctttatgtctgccttcattttgttatgtacccagtagtcattcaggagcaggttgttcagtttccatgtagttgagcagttttgagtgagtttcttaatcctgagttctagtttgattgcactgtggtgtgagagacagtttgttataatttctattcttttacatttgctgaggagtgctttacttccaactatgtggtcaattttgaaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccattattattgtgtgggagtctaagtctctttgtaggtcactaagggcttgctttatgaatctgggtgctcctgtattaggtgcatatatatttaggatagttagttcttcttgttgaattgatccctttagcattatgtaatagccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattggagcatttagcccatttacatttaaggttaatattgttatgtgtgaatttgatcctgttattatgatgttagctggttgttttgctcattggttgatgcagtttcttcctagccttgatggtctttacaatttggcatgtttttgcagtggctggtactgcggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggtccccactctcttctggcttgtagagtttctgctgagagatcagctgttagtctgatgggctttcctttgtgggtaacccgacctttctctctggctgctcttaacattttttccttcatttcaactttggtgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccctgtcactttcaggtacaccaatcagacgtagatttgggcttttcacatactcccgtatttcttggagactttgtttgtttttattcttttttctctaaacttctcttctcgcttcatttcattcatttcgtctttcattgatgatatcctttcttccagttgatcacatcgactactgaggcttgtgcattcgtcacatagttctcgtgccgtggttttcagctccatcaggtcctttaaggacttctctgcattggttattctagttagtcattcttttaatttcttttcaaggtttttaacttctttgccattggttcgaacttcctcctttagctggtagtttgatcttctgaagcctccttctctcaactcgtcaaagtcattctccgtccagctgtgttccgttgctggtgaggagctgcattcctttggaggaggagaggtgctctgatttttagagtttccattttttctgctctttttttcccccatctttgtggttttatctacctttggtctttgatgatggtgatgtttttggtgtggatgtcctttctgtttgttagtttttcttctatcagtcaggaccctcagctgcaggtctgttggagtttgctggaggtccactccagagcctgtttacctgcgtatcagcagtggtggctgcagaacagcagatattggtgaaccgcaagtgctgctgcctgatcgttcctctggaagttttgtctcaggggagtacctggttgtgtgaggtgtcagtctgcccctactgggggggtgcctcccagttaggctactcgggggtcagggacccacttgaggaggcagtctgcccagactgcgtgctgagagaaccactgctctcttcaaagctgtcagacagggacatttaagtctgcagaggttactgctgccttttgtttgtctgtgccctgcccgcagaggtggaggctgcagaggcaggcaggcctccttgagctgtggtgggttccacccagtttgagcttcctggccactttgtttacctcctaaagcctgggcaatggcgggtgcccctcctccagcctcactgccgccttgcagtttgatctcagactgctgtgctagcaatgagcgaagctccgtgggcataggactctccaagccaggtgcaggatataatctcctggtgtgccatttgttaagcccgttggaaaagggcagtattagggtggaagtgacccaattttctgggttccgtctgtcacccctttctttgactaggaagggaatttcctgaccccttgcgcttcctggatgaggcgatgcctcgccctgctttggctcacgcacggtgcgctgcacccactgtcctgcacccactgtccagcactacccagtgagatgaacccggtacctcagttggaaatgcacaaatcacccatcttctgcgctggtcatgctgggagctgtagactggagctgttcctattcggccatcttggctccacccccccggcaactgcctattgttttacctgatatgcacaacattggccattagtgttaccaaagcaacatccatcacaagaattaatgcttcttgatttgaattttactcctctctgtctctgtttatgtgcattcatttgattgtacacttgtataagaactaaaagcataaaaagtttattcctacatctggcacagctcacgtctgtaatcccagcacttcgggaggccaaggcgggcagatcatgaggtcaggagttcaagaccagcctgaccaacgtggtgaaaccccaactctactaaaaatacaaaaattagccaggtggggtgttgcgtgcctgtaatcccagcttctcaggaggctgaggcaagagaattgcttgaacccgggaggcggaggttgcagtgagccaagatcgcactgcaccccagcctgggtgacagaatgagactctgtctcaaaaaaaaaaaaaaaaaagtttattcctagttttacatttgtagcattgaaattaaaagaatctaaataaataacagagcactgtgagaatttgttgtttaacagagctctatatgcattacacaatttcaaggaacattgatctgaatgttcctatccctcatggaccttgagccctgacaaaagttaataaagatgggtctccttttcttcttgtcccctgctttcagctctgaatgagaaaagttttgcaaatatgtcggtactttgtattaagcctaaaacttataaagtatcagatttgtaagttgactgtattaactttaatttctcaaagtgttctcagttaattaggttaacctaaaactaaaactataaagtgattcctcccctaccaagaaaaaaaaaattaagctgaaatcctctgtttagagtttcaggcctttgggctggactccacaacccttctcaggaagtagcagtagacacctgaccttaggctgtagtgctaatataacctgtgtcagtagctgccccattgcaaacaaggaaatgatcctctgaagtcaaactcaggaaggaacaagaacctgtctctctgagctctctaaagagtgtggttaagagtatgagcattgacaacagactgcctaggttcagataccacctctgatgccagttatgtgattttgggccagtttcttaatctctcaatgtctcaacaacatgagtctaataatagcatatatacccctataaccatggcatgaggattagacaggttgattggtgtgtataaaacacttggaacagggcctggcacagggtatgccttagtagatgttagcactgcatcacgactgctactatgattaccgtccctgtcactgttgctgctgccaccacaggcaggtcagtggaacgtcacccttcagggatttatcagcgccactccctaagcatgccacctgcatgaagggcagacatgaaattgtgccgccagcgttctggtttcttcagcgctccctgccagctgagctgtgtgaaaagcactcagctatgaaaaaatgagaaagattgattgaaatgttggtgaggtcattgtcaaatattctctgtcaactgaatgactgcaaatagggagatgactgcccccccaccaagtcagcctaggagggttcagtccttcatttattcattcacacatcactccttcactgtgccagccagccatgacaattaagtgcatttgggaggaggtggcagctgagctggaaagggggtttggcattatgctgggaaggtgtaaaaagccaggctgaagatttgggccgtctttttttttcccccagatagtggggagctggatttggagacaagaaacctttgtagaccctctggcactctctattgacagatcactgctaggaggcagtgtgactcggagaaccgcatgggctccgccaccagctctgggttccgcactcattagccagatgaccttgggctcattatttagcaagcctgcacttctgtttcctcacctacaaaatatgcataaaatagcagtacatacctcacggagttgttctggggcttaaatgagttcatctgtgcaaacatttagacgaagtgcttgacataatcagagctatgtaggtgctgttaattcttctttgccccactggtccccaggttccatatctgtaacaagaagcaactggaccacataatttcacatccttttatacccaagtttttgatcaagagagctcaggctgtactttaagcttaatgtgacagtgatttatagcatagcttgggggcgatctgaacacttgggggcagaaaaacaagttaggctttccctgtttccatcattctcccacctttcctccatctgcctgtccccacctggacatacatgccaaaagccacggcccattttactagatctaggtagtatgggaaaagaccatgaagcggacacatcatctgtactgccagtgtctctcttcaaaataaactttttttttttttgagcctgaatctcactctgttgcccaggttggagtacaatggcatgatctcaactcactgcaacctccacctcccgggttcaagcaattctcctgcctcagcttcccaagtagctgggataacaggcacctgccactacagccggctaatttttgtatttttagtagagatggggtttcaccatgctagccagactggtctcaaactcctgacctcaagcaatccacttaccttggcctcccaaagtgctaggattacaggcatgagccaccgcgcccggcccgcttcaaaataaacttctttaccaggaaataggattaagaggaggtagaaggaaattagagtaggatcagaaagatagaaaaaggagttttctctgaaacaataggacagccagatacaggctgagcaggcccaatgatggatagagaggcacatccactgctgagctctaacctagagagagaatgtctcaaaactccttgcatggaaggtgcctggaaatgtatttattctcctgttgtttattctcacctctcttcattcctttttctttcttctgtccttgaatcgcagcagataaaaagacaaatctgctgagaggatgcatgtcacaagtggtcagatgaattacagccatagcaccatatagataagaggcaaggctggcgcctgggcaggtctgagagggtccaggaggacacacaccatatcaaattgtgcaatttagcaaatggctggtggcagactgaaatgatagttaatctgttttccatgcactaaaggcttttgccaaactaagatttgctgtgaagacccaaagctggagcccacccagggagcgggctgccttggatgcgtttcccagccttctacagtggatgccagtaaaactaactagagacatgaatgggcaccaggataaacacaaggggatattttgttcttaccattagagaaggatactgctaactggcaagaagtcccatggttgttatcttttgattagtagtagtaaaaatactatttaaagctagtagcattttttgagagcttgctttacactgggtactttttcaagtgtcttacaagtattcgctcattttatctgcacggcagctgtatgaagagaatactgtcattatcttcactgcataggtgagcaatggaggcacagagaagttcagcaacttgtccaagctctcatagctgggaagtggcagagccaggctttgaactcaggcagtctgactcagagtccaagactgccggcctgaattgtaggagagagacagtgcgggtataccaggaaccaaatcctatcggctgaacatcagtgtttaagtcgagcccagatgctctgcacaaaatacaatgtgtctgtgcacatgtgactgttaatcagccatttccttggttcctgctttgtgctggccactgagctggaccctgtgggatggataaatcaatgtcagtcatgcccctggagacctggctgttgcaaaaaggctcctgaaatcatcataacccaaaagagaaaagggcaggtgctgaagagaagtataggtaaagagcagcaaaatcataaaggaggggagactctttgcctctgtggtatcagggaatgcttctcagagcgggtggcgtttgccctgagacttgaagtaggaatttaaaaacatagaaatgcagtggaacgggaagaaggacattctaggtggagagaagtagagcaaaatggtccaatctgcccccctaagggtgtgagacagagaagtggatgggaaggccaggaaggctgtcgccatgtgggccgaacatggggagggaggtgtttgtcagaatcagaatggactcagagggaagctgagctaaaagcttcaatttacagatgaaagaagaaagaatttggatatgtgactcactcagtgtaccaagttcgtggcagaagtaagtctcaaaccccaggcttgcctccaattttctttgcactgatctcctggcataaacatgtggctaacaagggtctcacaatgccaggagggtgttacgtttttataacctgttctatttgagggtctccaaaattacatatttgaagttaatattagccagatgctaactgtctgcaggcaagaataagcacccactttacattgggagaagctagagatttgggaatcaggatttgctgcagatactttgaggaatctaggcctctaatccacagtctcctaaattctggaacttctggcttaattacactttttaataaccagtcatcattgctgcataatttgtgaggtctggtatagtatgattcctgttcccttcagctaaccctgcccccacccccatcctttaataaacgtaaaacttttctttcctgtgaattcatttttttcccttttatcttttggacctttgcaattaacatattaatatttaattcatattacctgaaggtccaagaacacttttaaactcatgaaaaaccttcactagtaatttagctgctaccaaggtatccctgagccctcattatttgcctctggaaaatgccgtaaacgacatctaacaggcttcagctctgtacctctacaaataagaaattaagcagtattcagaacgccattgattattaatttaaaagaaatcaaaaatcaatatcacattcctgtaacctggcagtttttcttaactgaaggcagttgcctgcagaagccttgtggctttccagagcaacggcgccccttcgtggtgataatgtgaactgcaccccaggcgtgattgaaaataaggcagaaaggaatgccggcctcgagcaaggacaccggttcatgcccaaatcacttctgctttcagccaacagactgtttctgccaaaagatggacgcagctagattttttttttttttgtaccgataatctgtcttaaaacttggagaggatctcttttcccctgtgaagtcaggaaaatgacagcaagcagcatggattggttcgaataattttcaccagaaatgtggggtgaggggaagggatgggactggagtcagagcagtgatctggcgggatggggtgatgagccatacggagatgaggtgtggcgccacgggctgggagtcagggattatagagtgagggtggggtaggatcttcctggtcatcaaaactatgagaaatgtaattatttacattttaaactaagccaaagactgtattgaaatgtcttacacccagaacagagaagtggtatcaccaaagttcagaattcccagctctaacgtgatgcctttggggactgcctccccaccccaggctgacctaacacacccctttgagaaaagaggatttagtttctcctgactgtgaattgaatatgtgggatgtgcccctccaggagcttctaaaatcacctctgctttgaccttgaggggccgtggtagaggggagacagcaccggcttagaaaccccacggctcggctctagtcccagcatcagtggagcaccaaggggagaaagtattcatcactgaggtattttatgatatgtatattgttcctgggcagttgcaccccttatcgcctgcaccctgtgtacagctccccattcctcctcccttggaggccactgtgctatgtaacttgctgtgggctgcaagaaagactgggctcccgtttcctcttctgaaaggcaggaatcatgctcccggctgacctcacagaatcattccacagattaaatggcgatatggcttgtctgtgttcacactcaaatccacatgttgtgggagggacctggtgggtggtaattgaatcatgcgggcaggtctttcccatgctgttcttgtgatacagaacaaacctcatgagatatgatggtatcataatggggggaggttcccctgcacaagctctccctttgcctgctgccatctatgtaagacatgacttgcacctccttgccttctgccatgattgtgaggcctccccagccacgtggaactgtaagtccattaaacctctttcttttgtaaattgcccagtcttaggtatgtctttatcagcagcatgaaaatggactaatacaaatgggatgtaaaaataaaattcttatatacttagaacggcaatatgagctttacatctgagttatgctataatatcaatcaacatatataataatataaagtagtatatttattataagttataataacagagtgagatagcttagtaatttcttgttagtatctgcaatcttggggaaaacaaatctagagaaataagtccaaactggagctgcagagtcaagtgggcgagagaaagaagtctcgctttttttgttttccaggaaagctcaggtccagttcagcaggccagcccaagagactgggagagccctatgtactcaggagagcagcctcacccctcgtccttgtccaagattggggagtgggtgcccacagcttgtatgtgtccccatgagagtgggtgtcattatgaggagcatcaaagggccaagcacagtggtgacagatgtgggggaatttgccattctgagggcagaggaggtcaaacacaagtggactcgcttattaagcccagaaagagaactgggagaggaaggccaagtgaggatggaggcggagatccagggcccatctgcaagtcaaggagcaccgaggatgctcagcagcagagccaggagagggcatggagcggactcgcttgcagagcctgtagaaagaaccaactctgccgacactttgatttttaacttctggccttcagaactgggagagaataaatttccattgttttaacccacaaaggaagaaaaagactatcaagagtagaagggcctgacaggtggccacacggcaggtgagtcagagagttgagtcacgtgggaggtagtttagaaaaggatttgtgaagagggccatcccctagcagcgtgttgaatatagtgaggaatatgagatggaaaagaatctttttagagaacatgggtgccagacatagccacagacaaagtcgtgaaatagacagaaatttgtcccatttatggagactgtggttttccacccatatgtccccccaccccatgtcatgtttacctggccctcaggctcacgctgatggccctgggctgcttttttcccctcaaaagctgatgtctggtctctaattataagatacaagatgagatggaaataattgttaacaatgtattcattcaacaatggattgtgtaaaaaaaaatgtggtacacatacaccatggaatactacacagccatgaaaaggataaagtcgtattcttcacagcaacaggaatggagctggaggccattatcctaagcaaattaaagcagaggcacaaaactcaatactatgtgttctcacttataagtgggagctaaacattgggtcctcatggacacgaagataatagtaactgacactgaagactactagagggggtagggtgggagggggacgaggggtgaaaaacaaccagcaggtcctttgctcagtacttgagtgacgggatcatttgtctatcaaacctcagcgacatgcaatttatacatataacaaacctgcacatgtacccccgagcctaaaataaaagtcaaaacaaaatattcattcccaaatcatttactacatacaaatcgttaagtcaggatccctgctgtgacactagggattatagaagtgttgaaagcttcattctcatccagtcattcattcagtgcctggctggggttgtgataagcaaaagcaaacccatccctctccacatgtagcttccagtctcgtggtggcatttcctcagaggatgaagccatccaggtagcatagcaggcatgaggtggttccagtaaatggaggtgggacagtctccttgggctgccaccctgcttggggctattcctggtagggcctggagctctgcctagagaagcccacatgccctctcctggagtcacaagggcaggccaagtattctgtcctattccagtctttgctagaatgtgtcaagtgctgtgggcttgagtccttggcaatttttgcatgggacttagtttgggggtaagttttctggaaacttgaaatgtttcacttaaaaagaaaaatgcaggattcaaagaagtaaagagtaacaaataaatagaggcttttttagttcaggggtcagcaaactgagggcattgcagctgttctggaattaatgcgtgtccgggcaagggtcagtaattctgagatgccgttctgttgctttcaggccttttttggtgaaaactcttaaaggaggtataattcttcccttgctgggagtctttgtttcagaggggttgtaaaaaaagattcccagaggataaatcatatctgtattaacttcctaatgaaatgaaaaattatatcattgctgattattcctccttggctgatatggaaaaaaatactattaatactttttagtgtgattttaatcctttgcattcacggatatttgcattagtattttctggacatcatcttgtttatatggattttattcattgtaagatgccatcagatccaggcatctgagttctgggggggcaatgctataatccctgcccagaaccaaaactttccctgtgcagatggtctttcaatagagtggaatgtgtttggggtttctgcatatttcagtttacaaacccttcagtgatggttgtcttcatcctgagtttggctccatgcttcagaagatgcaacagtgctgagaacggtgcctgacatgcaggaaacattcagtaagtgtttgctgaatgaatgaataaattaattcaacaacagctaatgaaagcacatcccttaaaaagtctcggcaatattgcgagcataataccaaaggcagaaaccataaaagaaagaattgatggattggaaggggaaaatctttttttttgagacagagtctcactgtgtcacccaggctagagtgtagtggtacaatcttgactcactgcaacctccacctcccgagttcaggcaattctcatgcctcagcctcccaagtagctgggactacagatacacattgccacacccagctaatttttgtaattttagtagagacggggtttcaccatgttgcccaggctggtctcaaattcctgacctcaaatgacccacccacctcagcctcccaaagtgctgggattataggcgtgagccaccgcagccggccagaaggggaaaatcttataacatgaatttcagataaactgttacatccttaatacttaacgaattcctgttaatcagtatacaaatattagtacccaaatagaataaataccgatggccaataaatgtattagaaacatttgaatctcacttataaaaacatagttattttcctaaatggggtatcattttttcccaatcagattggcaaaaataaacaagaatacaaatccagcctagcacatgtacgtactttcaaagggaggataatttggttcaacatgttttgaaagctggttgtatggtatgttttgaaaccttgaaaatgacccagaaattttccttctagagatttatcttaaggaaattataggaggcataaaaagtttcacctgcttattgctttgtggcttatcattgcaaaaagaaaatggaaaactacttcttcagctaaaggaagtgatacgctatcgtactagaatattaaaaatgaagaaggtagggaaaagagaaagagaatctaagcggtaaaattgtttgacctttattttcttctttttgcttagctatattttctaaagtttttgttaaaataaactcttttaacaaaaaaattctaaaaactcatagctgcttagatgataatataattataatatttatgttaatttttgttgcgaacgtatgtttatgttgaacttaccaagtgatctaagctatattactaagttcttttcataagcctctgagttcatgtatattaagcccttaacataattcttagagttaagcagagcaggtggcgttattcttccatgaccgcactgagactcagaaaagttacatgacttattcaatatcacataattaataaagagtaagactggccacaaagtccaggatgccacacacatagctgagtgcttcttcctctatcatagaaacaaaaatctggatgaccattaggccgttgttggcctgcaaaggtgtagagcaaactattttatggtattgagagcacttatcttggcattactccatctgattgtttgtgtcaagtaggaaagatacatttattattcccattttgtagatggagaagctgaggctcagagaggttgagtgacattcccaaggttgtacacagtaagtggtaaagttaggatttaaacagttttagtccgaatcccttgctctgtctacttcagtttggcataataaattcttaacttccttaacagtttgtcccatcatattcctaaagttttatgatttgatgaagtctctcttaagctccttttccacatgggtggcatgggttagcaagattttgagggctgatcttgtgtgacagattgtatttccaaagatgtctggaataatatcttgtgtcccacatactgttgtggaactatcacctctccatcccaaaaggtggaacagaagcaacactatgaaactgccaaggctaaatcataaacattcaatgcacttctgccttgctctcttgggatgtttgtgcttagaatccagctgccctgctgtgaggaagcccaagcaactctgtggaaaggaccacatggaaaggaacagaagtgcccagctcacatccctggctgagctcctggccatcagcctaatttgctggccatgtgagtcatcttgaaagtactgtaggttcaaggtttactttctgaggtttcagttatccatggtcaaccgtggcccaaaaataggtgaatatagcacaataagatattgtaagagagagactatataacttttatttacataacttttcttacagtatattgctatgatttttctcttattagttgttgttaatctcttatgactaagttataaataaaactttatcataggtatgtatgtatagaaaaaacatagtatatgtaggattcagtactatccgctgttgtaggtatccactgggagtcttggaacatatcccttgtggataaacagagactactgtagatcctcctgctcctaattagcctaccctaactgatgttgcattgagcaaagtgaggtgagccgaccaacctctgcccaaattgcagatttctgtgtaagataagtgattattctgttgggggtagtttgttatactcattttccctcctaaccccaaattaggtggcagggatggaggagtcttgcttatcatctctctatttttgttaactcctcctcgttcagggtagactttggcacctggatcacaaccttattctccaccccaaacctgccattatccttggtgacaccattatccatgaaggggacccatttgatatgttagcttctcagttccctgtcttctaccccaaagtccttcaaattcaaagtatcttactctttttgttttaaaattgcttggagtagtagagaggactctagtggaatatacaagccaaaataatcaggaatttttacatgagagaaaggaggaatgtcgtgaagggcatcaaaaagcaagaaagatgctcattttcccttccaaccccaatttaggtggcagaggtgggagcaggtgaaaagaacaaagggcattggaaaagaccacctggaagtcagtgaagaccaagcggtaaagggatccttagcttaggcaaaggctagatggggacttatctcaccaatggagccagagaacagatgttccagatgtgtgtgtggaagtgggaagaggactgattaaggaaagaagaagctcaaagcaatatagagatgagacagagaaataacaggattccagaggcacttggattttactcaccaaggatgagggggaattagttggtctcaacatttctaacggcaaagttacaggtcacctaatacatatttatgtattagttggatcagaggatggatggatggatgagtgggtgggtggatggtagatggcagtggatgaacagatgaatgaatggacagatgtgaggatttctctgtgggagattcagttcgcccaggagtgatggtgtttctgagagagccctagcagcatttgttatctcctaggctctctctgaatgttcgaagcagtgagtggcaaagaggaggctcagccctctctggattgatctgttactggggtgtacaggcattcagtgcagagttctcttcatcaatggtcaaataacttctgttacccacttgtgatggctcctgtagcctctggttcgactccatgtaacaactgaagagcagccttgctgcaacagataggaagcaggtcttatctctgatttgagaatagaaggcccggtgggtacaacctgtagcactttcaatcctgtagaaatatagatagtgatgctgttggtaaaaaggaatccaccctttccaaactttttcctaagtcagtggttgtcaactggatgaggtcttgctcaagcacaagtgtctggacccctcctctagaaggagtgattctgcaaggctgagcaagcctgagaatgtgcatttctcacctgtaatcctagcactttgggaggccaaggcgggtggattgtctgagctcaggagttcaagaccagcctaggcaacatggtgaaaccctgtctctactaaaatacaaaaaaagtttccaggtgtagtggcacacacttatagtcccagctactcaggaggctgaggcacaagaattgcttgaacccaggaggcagaggttgtagtgagccaagatcatgccactgcactcaagcctgggtggcagagcaagactctgtctcagataaaaaaagggatgtgcatttctaataaattcccaagtgatattgatactgctctaggaccacactttgggaatcacttccatcctgcatggctaggtttaaattaggcattcttaacttcatatgtggcagggtgagtggatgttgagggccccaggtatattcttgaaaaacaaaaagaagtcagtgatcagttaattcattctagtctcctgctgagactgttgtctggcttatgaaggccaggatttttgccacctgaggcatttggagaagcctatgaaggagagtagaggagaggttggggacaacagaatgaagccagccagaaaaagagactgggcatagggggaatgggaatttgaggagaaacatatcattcatcagaacttaaatctgcatttttagagaagatattataatgtgcttacgtggcctccagatgtgcacaggtgccataggatagaagtagcccagggaagccttgtcatagatgggctacataaataggaaggcttgcagcagtgttaaaagacagctgatatgattaggctttgtgtccccacccaaatctcatcttggcttataatccctgtaatcccgttgtgacaagggagagaccaggaggtaactgaatcatgggagcggtttcctccatgctgttctcatgatagtgagttctcatgagatctgatggttttacaaagggctcttccccactttgctctgcacttctccttcctgccgccttgtgaagaaggtaccttgcttctctttcaccttctgccacgattgtaagtttcctgaggcctccgcagccatgctgaactgtgagtcaattaaacctttttcctttataaattaaccagtctctggcagttctttacagcagtatgaaaatggactaatacaacaccctccatgcaacctggagaaaatgcaaagtacatatagctctcaaacttcaggaaggggatccatatatgcagacagccattctttaaaataacctttccattctcccatccacttcgctcacacgtgatagatagtctgtattatctcttctctaacatctccacccaaaactaaacaaaacattaaaaccctccagtcattatttaacttgcctctttcttcacctcacttccagtttctccccgattcacattcacaaaagcccaagaatgttatggctgatcaaggactctcctttgagggtgggaagaaactgcaggggtcaggccagaattctcttctgcagacagaggagggggaaagacaggaaataagcatgcacaacgttcacctttgttggctgcacaacagcttgggatgtgcacccagccctaggtctccagctgagatgtcctcagttgtactcagcaaaattgccaccttttctgagttatgaaagccttctctcctagagccccagtatgttcctggcacctgcaggcttttgggttttggttttggggtttttttctgtgtggtgttgttgttgtgtttcttcaccagggcatgagtagacagatcctatgcaggcactttctttgtgatcttcaggatcatttgttttatcttgcctcccaaatgctgatcacccatgggcatgcttcttgagggttgcaaccatggctttaaaacccagaacagctggtgtctgtggtctgcagggcccagaaaatattatttaatccaggaaacattcctttgttctgctctgcttcattcagacctctcctgggtcttttccttcccctgctggctatcgatttccatccaactgaaggggtgaagttcagaagcccaggagacagcctgaataatgggtatgcaagtgttgcatcacacatgcagcaaacatttattaagcatgtatactatacagggctgcaaaagtccatatgtactaggatcttacagtacacttggaaacaacaaggaatctgggtatgaggattctttaggtggaccagatgcctgctctgtgtagcagcagaactcttcaatatggactgtaaccacctgctccaaaatcaccctggggaattgtgaataaaatgcagacttcaaggctcatcctatacttgatgagatagggccctgaaatctgctatcttaacaagcacccagttggtttggctcttcatttttctttttgagacagagtctcattccattgtccaggctggaatgcagtggtgcgatcttggctcactgcaacctctgcctcctatattcaagtgattctcatgcctcagcctcccaagtagctgggattacatgcatgcaccaccacactttattttgttttatttattttattttattttattttattttattttattttagtagacacgggatttcaccatgtttcccaggctggtctcatctcttggcctcaagtgaagtgcccacctcagggacatatattgtatggtactgtagagtgctttatacttatctttctcctaaccagatgttagctcttagaatctcatcctcctactttccaaggtccctgcacccatcaccaggcccccaagggatatggacagggagagccctctggccaaattctcgctggatctcccagtggccgttcagcttggaccgccttttctcctcttattccagtgatagtccaggatatctttttgccttttttcccttaagacttccctggtcttggtatttgggattttctcattttgaatctgggggtgaagaggggaatttaggggatattggtcacttgtcttctgtgtccaaatgtgagtgtcttgctttggattaggaaacccctaactaatgaatgttgttaggggctaagaccactccaacagtagaagctagaaatcttagatactaccttgcccatctctgggtgcagccaggacactgaatgtgattcaggctctgctgattagatgtgtccctgttagacattgacatagaccccaggagccagggttataagggacaggagtcctttgtcctctggcaagggtaatttcctcctcagaaccagtcctgggctatgttgatgggcgtggcccagttgccttgtaccaagtcagttttctagtcctgactagaaattgttagttctggcagctaacaattctacatgatccaaaaaagtgagggatatcatttaaggagggagggagacagcctctgccttggtgtctcaccttccaggagtaaagacgtgtcccaagtaatgggtagctccatgcacaagagaagagacagtggagaagataagacatgcaagaggaaggatcatggaagagagacccagaacatttgcttaaccagatctatttataagttttagtccttaatcagaaagcaatgtatctttcttagaacagtaacctcataatgcattcctgaggagcccagttagtccttgctcctgtccatcccacctccttcaggcggtagaacagaagaagggtcttcatctcaccccagctaaagcatctctgcttccagaaagtgtggatgagtgggagccataaacctgggaaataagccacatgctacccttttggttgttgtttattttaacaaaattctatgaccccaggaccatgtttctaagagtagccacttgaagcagaaggaaatatttagtcaaattctacaatcacagccaaatacagtctaatggcagccagcagacactgtggaaagagagtgtcacacaccattctaatgtggggagtaaggatgatgaagaatcagtcataggtccgtgttgtagctccgtctggggagtggaactcatagggtataagtgattatttcctattcatttccttagccctgaaccgtccaatgaccacacgcaacttgactggcaagaggtgtttagaatgttgagacacggtcagaaatgattggtggtttcatgtgatgcaaagaatttcccatactccgcctgttttctggatcacctgtccccagaaattgcctgaaaacaaatcacaggttgaaactagaaataacttccctctcctaggcagcttggagactggccaccctgtttcttggtttggtaagaatgttccagacacaaggaggggagcaacacacactggggcctgtcgggggttggggtatggggagggagagcattaggaaaaataactaatgcatgctgggcttaatacctaggtgatgggttgataggtgcagcaaaccaccatggcacacatttacctaagtaacgaaactgcacatcctgcacatgttaccccagaacttaaaatgaaaataaaaattaaaaaaaaaagaataatccagaaagtcaagaaaagcctaactaaaaaagtctttttaggcaagagagcatcgtaagtaggatgtagaggaagctcccctgcttaaaacctgttaatggtcttctgtagctttcaaattctagctcctcttgcctccacgactcaactccccagccctccttccgagtgtacaagatgactcaccctgagtccagagccaaactctcggtttgcatcccagctctttgccacttactacagaccatgtgaccttgggcaagtcacctaacctctctctgcctcactttcttaatctgaaaagggggggatgatgaccacccgtttcatcaggttgctgtgcatacaaatgggcgaatatgtgtaaactgctgagaacagtgcctagcaaatagtaagccctatgtaaatgtttgctgatgttgtgttccatgattccgtggctttgaagatgctgctctctcatcctgcaatgccaccttaccttacctagcaaattccaacgtgtccgttaacattcagctcaaggctgggcacagtgactgacatctgtcatccccaaactttgggaaactgaggcaggaggatctcttgagcccaggagtttgagatcagcctgggcaaggtagcaagctctcatctccacaaaaaaattaaaaaattatccagaggtggtggcatgcacctatagtctcagctactccaaacactgaggcaggaggatcgcttgacaccaggaatttgaggctacggtgagctctgctctcacctctgcactacagcctgggtgacagagcgagaccctgtctctaaaaagttttcatttttaattttttaaaaaatgtttttaatgtatctcaagccctacctccttcagcaaagtgttctgagcacccaggtctgatgtagggccttgtccatgcttcctgaaaatatatcttctgtagcattcaatgcactggaatgcctatgttagctgaaagttactgatcacaattccggtggcctggaggattggtgagcccagctgtgaagtttagaggcttgctatcttgcccaggctgatctcaacaagtaaacattagtttattcatctgtcttctccctggtttcaagcccctggagtgtagggccacatcttacttggcattgtatccagcagtcaacatagtcctagaatatagaaggccctcatgttgaatgaatagtaaaaccctcctgaaatccattaaattcatatgtttatttactcactcattctcttcctttgttcaaaaaacatctcttgagcctctgtgatgtaaaccaagtgctttttaaccagcagcttctctctgatgatctatctgcaatctctgtgtcagtcctcacatttaactaggacaaaaagagaacatagattcttagtagctttgctcatgacctgactttaacaagaaaaattttagagaccaaaagtctgactgatagctgagtgagttctttctttcaaactcaaagccctgtttgagcctctaaacttcacagctgggcttgcaaatcctccaggccaccgcatttgtgatcagtatctttcagctaacataggcattccagaagatgttctgccctaaacgtaattggaatcctttttgaatcagttgccacagtacttctgaagttttttatgctaacttcttgggtatatttcctcaagatggattcaagatgtggccagttctcttgtgagaagaatacatttctgttgtcctaagtgtagagaccctctagttcatgtaatagccctgcaaagcaatctgctattaccagtcccagcatccatttctccttccttccttagtaataaaaccctgctttggctgagcaccttgttgcccagaattaaacactgttttaccagcttccctgatgggtgtggtcaggttactaagatctggccaaagatgtgtgtatgagttttctatgctgctgcaaattactacaaacttagtggcttaaaacaacacacatttatcttataggtctggaggccagaaatctgagatggatcttagagactaaaatccaggtattggcaacagaggtgtattcctcctggaagttattgctttttctagcttctcgaggtcgcctgcatttcttgtctcgtggccctttcctctgtcttcaaagccagcagctctctggcatgtttgtgcttctcattctcattctctctctctctcccaccccgcccccgcccctgctgtgttatcacatctcctctctctgatccttctacctctctttcataagaacccttttgattagatagaacccacatggataatctctccatcttgaggtccttaatcacatctgtaaagtcccttttgccatgtaaggtatcatattcacagttctggggatcaggacatggacatcggggggacattattctattgtcatgtataagtagagtaagtaagtagagtatggcattttcagaaatgtgctcaaagggaggtgtctcaactgggaaggaccctctttgacccttctgcctttcctttctaaagctgagatatgatggctgatgctttagcagccattgtgaaccatgaggtggccttgcggatggaagtcaagcactaggatggtagaagagaaacattaagatataaattcctgatgatgccatggagccaccttttaccaaatacacttctatcttgtttaagctactgccatcttatttgtttttttttttctggaacatacagctggacctaatctcaatcccttaaaactatacatgactctcttcttaataaactgcaaggctggttctctcagcctactaccctgcctaaggaacagataggtagtaagcatggatatgaccattgctcagaaaatgtgttccaaaaacagacagtatgtttatcatttattgatcagttcagcctctggctctgcctatacactgagccatacaacctcaatattaatctgggctgttaacattcttccagagctttgatcatggtctacatcttactccccggagaatcaggtgggcagaaatgggctactgacctatcaatttctagtcctgattagctcaaaatgtggtcatttcctcttaacataaatgtatttaacaacctgaaatagcaaatagcaaggtaactttccactgacctgtcttactattaatatcagaagtcagaggtggacctaaaaagtaaccaaacaatcaaaaccaatgtctgtaaggaaaaccagcatcgttattagtgacaccaagattcaaatcattgatttagcaacactccttagtgtattcatcagatgtttattggaaatctatggtgtggcctctgcagtgagtcagagtgcagagttgaagagatgagggtccctcaccttaagaaccctcactgcattaatggagagacagaccaagaaatgcctttgtggtttcaagaagtgcctttgttctgtttcatttttttattgtcaacaatcatggccaggcatggtggctcatgcctgtaatcccagcactttgggaggccaaggtggggggaatcacctgaggtcaggagttccagaccagcttggccatcatggtgaaaccccgtctttactaaaaatacaaaaaaaaaaaaaaaaaaaaaaaattagccaggcatggtggcgggtgcctgtaatcccatctactcgggaggctgagacaggagaatcgcttgaacccaggaggcgggggttgcagtgagccgagatcatgccactgcactccagcctggactacagagtgagactccatctcaaaaaaaaaaaaaaaaaaaaaaggaaaaaaaaaatcacaacctagattctgtaagcacctacagcagctatcctttgctggggtttcctcattcagctctctcctcattcattatctgggtcctattgtattccctttattagttttagcaatgtttaaaattatttgctgcttgaaatctaatccattttgcaagtaaccagcacctgggggcaggggtagtgatgagaaaacagggctaaaaggaataaattcacaatgagttttatatttacaccatccttttcccattcacagggttttcccatttgggaacattcttagcgtgttctctgaacagaagaccgtttctcttggtctgaagttgatcaatgtgagaggaagatggcacattagaaagatgcctggctctgatgacattccaccccgcagtcttccagcacactgggatctggggcttgaagtcacttgtctggctgtgtgactgtatccacttggaagcagcgtcccctgctcctaagttgcacaagatacttcagggagtctgctgtgatttagtgatagacaagtcagaaaacaagtttaaacttgttattaatcagaagagaacacagacatttttagctgtctatctgacttggtcatagggcagagccatcagatgccatcagtggtggtcggtgtagatttttttgtgaatcaagacaggagcaggaaaaaggggggtggaaataacagacaggttccaggagggcctggtggagggttcagctgttggagctcatttttcttgctttttcccgagagaggggaatggactgccattgtcacaggttaagtcacagaagagtgaagctcaggtgacaggagacattccaaattgagaacagacatgccaggggtccctgttgccacctgctcacaagccaaggccttggttccgagcccctcttctctctctgcattttctccttgggtgacctcatccagcctcgctgcctgaagtgcattcctacacaccagtgactctcaaatactatctccagccagctctctccccacaaatccagattcaacagccactccatgtccctactcagatggctcctacagacctcaggcgaaacatggctagcacgcaagcccaggtgtcctccccatcctgttttctcatctcagttgatgtaagctccaccgtgcacccaactagttaagctagaaacctggagtcactcgagactcctctttttctcatgggcaagccccatccatcagagaggaccaggagccttgcctccaaacccatttgcttctcttgatttcaccatatcacctgtgcccaaccagccttccatttctctaacccagtggacacagttccaaactggtctccttgcttctactcctctccctttacaatccattctgcactcagcagctaacatcttttaaaaacataaactggaccccttaccacttgaagccttccaggactttctatttcttttaaaacctgacacagcccctgccttcctggtctcctctccactgtgttctgtgtggccaacctccaggcgtacgagcctgcctcttgccctctggacagatcaagcttgcttcctgccttggagatctggccttggctgttcctctgatggggaggctcttcctccaaagagtcacacgaccatctccttcttgttcctgagttctttattctcaatgaatgaagtttattgcactcccctccccaatctcagtagtccccagtgatcctctctcccaactcccattctagcttcattattgcgctgtttttccttggtttcatgcagtttccttgttcattgactcctccattacagagtaagcttagagaggtcagggaccacatctgtttctgtctcattccccacttcagcacagagaacgatatggggcacagtaggagctcgataaatgctttagtgaatgcataaacaaagtaagaaaccatgaggtgacccaaacctcggtttcttcagttataaaatgggcacatgggtgcaaaggctcaggtgtattgtaagggtgaaacgagaggtgatgcgtgtgaggcctttgtgagctctagatctctttgtagatgcaaagtatcagtgtagattgcagtaaccaggacatcagaagaaaaccctgctctttggaagcaaagtgtgccaaataacaaagcttagctctacaaggctatcgctaagcctatgcaataaatactttctctcctccacatctgagctggacattctccacttgtccctccagagccactctccacccttcttacctgcctctgtgcctcacgggctgtcactacagctgcctcagtaagctcccttgccctctgggtacaaggcttcaactgatgggtgacaccaacaggagatcagaggggaggagagggagaccaggtaacttattccctggcagaccttcatcagagagtagctgtgttctgctgaaggctgtggcttctgtctgtccaccttctcctagaaagaccacatcctgtgggttcctgtaactgttcctccttgctaccccattcgacctgaggttggaaacttcctctagttgttgctctagccgcaggctgctccacaatccctaacccacccaaacctttgtctaaagcaccttccttacaccctccccagctgtggcatttcggggccctgttagcatccacgtgatgctgctttctacaaatgtgtctatttgtggtgacagcacttgcgctttgctttcttccctttcttatcctacctgatatcccagccttctgcccctcagctacaagaccactccataaccatagaggaccaaaatcacctaggagcttgagagagaaaatgtatttgacatcttgaaaataatgcagtttgctcaggggatttatttctccctcccctgggctctgcgctcagaccctctttgcttctgtccgactactgcaagcaggcagttaagattatttctagcaaatggacttagagaagctgagcatatgagtgatgttgaaatttgacctacacttcttttttttttttttttttgagatggagtctcgctctgttgcccaggttggagtgcagtggcatgatctcggctcactgcagtctgcctcccgggttcaagcgattctcctgcctcagcctcccatgtagctgggattacaggtacatgccaccatgcccggctaatttttgtatttttagtatagacggggtttcaccatgttggccaggctggtctcaaactcctgacctcaggtgatctgcctgcctcggcctcccaaagtgctgggattataaacgtgaaccaccgcgcctggtgagctatgcttattacttagatttctagcagataacatatagttatttcctaaaactctgttcttaacctgagctgtttttgtcatttttcagggttttagggggtgggaacatattacaggagctattaggtgcatgagtgtgagttgcgggcatatgtgagggttgtgtgtcttgtgtctatgcacatgcgcaggtgtgtaagtgggtgtgaatatgtgtgagcgttgcatgcatgcatgagttgtatgtgtgttgcatctgtgcgtgtgtgcaggtgggtatgagttagtgtgagtgttgcctgcatgcgagttgggtgtctgttgcatctatgcatgtgtgcaggtatgtatgactgtgtgagtgtgtgcaggtacagcttctgtattaataagagacgggcaatcactgtgcactgatattgaggggtagggattagagggcaccttgtctatttgggaggtgaaggagggctggaatgagaggctgaaggggtacagaagaggaaggcagacccctgcaggcctcagggacctagcctccctcccttcagtgtcccttcctctccctgcaggaaccagaaaaagtgtggaggtctgaattgcagtctctaaaatctctcctcagtctcacatgactggcttcagttttctcaccagtcctgcaaagccaggccttgaccccttatctaaatatccaaagaaaaaaatggaattagggatcttagaaggaaagagtggggcaggaaatgcaccaccagggcagtgcagcttggtcactgccagctcccctcatgggcagagggctggcctcttgcagccgaccaggcactgagcgccatcccagggccctcgccagccctcagcagggccaggacacacaagcctttgacttcctcctgtcactgctgctgccattcctgttttgtggtcatcactccttccctgtcctcagactgcccagcactcaaggatgtcctgtggtggcatcagaccagaggcccctgaagaggagtgagttgggtgttttttgccgcgcccaaagcagctggctgtcccctgaaagatggcaagtggggaatgatgatggtgcaccatcgttctgcacaccaagcccttctggataggaggcccccagcagtggagggatgggggctgccaactggcattgcccagaggcccagctcctggtcacatagactgacctagcagtgcaccagctacccgaggcagcctgcaggaaaggtgcactcatagcgatgctggaatgccatgaggcccagccatggggttgagaactggaatggagggaaatgtttgcatcctgatgctgggaaacaggagatcagtcctcaccaacgctgagatgatttccctctggttcttaagctcggttctctttctgcttgatgcttgaatctctggtgtctggcagagagtctggtgtctggcatagtgctttgtatgtaggtcatgccagagcatgctggtgactttgcccttctaggactcttttccatttcatagggacttgctgtgaaaccccgtttgacctggatataaatgttagatgtcatggagtcctgttagcatggtgagctgcaggctgttctgcatgagtcctccttgagcctgcatctaatacccactgctcaatcaatctcttttcactgtttcccattgatcccaagtgtgtcctctgtgagccttttcttgacactgggtcacccagaattactcccctgtctgtgtccccatagcaccccacaaatagttcaatcatagcccttgtaacattctggtgcaccagtttaaggacagagccctgtcttattcatcattgctggtggatgaataaaaatgttcaagtcgtaataacggcaatgacaacaatgataaactcaccacttactgaccattggctgtgtgccacaggacataggactgaacatcttacaggtgttatcctcatgtccactctctcagactgcacttctatcgtattctacagaaactgaaggatggaaggtcacagagctggtgggaggggagcctggattcatacccaagccgtgtgcctcctggccactcctatgggtgaaggaaagcaaagggcttagctgtagctgggatggagaaagaggaatctcaggcttctcgtcatattttgcctcaagaactggaaattgatctgggagtagatcccacactgagggagaaggccccagaccaagaaaggatgggctcatctatttgattgaaaacagagaagcttggaagacccaaggtagggcaattcctgaaccgtccagggctggaaaacctgtagcaaaggcctggggagatggggcagaaaggctaaattataacttaggaatctccaccaggagatcagctccaagacagcttccagtttcggcagatggaagggatacttgatggaaaaggagggagggtaagtgtcagagactgctaaatgtctttacctacatttcctcatttcaaactctcacagaacagagtctgaggtagactctagggctggccccattttgcagatgggtaaactgaggttcagagcactatacccgtaagatctttgctcaagaacttgtatgtcccagaccatgcttgaaacctggtttactcacacaccctgctgtgcagacctcctccgttccaaagtggtggcagacttcagtgtgctttgcagactttcaatctcagcacatgctgtggaagtgctagcagtgttgctgtgctaaccctgtggttaggctgatcacagtcctggtgagtaactatggcctgcagccctggcatctgaaagatgaccccttgcctctcctgctgtcctcaagaaagccttagccccctagattattttcaatataaaatgttcatacactacttttcagattcaaatttgcacaaatgaagtgaccgttagacaccactggaaggtaataaaacccccaagcctgccagccatcaggtccctcccagccatcccagaaatatgctcagctgccctcgaaacatctgtcatgctctctggtgggtgctactgggcacctgacattagatcacttctctcccaaagctgcagctctgcttattcgattcttatttctgcctttggattgagtggaaggcagtcatcagtgacagccaccctcggggaacagaaacgatgtccacagtggcaacgatcctccatcttcctgcactgaggcctaatcaatgtagcccatacccagcctccatttaataagctgattgttgagctaaatcccgcacactctccccttgccctggacgcttttgattgacaaaactaatctctcctccacccccacgtctgctgctgcccacatcctcttgcaaatcatgtactcggctgctgacaattagatataagacttgggattcggatgtgggagggttatgaggttatgaatcaattgtgggggctcaggtgagataacaaaccaggggaacccatttcagacacctcgccacagccctcagagcctcctggttgatttatgagttggtaataacctcgctgggtctcctggcccctattatttttcataatgcacaggaaagctttaaatatcagagaatggggaagtgcacagtctgagtgggagggaggtgaggggggatggggcttgggggagaacagtggccaagggcttccccgcagctgattgtctctcctgccccatctccccaggccttcgctgcaggtcttctagtcctggacgtttcaggaattgctttatcttggctttttcaagcttctctgtttcattcaaatagatgagcccatcctttctcggtctggggtcttctccctcagcgtgggatctactcccagatcagtttccagttcttgaggcaaaatatcaggagaaacctgagattcctccttctccatcccagctacagctaagtccttcgctttccttctgtgggtcaccacggggtgccgttgtcatatacccatggaggccagcaagctgatctggccaacctgggagaagaccccaggttgatgacccctggtttaggagtgcatatggcaggatgcttgagggatcactgggcccaaaatcgtatttgctgtgtctggatgtaatgcctcccacctgttcaagaccacgtcagaatgactcagagacctgcctgttaagaagggaaaattatccgctggacaaaagccagtcaaaaagcaggctcaccctgcagtctggaagccagttgagcagcgaggacaggccaaaaaggtgggagggggccagtgagtgtctctcagcctggaggtaaagagctgaagactttacctttccttctgcctgctgtcctcttcccagtgacagccagtttttaataaggaaaaggaggaggctttgaattgctacctaatatttgtttaagtagtaatttgttgagatttctctgttttgttttgttttgttttgttttttgagacggagtctcatgctgtcgcccaggctggagtgtagtggtgcagtcggcttactacaacctccgcctcccaggttcaagcacttctcctgccttagtcatccaagtagctgggactacaggcacctgccaccatgcccagctaatttttgtatttttagtaaagacagggtttcaccatgttggccaggctggtctcgaactcctgacctcaggcaatccacctgccttggcctcccaaagtgctgggattacaggcaaaaagatgtgattttttttttttttttaacagtatcagtgggtgaaagaccctgaacctttcctctaaggcagtgtttgtaaactgcctatatgatgtctggtactagattgtgatgatgttttcaagggccacaaaacaattgaggaaaaatttaaaacatactgaatatacatgtgtgggtgtttatgtattatgatgtgtatttgaatacaactatcaacgaataagcattcattagaccccaactctgtaccagatgtttgtttactccatgccagggacagaactaacagggtccctgctctcttggagctacagtttagtgggcattatgggttgaattatgttctctcaaaaattcatatattgaagttctaaacactagaactccaaaatgtgaccttatttggaaatagagtcattgcagatgtaattagttaaggtgagataattagggtgggccctaatctggtatgactggtagtcttattaaagggaaatttgggccagtcatcgtggttcacacctgtaatcccagcactttgggaggccaaggcaggaggatcacttcagcccagaagttagagaccagcctgagtaacataaggagaccctgtctctacaaaaaatttaaaaattagccagcatggtggtacatgcctgtggtcccagccacttgggaagatcgggagaggcctgggacagattctccctcacagccctcaggaagaaccaacccgttcgacacctggatcttagctgtctggcctccagaaccatagacaataaattgctgttgtctaagccacccagtttgtgataccttgtcatggaagtcatagcaaactaatatagaagaggaaacagacatcgatcaaataattacattgtggctaattccaaactgagataaatgcttcaaggagaaagaaccttgttctcttgacgttgaaagccaaaggaccttgagccagtctggagggcaatgaaggccttcccgagggagttagggctgaaggatgtgtcagagtcagctagagctgtgttccccagcctttttggcaccagggaccagtttcatggaagacagtttttccacggaccagggttgtgggggatggtttcaggatgattcaagtgcattacatttattgtgtactttatttctattattacattataacatataaggaaataattatacaactcaccacaatgtagaattagtgggagccctgagcttgttttcctgtaactagacagtcgcacctggggggtgatgggagacaggaacagaacatcaggcattagattctcataaggagcgtgcaacctacctggcatgcacagttcacaatagggttcatgctcctgtgagaatctaatgccactgctgatctgacaggaggcagagctcaggcagtaatgtgagtgatggggaggggctgtaaatacagatgaagcttcacttgctcacccgccactcacctcctgttgtgaggcctggttcctaacaggccagggaccattacctgttgggaggctgaggacccctgagctagaggaagaggtgggaggaggaagggaaggcacgacaggcccagggagtagcagatgcaaagatcctgtggtgcaatggagactgttgcattctgggaagggaaaggcagtcccaaggcaggagaggtgggggaagaagaagagggtgttgggatggatgcaaccagagcaccccaaaccagaaagatgtttactccattaccttcaactgaattacagtggggtgagggcacctattttgctttctgccctcacttccgggaaatgcgcatcctggatcacagaaaagctgctgggcagaggtcccagtctctcagtgaggcctcaccagactagtagagttgtccagccacaatgccctcctcatttccccttctgtccaacaagctgtctatcggaagatcccagtctaaaagcaccagaagacattttgagtttctctaaggcctaaaatttaaaagctgataagtaacacaaggattccaagttactgctgtctctcccagccacgcagatgactgggttagacacttggctggtatgaggtccctgaaacatgggctctgtgagtagccaatgtgtattaatattaatgcttatgatatgtcaggcactctgcatgggttcattacccctcacagtcaagatgatgggtcccattattactgtcctgttttctttatttttgagacggagtttcgctcttgtttcccaggctgcagtgcagtggcacgatctcggctcactacaacctccacctcgcgggttgaagcaattctccctgcctcagcctcccaagtagctgggattacaagtgcccgccaccacaccaagctaatttttgtgtttttagtagagtcagggtttcaccatgttggccaggctggtctcaaaatcatgacctcaggtgatccacccacctcggcctcccgcagtgtactgttctcttttcatatgaggaaataaacgcacagggccagcagatgacttgctaacaaccagatcatttcagcaaaaccatgaaccaggcattgtgaagagagttttgtatacctggccttattcttaactagacagcacttcaccctagttgacgtatgaagaaatggagatcagggcaggtggtgggtaagggacctgcccaggttcccaccgtttgtaagtgatgtaccatgagttgctctcaagtgtgtctgactttataaatgctgcaccttatcatttcctatgcttggtaagcaagtgagtgtgaaatttgccacgcttttccttggaaaaactcaagcccattgaccaaacaatactacttgaaaatgacactgaacttttcatcactgtgtttctccacctgtgttcccttctgtcttactgccacctactcattgtgctcaccctccaaagcccagtttaacatttcctcttagttaagctttctctgctagctgatcattgcattttttttcaattaaggcataaaagaaaaaaaaaagacggtaaagattgtcctacttagaatatccttccattcatttgcaaaatggagataataatatgctatttacaacataggattagtatagcaggattattccagagcctggaatatagaaagtactcagtaaattattagttcaacagctaataatagtaccaattattattatcactaaattaatgcctctgtttcaggaaaaaaactgaatacatacagaatatcggttttctaattgttttttctttatactacttggaaagttatacagagttaagagacacagaatagtatagtggaaataatatttggcatgaaattgcctggattccatcagtagtagcctgtggtcttgagcctctctgggcctaatctttaaaatggatataataattatcatattggacacaattattgtcaagataacatgcgataacagggtcaagtgcccagctctggcctggtacaccatgggcactcaggaaatgtcactccgccttcataagcattggcctgtgcatgacatctatgtgataaggtggcctgaagctgtcctccccacccagaggtgcagcagaggcctggcaggaatgtgaaaatccaatggatcaagtcataaccttgactgaagagtatggtgagttcactcatggcaggaaccatctgatcattcatacggctccagaaacattttactcaaaagaaagtgtctttccccaacagtcaagattgataattagtttatgaattgcttcatttatcagtactatgatgtactgtataatccaccaggtttcaagttactggaattttgcaggtgatgggaaccagtctttttatcaactttgcataatctgatctgggctcagattgatagaatgctttgggaagaatcaggggagtgttttatactaggatctcctgcggttctgatgcgttaatgggaggaagctatccctgtcaaattctacaattttggaggagcttaaaacacctgaagacaaagccctgaattttatgagtgtctgcctgaaaccagaaacagaaaccccttacagcttactcaacagcgttaattcagcatggaaaggcaccaggaaaagatcactgcgtcttactcccaccaagtaaacaagctaacaaacacagaggagaggtgcaggttggcacccttaggccggactctgggtggacagccctgtcagagtctataaagggtcgctctgaggctccaggagtggcagatggccagagagtggccaactggaggcacactattgagcctcgggattgagcctcccactgtttacccctcaggaaaaagagagctttgagtctcctggccctttccccagagagcaggaaatggccagggcttgaggatagccagaggccgtccaaagttacccataccatctccactttggcctcagaggccagctctttcttctctctgtgctttttaaaataaaaacttatttttctagtgtaaaagtattatatgaatgttctatgaacttcaaataatacagaaatgtaaagaatagaaatttcccattatttgatgcctcccgctccccaaaataacctaaagttaacaatttaaatatatatccagaatttttcctctccatatttatatatatctatacatatataattaatagaacataaatattttacagtaaccctgttctcaagatgcttttccactgtagatgtttaataaatatttattgcatgaatgagccataatttatttattcagtcctctattagaggcctttggtttgttcccagtcatctaataaacatgattttagatataaaagacataattgaaatacatataacacatacagaaacataacccataactgcatatcataaatatatccttaaatatactaataaaacacgcatgcaatggagaggtgttttgggtgccgtctggtgtatatcctggatatccctggaatatatattgataaatcagcctcaaaaagaatgctttcagacagtgttttaggatctgtgggaacaaagggtggccatcctgcatttgttatgttgtttcaacatagcatttgttatgttgttttattaactttaagtccttggcaaagcagcttgactaagataagatccagaaaccagtcgtggtaacaaggcaacaattaatcttagatagaacagaaaaggaatccgcttcaaattctctttagaacaggaaggaaagggtgatcgtgggttagcaggaaggaaggaaagaggcaagaaaggaaagtgaaaaaagaatggaaatgctttctcctgctggtgatttggatgtttggactactcttgtcagatgctacagcgtaatcactgtaaatgttttaaaggacgcgatattatgacagatttccctttctgacttgttcctggggctgcacacacaatgatttactccctgccacgggctggaggcttggccactcctgggttggtccaaggaagcctggaatacccaatgcctgtgagagtgagcacgtccccctgtctctaggtgttgttgcttgtgctgaaatggagtctaccaagcattgccatggcatggaagggatggtggcggagtagatgccactgcagattgagtgcagtgtcccaggcagccaggggcagccgctcagcccttgcctggacctgaggactgttgcatcagtctccagatgagacagcagctgtcatggtggctgaaccagggaaaagaaactccactctgtggtctccatggggctagggaaaaaaggaaatgggtttttgtgattttcccttctttagaaacaaaagtgcttaaatgtgattctttagctctgtaaatgcaaaccacggcctggtggactggggagaacaattaggccaaaggctgagcacaggaagccaaaagcgggtggaaacccagacaacggtgctgagccgggggttggggtggttggggggagcggatatgatagcaaggaaggagtttcaatgtgaatgaatactaattagtgacatggatattaatgatgacagtaattaacaggggaaaggaagggctgtcattgtcccagggtgagtaatcaatcttggcaggtgataaataatggttcagcaagctcagcagaaagataatccgcaggcctgggggagaactcagctaatgcaggaaacctcacagtttctaggcaacccacagaaaagaactattttttttttcttttttgagacagcgtctcactctgtggccaggctggagtgtagtggcgcgatctcggctcactgcaacctccacctcccgtgttcaagcaattcccctgcctgagcctcccgagtagctgggactcaggcatgtggcaccacgcctggctaatgttttgtattttaatagagacggggtttcaccatgttggccaggatggtctcaaactcctgacctcgtgatccaccctcctcggtctccaaaagtgttgggattataggcatgagccactgcgcctggccagaactatttttcttttgaggaaaaaacagattagagtatctctcccacccccagcttgggactacagttcttatttgatttctgctttgttcttcatttcctgggacaaatgttgaacttgtataacttggaggaaagggacacacaggcacatgtacacacacacatattcattctctctctctctctctctctctctctctccaagaatacgaatgaatacgagtgtttttgatctaaagtttgactcacagatgctgtccaggagtagcaagagtgaggagaagcctagaagtgctgcctttgaggttggcgcggggaaactgcaaaattgcaaggctgtgtcggcagaactggggcacacaggaggatgaggatggccctgggggtcccactgtgcagggttacttcacctgccatggacccagagagaaacaaaatgtctaggctttctgtcctgtaccagtcccacttctggccaccagtcacatatctaagaaaactgatttctgggaagagggcaatcctcatgaagcccctctgctggatccccaggccttcagccaggaatccagcccaggagagttcttggcacatcccctccctctcaccaaagcctcagacccacggtaggactctgatatctaaaatgtctccccttgcaggctgtgttccatcaaacaatttagaggtgacaaagccacaccttcaatggtctgcactggtttaaagtgagatctttgggtggcaaaggtagattgaccagaaattcagaaccttccagaaaactgaactcctctactgccatgtacacagtgctgctctcagaacattgtttgcgggtcacattttcaaagagaggcagacagaagggaacttattcagaggattgggaacatatggtgaggaactccaggccacaccctgcaaggaagcagctgagggacccaggcctgttgcacttggagggaggacgtcgctggtatgccgcaggactgtctgaatagctgaagggctgtcgcacagagtggttaggttggggtttgtttttctatcatcaaatggcaaaactgaggccaaagggaggaagtcagagaggggcaagtttctgttcagataaatcaaggctgatttaactgggtcaggctgggtaggggggagtttgtgagtttccaggtactagggattctaaacacaggttacagcacctcttgtccagggtgttgtgaatgggacatgtattggctggggttggagtagacaagctttaaaagttccttcagggccgggcgcggtggctcatgcctgtaatcccagcactttgggaggccgaggcgggcggatcacgaggtcaggagatcgagaccatcccggctaaaacggtgaaaccccgtctctactaaaaatacaaaaaaattagccgggcgtagtggcaggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaagttccttcagactcttaagatttatattcgttaaggtaatactagataccaaaacagctaagtcccaaatttcaggggcttaacacaacaaagttcagtcctttcagtcctcaatcaagtcagagccccacatgggcgtaatgtccatggttggaaccgtggctccctgcctattgtggctctgcattcccccaggtctttggagtcccccacatccagccagtagatgggattgaaaggggcagagctaaggagagccatgtaggagtttttatggtccaggtctggaagtggcatatgccatttctacccatattctattggcagaactcagtccatatctaagtgcaggggaggctggaaatgtaatctagctatggcacagtgaggagaggaaagaggtcttggtgaatacatagacgtttctgccacaaatgcagggacacattcattcaggataggcctgtgccggaagagatgagagttttgcaagaacctatgaggtcacctgtgttggtcagcccttgtaattgatggtagggagctgatgaggcctccttcttcaagaaatggtctgggggccaggcatgataaagcttcacctagcacgtctcagggaagtcctctatagacacttcctagaaacatgaatataagctcatcctgcatcatcagaagtgagtgttttttggacaagaatggaattgtaactatggaagtgtactgaagaatggaaagggttggttaggacaaaaaaaagtgcccatattatcctgctctacagtgtggactgtttggaattaggattctcttaggtaaacatgtttcttctgccacagtgttaaacacccaggaggtcttcagctgaaattgctttatcgttgcaggtactgacattgtgcagtggcttatgaagaacctttccattgaggacccaggtacttgacctttgaccccacccttatctcccctggtatcagtaaacatcccataaccaagttccaaactagattcccctgccctcctgagaactggtcttgtaaatgtgaattccaagacgtggaatcactctatttacaaataaaattaatttattttctccactgaatatttgtctttaaatttaaatcatgctttgaggaaatgagcaactttttagaatgccaaagagcccaatacaataatgtgtgaaatgagttgaattctcattagctgcagcaattaaagataagttgtagcactgtcactgaacagccttctagagccagctcttaaaattagattgcctgatccacaattaagatgtttaattatttgctaagactccctctgttttctgcttctgcaagaagtgaaggaatgattttttttcaactttaattgcgcatttcaattaggaagaccttaccaggaaaacaacaacagaaccctggccaataaaacaatttcccagtctgttctcccaccagaaaataggcagtaaaatttattttcacagtgtaattaggaaatggggggggtgttccagaaaaataaaaattcaagataagtaaagcttattcccatgtgctgtcagttaatacttttccgaatttattacatactcctttgccttgattaactgagtattcttgatgcctgaaggtcacatttataaagatccactaatacactctgatgttcttaatggacattggcgtgattagacttacctgccccaaattaaatggccctgaaccacaatgctttttgaagatttttttgaagtgcccattctgcatccgtgaccttcagctgtgagtccctgctggaatcggtgtgtcagcttggcactcctgtattttaacccaacatttctaatctgttgactgcaaaacaatacagtttctatgcagttcaattatatacagttgttagaactctgagtgccagaaaagcagatcattcatagaagtggcccgagtcttttcacccccttgattagtggctactctcacaactagtgaaaattcttaattctagtcaagttcttgattcacagggaaaaaactataaatgctaaccctttgtaaaggatagaacccaaagcaactcactatgtgttgtccctgatgcagcctgtacttctgagtgtccgcttggaaagcctggactgaatcagcatctacctgtttagttacatttatctaaagtcagtatttcttgtgattataatgctaaactaaggaacgtgtttcctcatggccaccttttctcttccaagagcactggtttctttgcctcctaaaataatcgttgtatttctgacatatattttattattactattatgagaaccctaaattggcgagcagtatgtgagaatgagcttcaggaatcctccagccctggcgtgagaagcttctgtgaagggtcctgaatgatgagagttatttctatgaaaatctgttatactctgatgcccttgggaagacatcatggtataggggcctgtttgggcttctgagaagtggctgaggagaagctaagaaccatttgtcagctgggaatagtctaaggggggagatgaggcaaaccgaggccttgggaaacagtcagatccagcatctgcccctctctcccttctttttcccatcagtcgatttcctgtggttattttttggtttttgaggcaaggtctcactctgtcacccaggctagagtgcagtggcacgagcatagctcactgcagccttgacctccctggcccaagccatcttccacctcagtctcccgagtagctgggactataggctcctagcaccacatccagctaattttttgttttattttttgtagagatggggatctcactgtgttatccaggctggtcttgaactcctgacctcaaacaattcttctgctttggcctcccacagtgcttggattacaggtgtgagacactgcacctggccccattggccaacgtctaagcaaaaacatttttgctcagagaatgaagttagagtcttagctccaagactggtggcatgaaagtcaccttcctacaggattttgttctttcttctctggggaaggagcaactgctgatgatgaaacttctgttctagctggactcatggttcttgaagcatatggactttaaaaagcaaaccggccagacatggtagctcatgcctgtaatcgcagctctttgggaggctcagctgggaggactgcttgagcccaggagttcaagaccagcctgagcaagatggcaaaaccctacctctaccaaaaaaaataaaaaaaaaattagacagacgtggtggcatgtgcctgtggttccagctacttgggaggctggggcagaagtatcacttgagcccaggagttcaagtctgcaatgagctgtgatcatgccactgcactccagcctgggtgacaagagtcagacctgtctctaaaaaaaaaaaaaaaaaaaaaaaaatagcaaattggtcatcactaagcaagtaaaataaaactctattcattccaattccaccagttacatgtatgtttctttcaaaggagaataggtggttcttgatacgcaaaacattgcattgtattcaacttcttgaaaagtttgcaagtaaagccaaaacaaactactttaaaaagtcagagctcgtgaaattaataattgctagaggctccctgagcacattaacaatttccatgtccaaaaattagttttaacctgtaacagtacttttggatttgtgaaagattgtgtgtggtagaagcattgaggtttgttattttttcttagctctgctcaggataaatctaaattcttaacttttttttttttaattgagacagggtctcgctgtgttgctcaggcttgtctcaaactcctgagctcaagcaatccgcctgcctctggattacaggcgtgagccaccatgcccgacctatattctcaactttctatgtgcatctatttatggctggtgccaaaggaacgaaggaacagattgactgtggcaaaaatataagtatttctatcaggttagcctctctctgtcactgcccacttcagtgtccttcctctaattttcaaaggaagtgaggttttcctctctgtccataagagaagggtgacacccttctcattcctgatgggactgtcatattggggaacgcactgggagtcctacgtctctatgggcagcgaggctgcattcttactgctggggatgatgaaactggtatgaatcagagctgctagcacttacggagtatttgacctgtaccagacaatcacttcatgtgaaatatctcacttagttaaatacaggttcttctatgccagaacttatgcccttgaccctgaagccagactttcttctgaaggtcagggtgaggaggggttaagccatgtcagactctcagaggtgggattcagacaagtcccagacacatagttgccctttccagccattggcatctcccctcctcacccccacactgagcaagggcaattgtatcatcaacacagacatctgggggtgatgacagttgacttctggtctcccagcttaattttcagccaaataacctgctttctaattccttctctctctatgcactgttcttacagttgaagcaatacacttggggagccttatcgctgcccagggctacatctttccaatctcagaccatgttctcaccatgaaggatgatggcaccttttatcgtttccaggtaagcctgctggctcctcctcctgaagaaccttttcttcacaacatcatctgatcttaggttagaactacaaagaaaacctagggatatctgagggagtagccctcactcctcatcagcactgggaaagccaagagaacttttctctgggccactgggtgacccacttagagaatagtaaaaggctgtcattgagagcctaccatgccctgggcactgccttagtcccttgggctgctacaacaaaatacctaaactgggtatcttataaacaaacaaacaaaaaatttacttctcatggttgtggaggctggcaagtccaagaccaaggtgccagcagattcggtgtctggtgagggcctgctctctggctcatagatggcaccttctagctatatccccacatggcagacaggacctggggcttatatcagacctcttttataaaggcactaatctcacctgtgagggcttcaaaggccccacctcccaataccatcaccttggggattaggatttcaacatgtgaatttgaggaggatgcagacattcagaccatggtagacactttgtacagatttcctcatttattctgaagagcacactttagggggtaaatattacccattttacagaggagaaaactgaattgctcaaagaattaaagtgtcatttagtaaatcctggagcagccttcatctgaacctaagtgagcctgatagcacagaccttgatctttctactgtctcatgttgccttctcggagtgaagtttctatttgcgacctaatcaccctccccacccatttcacactccttctcccagatccttccgtagagggaatgagggcagaggatatgggcttgaatcaaggtctaaccaaagggtgtgggagaagagttcttcagactaggttaaagggaggaaaggaacatgggcttaggtgcccagtaagttatgccagcctgacttttgtacttagacctctattgtctcaggataagaatatattgccctgtgaacaaaacttaacatttttgcatttgttttgcttacttacattttgcttctcaatgcctaggttaaaatgttgactcaccttagctgaattagagaagaggagagaattgtggggtagcatcagcaagaaggagatgggggagagcctgccatcagggaggctcctccctgggtgtgggagggaagcgcaggcatggcgcgcccctgagcactaacacccatgctcctttgcaggctccgtacttctggccttcgaactgctgggaacctgaaaacactgactatggtgagaactgaagccactgggaactctcaacttcaacactgtgtgtcacttctgggggtgcagaagacaaatgcttggtgtgggccatggtggtacatggggaggagggtcctttctgcttagtcctttctcatattgttgctatataacaaatctcctgttccacataacagaggaaggcccagcttactgaaagatgtagtccttggaggggaagcaggagagggaagaaaaatcttatcaagggtggtcagtatgttcatcttggggccatggagaaccaggatcccacagcaacactatcagatggtgacttttaattgttctttccagggatagggcttcagggagggctggatcaaggggctacctcctcctggccctttctgttctcatagacttgtcaaaacttactaagaaccttttggtgttcttgacagttgcaatttagaaaagagacagagaccagggaggagtatacagaagtcactctggactaggaaaatagagtgggtgaagttgagagttctgtctctctagacagggacctacaagacttctgccagatattctcagtggagattatttaatattcctatatgccaattctctgaagaagttttattatcgctatgcttaagagaaagaacctgaggcccagaggggccacaccctcacactaccacattgtctgaatgctcccttgattataagcctcttgagggcagaggctggtccagcttatgcattctcatatctccagggcatagcctatgtctgaggcagaattagtgctcagtaaatatccactgacagttctggttctttattgaaggtgaccaacagacactcactagagggagcagaacttgaactcagatctgagtggctccaaaacccatacttctttcacggtcccatgtgtgacatgcctgaaggttgtagctgcagcactgcccctttgcatgcatccttgctgctgactcagctgctgtggcagtctcatctgtggctctccttgggactgggacactcaatgagacctgcagcttctttgcagaattgtttaagacaagaaggcagatgcagctgtggtgagtgggagggagatgtgcagctgggtggtgatcaggggagcctgtctgggagacccatgggataagatacaaccttggagtcacacgtttgagcaagaggaaaccaacaacagggagccaagctgaggatggaatacaagcgagttgtacctactaaggctggagttgttccatggtcaagtgtggaggacgtcagtcatgcagaagggcaggctctggggctgtctgcttggctatccacaggcaccactgtgggccctctgacactgtgctgcaccctaaccaatgtgataagtggatccaggaagacttccgactgcaagtgagagctgcatttgaccgctcataaaactagtgcttctggggctgaaaagactgctcatgaaagcccaactcagaatttgaataattatagctcagttccatgcagcaacgtgtgcccttgtgaatgtgaaaaccagtatttttccaggcagtggagagggtgggaggatggtaagaccagatacctgggcccaagtaagattaaaatatttacttccgtaaagcttagggcatcttatgctgcatactaaagggcatcatctccctgttctacaggtgttcttcattttataattttaattgtgcatcatgaacagggagagaaataatagtttgtttcaggctctcattaaacaaaaattattttaaattcctgtgcctcaatttatggcaaatcagagggagaaatcaaggttcaggatgcacaagtgttcaccagggaccaggcatggtggtgcatacctgtaatcccagtgactcgggaggctgagatgggaggatcacttgagcccaggagttcaaagctgcagtgagctatgattgtgccactgccctccagcctgggtgatagaggaagaccctgtctctaaaacaaagaaaaaccagtactccccagggtttccaaagcagtttagttagaaaatcaggatgtatttatgaagagagaatccagcacaatgagcccccaggatcaacccgttccactagctgggtgatcttggcaaattacttaacctctctgtgcctcagagacctcatattaaaattagagtagtaatggcacttgtctcctagtgttttgttaggattaaatgaaatgcatgtaaggttctctgagttaatacggagtggtggttggtatcactactggggtggggtcggtattattgccactgggatgttggttgatattattatgactgaggtgaccgtctcaccaggaagcatgtgaaactgaagctaagaattcaatatagtatgatttggactgatgaagtaccagaaactttcattcaattgacaaacgtttactggtccctactctgtcaaattctatgtcagagatttgaataagtcacagcctttccccgcaagcattccaggctgggagaggcagcatgatgcagggaagaaaggcatggtgaggatctggcttgagtattcaaaggttttatgtgatgaatgactgagaaggctgaatagcttgggaggggcaggtttataaaaaggccttggcagtcaagtagagacatttagaatggattcagcagtttggggaagctattgtgggtccccaacaatgaacacactttcccaagttttttccctacttgggaaaaaattggttcatctataagatgggggtaataacagaacccacctagtagggttattatgaggattaagtggactgtggaagattaagtaagggctgtgacttagtcaaatagttcctgatattcagtgggctcaatggaagcagtagctgctacgatggtgatttttccagcacctaaaacggtacttggcccataggagacactcagtacatttttgaatgagtgactgaatgaataaatggatcggtgaatgtcatagaggaaactctgcactggtcctcgattctaattccatctccatcactaactagcccttgggtccatcacttcatttctctgggcctttagtttccccatctgtaaatgaggggcctgtacttgatggttgccaaggttacctccagtctaaaattctttggttctaaaaagtcatcagaaagtatgaggaaaatagagaaataagtgagttataggttccctagtttaggagattgaggtacataatgatgttgctagtaaaggcagaaagtaaagaaaggggtcagtttcttcagtacattgaaactcgataagctcaatattttttaagaaatttaattgcacatataatacatgaatgtgttccctttatacaatttttaaatatgtcccagttttgtgtggtgacacatggtgaacttgagatggcagtggatttctctgagtgagatgtgagatataggtaagggtggaatgccagatgtaaggacaaggaaatagaaatttttcggtaagaaattaaatatccaagagaaaccaatatctgagcttaagacagttcttccagatgccctcttgtagggctggctattgtcaccagtagtcactagagtcggttggaagttagagcaagccctagtgagggcactctgggatgcagacaagccccagggagttctgtgccaagaacagccacatcccaccttcctcattgtggtgaaaagattccttgtgtgactttaggcacagggacattagctagtagcatgtgaccctgtgactcatggccatcaggagtggccccagctctgcattccatgcatgataactcacttcacaaccccgctgtcccattttgaccccgcttacccatttggacatttcttgggatgactctgcctgcataaaacccacagtcaaatccaggttagccttttctgagttttacatttggccagtgcaaaatcctgtccagggcagcattgtcaaagcagctgccacctccactgacctgcactgctcaaaggtaatcatgacctggcccagtcgagctggtgacatgtcaagcttcctgcctgaggttgtccctaattctgccaggggtccaagagactgaaggaggtactttgtgatagatcggacacccctttatcagacacagtgaagcactatagctgcttggttcattggaaaagttggtaagtagaaaatcatttttaaaacgacatatgcacaccttaagcacctcatgtaaaggtaagatatacaaaggaacactcatttgacagccttgtgaagtaggaccaaagtgttctctttgattatgagctgaataattttagtttcttaaatcaaccgcactcaaaataaactaccctgttttggtatctttaaagtgcatcaagaatgtaaagacatttttgtagtcttttgtatattggcccctcctagatttttattatttttcttactttttcctgttatctcacctgtatcaaattcaccagcaattgccttagctaactctccttcattaaattgttccaaaccattcaactgagttttcatagaagcaacactctctctcttttcacattaatttcattgagacgtgtgatatttagtgaacttgtgtgattaaaataacagatgtgcctgatataagcagatttgggaacaaccacaactgactcctatgagcacacaattcgccgggtggaagcagaagtgtgggcataccagagggtaggctgctagcttccaggctccaaaatgtcataggtatcagtaaatttttcagaacaaatgaaggaagttggttgatccagcaaagagttgactagagatctcttagtaaagagatcttgttgtccaacaacaaaatgatcacaggttctctctggccctccctcttgatcattctgttgttcatttatttatgccattcatctactgttttccctggattgttccacttggctctggagaaggaggaagacattgaagaaggaaaggtagggagaagaagtgatgatgaaggccatgtttgaggaagaaacagggaaaccaggggccaagaacctttccttagcctgagttgagagacctaaattgtcttccctttccatagcctttttactgcacctgacaagacaggctatggtgctagcaacagggatgaaagctgagcaggacatagcctctgcccttaaagagacttcagcctagagcaggggacagtctagtaaatacaggatttcagtgcaatggaatttagttccatggtcaaggacatgtagatgctatctgaaacaccaacttgggtcttcaaagattagtaagaggttgccagatagagggaaggagagaagagagaaagactttcctcaaaaaggacacatatgcaaaagaatgaagctgaaaagagtttggtggcctcacagtgcctgcatgagggagaagaagttgatgagataagcagtgagcagatcataaagaaccatatttgccatcctaacgagcccaaccttacttctgaggccattgaggactccaggcagagcttttaggcactggagtaatgtggtcatgtttgtgaaatatcactctgagtgtaggatgttcagggtgaagcagagtgaggaggaagaaggggagttgtcaggattggaatatggaggagtcctcatttgatcatgactatgaaaggatttatagaggtcaggggtcatgaggtccacttagaaaacatatttttcccaggacagtgctcatgaggtccacttagaaaacatatttttcccaggacagtgctgggcacatagcaagggtgggtgggcgggctgtctggatggatggatggatggatggatggatggatggatggatggatggatggttgggtggatgggtggatgggtggatggatggatggatggatggatggatggatggatgggtgaatgggtgaatggatggacagatggatggatgggcttataattccattgtgctgctggttttgtacatgttgtcatttcctttcttccctcagccatctatctctgtaagaggacaatgcaaaataaagcaaggctggaactggcagattatgaagcagtaagtatgattattttccaggatacatataagaagagagtaaaatcatatctgcagctccgtctaagtttattttttttttcttttgtcccccttttgtccctttcagacagtggaagggaagtatcttctatttctcctcccttgttctcagctcctctgaccatcacaataagatggtgtttttacataaataactcttaaaactcaacaataaaaaaataagcagctcaacttaaaaataggctaatgacttaacagatattttaccaaagaggacacaaggatgataaataaacccatgaaaagatgtccaatattattagccatttaggaaatgcagattaaatccgtggtgagatactgttacatacctattagaatggccaaaataaaaaatactgatgataccaagtgatggtgaggaagtagaacaactggaactctccgctttgctagtggtaatgcaaaatggtacagccactctagaaaatagcttggcagtttcttataaagttaaacatacacttaccatataaccaagcaatcccacttgtatatacataccctagagaaatcagaactcatgttcacacaaacacctataaactaatgttcatacaagcttaatctgtgataaccaaaagctgaaaacaacccaaatgcactttaacagttgaatggttaaactaactgtggtacatccatacaatagaatactactatgcagtaaaaaggaatgaactgttgatacacacaaccacttgaatgagtaccaagaacattatgttgggtgaaagaaaccaatctcaggccagccattccatttataggacattcttgaaaagataaaactatcatgatgaaaagcagatcaatgattgctagtggttatggatggggtagggaattgttggaaggtgatggaactgttctgtatcctgatcgtggtggtggttgtatgaatctatacatgtgttaaaatttacagacttgtacaaaaggaaaaaagtcaaatttactacataataacatttcaaattaaaattttaaattgcacctttatacccactctcctgtgcttagtagcagaggcagaatctaagggtaaaattcaattcagaaaataagacaagatgtgtgtcacatgaggtatctacttcccagctttcttaccttccttctctatctttcttcataagatgagacttcttgcaaaaattagaggccccaccaccaaacttgggtccattcccatttgacagagcccagaaaccaaagcacttgaaaactcatagatcatttaattttttttttaacttttggttgcaaaatttttcccccaaactgaactttacatgggtcacagagaatgggagaaactggctaaactttcttataccttctacttccctctccctatatgtcttccaaaggatgtgctgctgagccatgaatgactgaagggccagcagctatggaaggaggggcaacattaaggggagcagagaatccttccctggatagtccagcattaacagcatcttcagacccacccaccgccaaagcccttcctgcttttactgcctcagtctttcaaaacaagtgtgaggccccactctgccaggccttacctctcctaggttcatgttcccaagcctaccaagcctaccaagcctaccaagccagctgggccatcgctcccctctctacagcccaagtgtgaatgcgcatgccattggggagcaggacgtgtgcatggtccttcacctctttgatcccactggcattgtggacctgtgaatggggtgcagggggccagaagaggaagaagcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgcccagcaatcacagcacccctccttcaaaagactgctgttgtactctttgtgcgcccagtgcaagtagctttgacatgatgacattacctccttaacacaaccttgaggaaaggcccagacagtagaagcctggggcccctccctcctgtgtgtctcttccccatattttcaatgttttggaaaaaggtcccatacagaaatcagacagcatcaactcctgctgtatttgattcaatttctcttctcttgtcccttaatgttctgctctggtatttgtaaagaatatggcattgaggccaggtatggtggctcatgcctgtaatccccaaggtgggcagatcacgaggtcaggagatcgagaccatcctggctaacatgctgaaacccgtctctactaaaaatacaaaaaattagccaggcctagtggcacacgcctgtagatccagctactcaggaggctgaggcaggagaatcccttgaacctgggaggcggaggttgtgagccaagatcgtgccactgcactccagcctgggcaacagagcgagactccgtctcaaaaaaaaaaaaaagaatatggcattgagatgtgctctcaggttgaagttctgcacaaaaatgattcaaaaccaaaaaagcattttgcttccaaaatgcaataatttttttatgaattttctgattacatattctttttacaaaaacaaaaattcaaacagcaaagaaaggagagaatataacctgtgactccccctcacctaagttttttctatgcatacatttttttctttacaaaactatatcagaatcataacataaacattcttgtggcagctgcttctctttccccagtcattatactgtaggtatctcggggtctttaccatgtcagtaactataatctacgttattgtgtttaatggctgcctagaattctatgctatgactgtgtcacagttgattgacatttaggcattaccagttttgcttcctatgagcagtggaagagtcacaaagacagtttttagaagtactttcacaccaagcctgggtgataactgtgagctcatgtgtggtactctccaactgaagctccttttatattaataatccattaatgagggtaatcaattcgtgttggcatgagctctatgaaaatacatagcataatatgggctccggccttgcattcatcagaattaggaggatcattagggcgcctgtcaaactcccctcctcgccgcccatcctcatgttccattaggtaactctacagacttagagaaaatacttttctttttctctaacggcagccctcaatgacttttctttctgttttgggctttttctttcatgaacatcacaaacgtagacactccgtttggggcacttttttttttttttttgaaacagtttcattcttgttgcccaggctgcagtgcagtggcaggatctcggctcactgcaacctccccacctcccgggttcaagcgactctcctccctcagtctcccaaatagttgggattacaggcacctgccaccatgcccagctaatttctgtaattttagtagagatggggtttcaccctgttgaccaggctggtctggaactcctgacctcaggtgatccacctgccttggccttccaaaatgctgcgattacaggtgtgagtcaccacactcagcctcggccactttgaatcctgacattagaaaaagcatgaaagccaggtccctttggttttcctttcctgtgtccttcccagctccccactggaagaggagtcctgagaaatccagcctttggttttgctcctggagataccagcaggtggcaaagactcgttaattccccaataaccacagacaattttcccgattttcagcaacctttgaaacaagtgctgtgtgagttgcattcttgtaaaacaccttcatgaagagaggaatcaggtgaaccatagagacttcagacttaatgggtgtgtaaatgaatattaatagttcagctctgtacggagggtctggcgcaaagtcaaatgggatacatgtccaggggatttaaagcaggtcttgctattttgttggaagtaaccaaaattgatggatgccttataataagcataggtgtcgatgtgctaatttacgatgattaatgccgccttgttgattttcatttctcattaggaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaaggtgggattgtcaaagtgaagtttccagatggcgttagtatttctaatagggcctgagagcaactgagtagaaattaaagtcaggatggataagttttgtcttcataatcaatgcttctctaaagcaatttcagaaatgtgtgtttcagcagacaagggagatcctcccaaaggtagaactctggttataagaaggtgtacctatttccccaagagatttccagttattttctgtgttcaaaggctgaaatcccattttacccgttggactggagattttgtcttcatgggaaaacaggttggagttttaggaagaacaacaagtagcccctgtcttcttttccctgacaggggaggagtttagaaccaacagaaaaagaaggcacagaagtcagacagttggagtccaaaatatcagattattacattaattaaaagcaagagtaaggctgggcatggtggctcatgcctgtaatcccagcactttgtgagaccgaggtgggggtggatcacctgaggtcaggagttcgagaccaacctgactaacatggtgaaaccccgtctctactaaaaatacaaaattagctgggcatagtggtacatgcctgtaatcccagctactcaggaggctgaggcaggagaattgcttgaacccgggaagtggaggttgcagtgagctgagatcgtgacattgcactccagcctgggcaacaagagcaaaactccctctcaaaaaaaaaaaaaaaaaacaagattatagggcgtgacactggatatgtggccccaggtgaaaattaaatctgcccttcctgtacagaggtgtgtatctataggcctcctctccccagcatctccaccccaccccaccagggcataggtgacccctgtaagttttctgcatgcagagagcagctatcctgagcacaggctgacccagatgggggcccagagagggagagtctgaacttcttcaatttcttctttcaagtctaccaattagttaagtcatttttcctccacaaaggacaagagatgaaaggaagaaaaaagttggaagggtttttcccagatttttttctcctggatacatagtggacatttcttcctctctaaggaaacatgaggaatgggtactctatgttccccaccccacaaacatcgttgtcaaccagatccatttaattctgggaaacagaatgattggatctggatctcccctgtccctcccagggatgatgtctaggttagccaggatggttagttaacaggagaagtgggacaggagcaggaaagggatgctaagctgggagaatgggactatgtttcctctgggtaccacctgcatgtgagcagccgctgagtcttcagagcaacattcctgggcgatgttgcagcccgtggcctggagccgggtctcaggctgtgtgggtgtagactcatcacagctatggtcacagttggaagtgacctgaggccatctggtccagtggcctgtacactgccattgctgtgaacctccccccacagtctctgcctttctcctgtccatgatgccagccacctcctgaccacccagcagccccccggggataggcgggtaccaggcactgggtgcccccgaagaggtgcaggtgggagagtaggtaggatggaggctgggattcaactggactaaggcagaattatgcctgtgtactcagaagccactggaaagcaaagaggaacgctaatttgttcttccagaatcaaacagcatcacaagttataaacagaggggaaattgttacttcataaatacatggtatttctcgattaacttttttgattaactctgtgattacattataattgtgggccacctaagtacacagtaattatcacaaaaatcgcagggtgattatgggtttatttcagtccagtaaagtaaagcgttcccgagagagccgagacctaggagttacacggcaattaatctgagttgctttttacttgaaataaaatgaagtaatacatgcttttttaagaaaaaaaaaaaaagaaagaaaaagaaaaaacctcttatctatgctgcagatcagaacaataagaatctgtctttgtcacctgcaatttccctcttgcaatttgtgcctcccccagctgaggccagtgatatttgcctcctggatcttgtctcattctagggccattattctgcctttagaaagccagatggtgtaagtgacttataaaacacataattgcagcattttaaagacatttatttctactgattctaaatctaaagcaaactttcaaatttgaacatggaacactggcaagatggtggttacattccatcttataatttgtatatgcagtatcctttttgataagggggcatatcaatggataattcagtttttaataatccaaatcttaatacttcagatgaacagctgcattcttattcttcccttaggccaccatgttcattacacatgtatggcaatctgtaatctagcctaaaacaagttctcttaccatgtgtggaattcctgaggttttcggggggggaattatacacccctatttcacagctctgcagagagcaggcaccatgcaggtaccaatggccttgtgttcacttagcccctagcaacaggagcaaacgctggagcaagtgtcagaagggaaaacagaatacagagcttcttatttccttcctctctttactctttcaggattgaccggaaaaaagacaagacagaaaggaaaattttggatagtcaagaacgagccttttgggatgtccacaggcctgtggtgagaaagcgctactcaattctctagatttttttttcttaattgttcatttttatctctataaagaaaagaccgtctttagccaccaggtgtctcattcttaagaaaatcgctcagctttgtggaactggtttcgccattcatttatataatctcagtaaattttctggaatatatgtaagttccaccttttaaaaattattcattcggccgggcatggcggctcacgcctgtaatcccagcgctttgggaggccgaggtgggtggatcacgaggtcagtcgatcaagaccatcctggctaacacggtgaaaccccgtcgctactaaaaatacaaaaaaattagccgggcgtggtggcaggcacctgtagtcccagcgactcgggaggctgaggcaggagaatggtgtgaacccgggaggcggagcttgcagtgagccgagagcgcaccactgcactccagcctcggcaacagagcgagactccatctctggggaaaaaaaaaattattcattcctgaaaatatggaattgcaaatggagaagctatgggaattccaccaaaagacctttgtgtcccgaaggtttacattccccaaattaacaatttccatttccactgctattcaactctgaatcttcaactattctctgtcgaatacggttaattcttgttatccatggcagttatgttctataaagtctttgcaaacactgaattagcgcacattgaagcatcactcccgtgggaactaccaagctaggtccccgtgagcctgtggccacaacatttttatcagctgatcgatacataaccttttaaatgtgtttctgtataaagacagcttatgtaatatatatcattgattcattaacattaaactcatggccaacagcactgttgctcatgcctgcatgtttatttcctcctaaggcacatcagagaatggtgaacagcacttcagcactgtccttggggccattttaaacagcaaaatcaccaacaaaaagtacagaaatgcagaaaagttggcactaaattagccctaaatagaagggtctgaaacaaaaaggcaggacgtcaccttgttcaatttcagtgggaaacacacatatcaggctactcaaggtacaactactgagtaaggagttataaatgaaatttagcaagcaggcaaattcacaaatgcaaaatttgtaaataatgaggtttgactgtatttctgatttcacgttattaaaacaaatcttgcattttcctcatgaaatggaactaaaaaataaattattggtcttcttaaaatttgattaaaagcaaaaaataaataaatagctactcatcctgatatcgtggagtctttttcaaacggttaagtatgtaaaaaaaaattttaaggactgtgtctgaggcaatcttgccacttaaatagctaatttgctcttagaaactgtacactataccctctacatatcatccttagattatgaggtaagcttttctagatcgtatgggaactccacagaggaatgcatattatggcaaaatggaaaaaaaaatcatgcattgtctgtaatggaaaaagataaagattggtcctgatggtgtgacatgggctaaattggaagtgtaattttcacgtagtaatttatatgatgtgttttttttttctcagccaggctgtgtgaacacaacagaaatggatatccgaaaatgtcgacgtttgaagaatccacaaaaggttaaaaaggttcgctagtttagctgagttaaaaattcctgatgtgaatagcccttccagttctagtactattcaaatagtaatttgctacttgtaattctaccaccttttgtcatttgaaaccataaccatttcacaaatattgattgagcagctgatgcatgcttggcgctgtgctcgtgctaggatacagtggcaggtcctcatggagcccacagcctggcaggagtaaaacaagccaacaggcaacagggccatgaatgctgtgttaggagaggtacaggacagttgaggagcccaggaggggcagctaagccagacctggagtgggtgggggtggggggcttcccaagggcttcctgaaagagggtcaggtgttctgaagggtaagttgcagttgtcctggggaggtggcagggaggggaggaaacaaaaggagcaagaagtggcaaagctcacaggtgaaagcaagctttatacttagaagcaaataaaagtcttttttatggtttttttttttttttttttttttggatagagctggatcacccaaactcaaaccaccatcttgtccaactgtgaatgacccagtggtcacttgtgtttcactttactcaaaggagtagtggtcacagcatacccgagggtgccatgctcagactcccccacgattcatatgtcccaccctctccacagcaccagggacaatattgcaggacagcatgaccagactccgtaatattaatttccaaagagtgggccaggtacggtggctcacacttgtaatcccaacacttgggaggccgaggtgggcggatcacctgaggtcgggagttcaagaccagcttgaccaacatggagaaaccccgtctctactaaaaatacacaattagctgggcacagtggtgcatacctgtaatcccagcttcttgggaggctgaggcaggagaatcgcttgaacccaggaggcagaggttgcagtgagcagagatcgcgccattgtactccagcctgggcaacaagagcgagactccatctcaaaaaaaaattccaaagagtggagatgtgtccccaaacattcctatttcttgtgatgaccaattagctctctctcatgtatgcattaaaaaaaaatacacgcacacacacacacacacacacactagacatggcgtatgtatataaacttctttaatctacttacatattttgttcgtcactgacttaacaatatccactgtattatattttaaaatgttagtcctaaaatgtcctcatttcatcttcaagagccccataattctaacattacagaatttcatggagtcacatccaccttatctgagcccttctgcattttgatgattttgactacacattgcatgcccttcagtgtttcatttctttcccattgcaaagattgtgtttagtctttccgtaatacgaggaacagctttaaatgtagctatagctacggacatgtggaaaaacttaggccagaaaactgtttaacttgaaagggaaaccctgaaatgctgccatcccagttttgtaccagatgggaatctgctgaccaacggaaatgtagaggggatcttttgtgcatactctttggcagtggctcttgaactttctttattcagaatcatttggggcatttgataaaagtgcagatttccaaacccacccacaaagattctgatgcagtaagtccagggggcgaggggatactcagcaacgtgtcttttccaagcacacccaggtgattctttgcaggtggtctatggaccatatttggagaaacactgagatacaaggaggctattttcagcccaataaaagataggatttgggttatagtggtaccccaaagatgagatgacatgccttaagaggcagcattctcatcattgaagaaataaaagcagagaccaatctcttattgtcatgaggggattcacgaaattggatgagtcattggactagctgacccctaagccaccctccaattctgtgggtggatgatcctctgtgcttgcttcttctcctagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgccatttcagcattacttggttgaatgttattttctttcatgatgagcagcccaggtcaacagacaatggctaattatattacttccttctgatatttactggtaacaaagcaacctactgtttatattatgccttgctggttcctagagggcaaaacccaaaggagtaaactttgaggtgcttgcccttgacaagtttattatctgatgggtaagaggtaatggatatatgaaaaaaaaaagctatttggcggggctcggggctcggtggcccacacctgtaatcccagcactttgtgaggctgaggcaggtggatcatctgaggtaaggagtttgagaccaggctgaccaatatgatgaaaccccatctctactaaaaatagaaaaaagttagccgggcttggtggcgtgtgactataatcccagctactcgggaggctgagacagcagaatcacttgaatctgagaggtggaggttgcagtgagctgagatcatgccgctgcactccagcctaggcaacagaatgagactctgtctcaaaaaaaaaaaagaaaaaaagaaaaaaaaaccacacagaaaaaaagctatttgatgattccagtcaagcatgccaaggacatgggtgtgacgtgcctgtgaaaggtgggcagaggaggggtcactggggattgttcaaaacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagaggcacaagtaatttgctggagggcagagctgagggagttggagatgtctggccagaggaggtatttggatcttggtggaaatgcaggatttgggtttgtggagcgaggggaaaaaaataattttagtttggtcttaacatctgtgttctctattttcccagataacatttttgaacgcacagatcgacagacattgtttgaaaatgtccaaagtggctgaaaggtatgttttcctttaataatattactactttcttctaatttaacagggaagaaatgttacagggttatggttaacgaatgtgttcaatgccaagagttagactgtagttattccttagactggggtgcagaaaaacccacaggctccatgtgagtataactaagataacagacctcccttgagtgatgtcaagaaatgttccgttgctaaggctttacagggggtggccacgggaccttgtcaatcaaggaagaatgtcctttaaagctacataatgcacctttgccttcagcctctggattaattcaaatggaaattgctcccctttcagctataaaatgcccagattcactttataggggaaaagaaattatgtgtgtcctttgaggtgctggctgcatagacaggaggggactggatcatcgggaagtgttccgcctccacacgccatcaaccactgaactgcatcgaatcagctgtaaagaaaatatttggcccctccagcctggcttccacagcggtgtgtgtgcttcattctgcaccagtagctagttccactccgttaactcatgggagactcaattttatcaactaaatggtctgtttttttaactcttccgtgaagatgggagaccacatggggaatctatatggaataaatctaaccaggcagctcagtagtgaacatttattcatccatatgctaccgttaaagcaatgaccaattgcttaaggaatcaagagcttaagttgggtcttggtatttattggatgtcagataaactgagtcttttaagcccagctcctacagggggctggctgtgagagccatctataagcctgtaagcctttctctgctggctcctgggttgattcacatcttttttctagataaattacaacaaatggaaggtataaaaactccaaccccaaacaaagagtctgattgaataccctaccttcaggggctaaggacatccctggacttgggctcacgtctttattccagggtttctcgattgtggcactagtgacattctgagccagataattccttgttgtgttcttaatgtcctatgaattataggatagttagcagcattcctgacctctccccattagaggccagtagtcccccaccaccacagctgtgagaaccaaaaatgtctccagacattgccaaatgtcccctgggtggggtgaaagtcactcccattgagaatgactgacactcctgctttttctatgcaaatgtgctggaaagttgccctggctggagctcagcttacactgaggtactgatcactctggagtcgctgtttcagctagctgtgtaggctgcagaatcacctcatacctcctctctcatcatgtgtggcttctggccagagtaccaggctctgaaaatgctttttaggtctcactgtggttcctttgccccagaaaggtggctgtgagtgaaacagcagcatggcctcaactctcttggtgtcatccatggcctgtgaggaaccacgagcttctttctctgtgaactagggacagaaatggctgtcctagtatactttgagggtcggtgtgctagcaatgctcatgtctggccttggaaggtggaagagctctttagggtttgcaatttagaaagagcgtatatatgggagcatctgtttctttggatctatttgctcaggtccagtggttctaagtaccgtaatccaggtgagggagggggttaaaaaatggaaattcccaagcctcagccctagggattcagattcagtggttccagggttgagccaagaaatccacattctggataatcttcaagtggactgatctggtctttcaggatccggtgaagccattgcctgctactcaggctgacctgagagctcacatccaatttgttatatctttgggatgcagagaaagagcctgaacctgtcagcatgagggaggcagactccagggcaggtgtgcagagagtccaaggaatggaggaaaccaaggtggaggcggggagcccggcccatcctattgtttgtttgtttccttgctgtcagggaggggccccacctggtaccacctaattatgcttgagaggctgctcatattgaaggattattccaactggctactcctcggtgcccagctagaagctttcatgagtctctgcccggcagaggctggattttattcccagcagcaataactggcaacttttcaatgcgacacgagggtttttcattagagccacaaggaaacccccagataaggaggaggagggaaaggagacgcgtgttagctggagataaagcagctgggagccgggcctgtcagtggctctgtgaagatggggccagggaggaggtgctggcagctggtgagaagctgccagagatgcaggctgagctctctcaggtgggcacgcacatccacatccacatccccatcctgatctggcttccctgggcctgctccaggtgataagtggcaattccatatcccccaggaaaccgcatcccccaggaaaggtcttcatcatttttcacccagttctgtgagaactaatagtgaggagaggcaggagggctggggacagcgaggctgggctctgggatgtctacagtcagggttggactaaagggtgcatccagaccagcagggagggaaaaagggaactttgcaaactaaaggggcagaacagacagtttaggggatgggtctgaaaccgaccatcgaggtttgaaacctacccctgccatttcctgttttctaactgatgaagccagtggcttcttctctcggtgcctgtttttacctctttagaggggagatagtagttgtatttaaattataggattaatgagttcatgcatggcaaaagtatggtccagtccttgggactcagtctgcacactgggaatgtgaataataattattttccagcatgacacttaacttgtgctttggaagagagcagaattcaaggccatgagacagaatgaactggatatatggtgcttaaaggagcaaacaaagggcaggccaaggagggaggctgctaatgcaattctttcctgcaccctctgtctccccccagtctcccacacagagatctctgcaggctgcccaaggctgaccttgcactgcatgtctccttccactgcctcacacgccatcactaatctggggctttgcgggagaaaagacttgctcttctgcacagaatttctcagatcatcccagttccaaatattctgtccattgtcttcctgagtgcttaagtgtccccaaaatgccagcatcgtggcaaccaaactgcatttcctaggctgccttttgcacctggaagcaacacaaaaggctttctgagctgttacccaatttttgttgcagaatgtattgtctctgcacacacacacatgagtgtctcagataaatgacacttaacaccctaagctttttattttaactttttttttttttttttttttgagacggagtcttgctttgttgcccaggctggagtgcagtggtgcaatctcggctcactgcaagctccgcctcccgggttcacaccattctcctgcctcagcctcctcagtagctgggattacaggcacctgccaccaagcctggctaatttttttgtattttttagtagagacatggtttcaccatgttagtcaggatggtctcgatctcctgacgtcgtgatccgcccgcctcggcctcccaaagtgctgggattacaggcatgagccaccgctcccggcctattttaactattttttaatggcagtgtttcttaaatatggttcatccactttacttcctaataaaaggacactacatttcagttaattttgctagatgactcaagagtcagtagtcttctattatgctttaaaactgtcagtggtcaggatcttataaggtgccctgcttccccttccctaaatggccccagataataatattctttgaattcctgtttctgccttttagttgtctgtctgtctgctttctctactaacccttccccccaacacccaacccctgctttccaatctgtagcataccatgtgtatcagttagctgtcactgagtaacaaaacaccccaaaactcagtggcttaaaaaataggcttttactattgctcacatgtctatgtgccacctggctccactggtctcagccatgtttctctatgtggctatgggttggcgaggcagctctgctgatcttggctgggctctctcacatgtttggcttctgctggtttaggatggcctcagctgggacagttgagcactccttaatatggtctctcaccctccagcagactagtttgaccttttccacatggggatagtgggattccaagagagagaacagaagcatgcaaaactcttgcagattagaactggcattctgtcgcttctgttaccttttattggctaaaacaagtcactaagctggactagattcaagggcagaagaaatagactccttttttgaaactgaactaccacaccaggaaatcaaataaccaaattgattagctttgatcctaaagcaagtgtgaaaagtcttttttgtgaggtgtgttgttcccgataacaatgaaccttgaggcatggtgtttatttcatctgtagactatgcagaggctcttatgctcacttatctcatttgtgttctctggatacttgaagttgccagataaacaaggtcctactcttctctgcaagcgtccccaagggagtccctttttttattcatctaagccttatagcacttgacaaaccaactttgagaagcaacactccatgcattttagtcccaaactgtctagtctccatgtttggctgcgattccccagagacttctcccgacccatagcgagcttacaccacaatcactgcagctatcccagtgcactgctgcacacagagggatcaaaatgtttcattccgtacctgcatctgtacttggctcatcctcaccctattactgggagccattcgtgtgtcacagctgactgctgaattgattttttttagcatcatctcacttgcctgtatctgagattgccgctgctccctgaaattggatgctggttcttcctccacctcctgaccctcagtgatcatgaaatgtaattaatgaaatgagataagacagcaagggactggatacccctaagggtctattaaaaacctgctagggtgatagaggtttgggaacttaatgtctaattatagtttcaggggaggaaaaaagagggtcacagaagtcattacaactttgcttttatgggatttcagaaaccatggggtctttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccaattccaggtcttctcatgtagaggctctgatttcataatgaatgctttagtgcatttgtactgtatttctaaagtaggactaatggtcgtatcccataatgctttagattccaggcctcgtttttgttggattttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgcttaactcaggatggacagcatttcttcttcctccaacttgtcatagttttgtgtggtttttttttggtggggggcggtcacatctatacaatttgtagcaaaattataagtcttttgttaagagagaaaggataaaatctacaacttttatttttgtcatattttctcaagtggttggactgtatgtttactaaattctctttcattatttccttcccctccatgtttatcaaaggtagaccctaattagcaatctaaattgggaaggttttgcattaataactgtcctcctaccaggattggttactattgttagaagctgtgactttgctgttagctcagctctaacaactctctgagatccagagagctgtttgctatttaatggcatagtaggctctgaataatggctactaaatgactgaccacagagtgtacccctggtagccatctggtagattttttttttttttttttttttgccattactaaaggttcatggggcaggagtatgtgaacaaatagccagttccacatttccactcaagacccagttcaaagcccacgacaatggtgggtagcacatttgctaaaggttcacagatcagcatcttctagtgatgtgagaatttgtcatttgaaaataacaaaagcatataccaatcaggagtcagggataaagggacaagaatgctaaaattgctcattgagaaatattgttcctaatggacttctgaatttcctatatttattttatttcttccatctcatcccaattctgcttttctgccactcacacccagcggttggaggaccattgctgctgtgtactgttatatgctggacatcctacaaagctctttacatacctctattttcttctccctttttgcttctcctctcctacctctagtctttctgtggtcattggtattgactttggactgaaatggtactgtgcgttggccattgctgcctccttcattggcctgcctggccttctcattgtcttgtgtgtcccaagcagactctgttcatcttgtaatctgtacactaccaggaagcacatgttctgaaagagacaacctctctggctagttctacaaagggctgccttgatgaacttgccttcacactcccatcaccttcattcccttttcaactgtattggtttgattccaagcaataaaaccccagcttgaacctggttctgcaaaatagaagcatgccttggctcccagaatacaagaaggggctgtggaattgaaccctgggaaaggcagcaatgctactgagctcaggaaaagctggagccagggccttcagtgcctccaagacccattcttcctctctggtcctgcccactttccatgctgaccttattctctttcatgacagacatgtgttaggaaacatgacaccaccagcccttgaactttgtgactatacaactttgatatggtttggctgtatccccacccaaatctcatcttgaattgtagttcccataatccccacacgtgatgggagggacccagtgggaggtaattgaatcatgctggtgttttcccccatgctatgctcatgatagtaagttctcatgagacctgatggctttataaagggcttccccccttcattcagttctcattctccttcctgtcaccatgtgaagaaggacatgtttgcttccccttcccccatgattgtaagtttcctaggcctccccagccatgctgaaccatgagtcaattaaacctctttcctttataaattagccagtcttgggtatttcctcatagcagcaggagaatggactaatacaagcttctactgctgaagctggggaaagaagatatgaacctcacttgcgtcaggtatctgttcctggacaaatcaaccatggccaggagcagggcttataaataaatacatggcagctcctgaagtagccttgtgtacatgtcagagtacaattctcaggagacaagcagaagtgagcagaaacccatagaggccctctatgcctgctcacccattttggagtactcaccatccagaatccctatctgcttcactcagattcccaagagacccagcataagggtcaacccttgtacattcactgtattcctaggcagcacttctatctccatttggatctcctttcatgcctaagaaatggtgctggacagcctaggcacaaacccaaaagccttttaactctctgcattaagcttagatcttatcctatgtggccaaccttcatttctttcctgtgtcccaccttggaagctctagctaccaggcataaggcacctccagcccagactaaagagacaggagagcaaggaaagggtaaggagtccttgctttcatttcttgtgctgtttctgcacagtctgatgatgttgagaagcataagggaagaggagatcgccttccctctctgcccagcgtggggtgttctttcacctcctctcagtctttggctaccccagctgtgaagttaaccctctctgctactctctctgggaaggatcaccctcccctcccaccaagaagctgggagagcagttgaggcagcagactgctaaatgcccaggtcacccatgggaaactccaagatgcactttgctgtctcctgtcttttccatgcaatgatgatggcaaataggacaaatgagggtgcatagattcatgaacactgggtttatttgcgtgggttgtgatagtggcagcaaaataaaacatggcggtgccattatgcaccttttatctactgccacactctcctccaggtgactttattttctacatagataaatatagtaagaaatacataataatacatttattttttcacataaattgcagtcaaactacacctgtggtaggcagaataatgatctctcaaagatgtccatgttctaatccccagaacctgtgaataggttatgttacatggcaaggagaattcaggttgcaggtggacttaaggttgctaatcagttcaccttaaaatagagagattatcctggattgcccagatgggcccagcataatcacaggttcccggaaatgtggaagagagaggcagaagagtcggtgtcagagtgatgcagcatgagaaaaccatagctggctttgcagatggaagggggccacgagccaaggaatgcagggagcctctagaagctggaaaaaggcaagcaaatgaattcttccctagagcctccagaaggaacatcgccctgctgacaccttgattttagctcagtgagacccatttcagacttctgactcttagaattataagacaatacatttgtattgttttcagctgctaaatatgagataatctgttccagcagcccttagaaacaaatataaaaccccagtctctccccttctcatagaatctgaaggccaaattgttcatcctctttgtctttaatataccagcatctccgagcaccccgctgactaggagtgcctcttatagccccaatacgtgtatgtctcattctgatgattcaatacttccttttcccatcaataaaatacaacattcaaaatatgtatgcccatctaattttactgtttcctttacaaagcctctgactttatttatgtaacttaacaaaatagatttccctcttctaatacaataaatttcccttccgaccagtaccactcatctctgacactggccagcagattagttgctcgtaatgactttggctttgttgcctggttcaggttgtcaggactttctgtgttccttctccacgtgttcctctatagcatgtcttgacgcctcttgcctagaccttttttagagaaggcatgacatggcacaagctcccaggaacaatttcattcatgcttaatgcctgttgcaaagtcatattttttgctcttatgttgggtggtcacaaaaatctcaccttgggctctcaaccacattctcctaaaccaacatcaccatgagctctcaccacctctcttccacccacttctctaatgatattccaggatttttcttaaagagatctggctatgagcctgtatttcattacagcttaaataatcatattatttcccatttccttagttgctctctggacttttaagattctactgccttaggctggtcagcggacagctgccttcattgccatgcatatagtaataggcagctggagcctgcaggctcctcttgggaccaggtgctggctgaactctcaccacagcctctcctgagccttccctattgtcccctcagcccagcactcactcagggctccatatggggacttgtccacaggacctgacctggctggttggaccccacttcccaggttggagatgtgaccacatcgaggatctgctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccaccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtgaaacctgtgaatgtgacctcctttgggaagagtctttgcagatgtaattcagttaaggatatctacataaatcattatggattatccagagactccaaatccaatgacaagtgtcctcataagacaaaaaagagagcggatgacacaggcacagaagaaagccatgtgaagacaaagacagagatgaaagtgatgcagccacaagccaaggcatgcctggagccaccagaaactggaaggaaaagaaaggaaaggaaaggagaggcaaggcgaggtgagacgaggcgaggcgaggtgaaattatcccctagagccttcggagggaggatggccctgccaacaccttgatatcagacttctagcctccaaaaccgagtataaacttctgttgttttaaccatttgtggtcatttgttattgcagccctagaaaactaacatattcctcaacatgcaatgccatttcttttataaagaattcaatcagcccaagtagctaagaagtggcttccaggtgcagcaccaacttgtagcctggtccttcctgccatagtgctttcttacagctcccttgcccaggttcattctgcctgagatgtcgtaaagctcttgatatggtttgcctgtgtccccacccagatctcgtcttgaattcccatgtgttgtgagagggacccagtgagaggtaattgaatcatggggcaggtcattcctgtgctgttcccatgatagtgaataagtctcatgagatctgatggctttaaaaatgggagtttccctgcacaagctcgctctctttgcctgctgccatccatgtaagacatgacttgctcctccttgcctcccaccatgattgtgaggcctccccagctacatggaactgtaagtccattaaacctctttctcttataaattgcccagtctcaggtatgtctttatcagcagcatgaaaacaaactaatacagctcttattggtgaagcctggccccagggaagatgcataccttgcaggagatttataggacagaggatgtgcctctagtgtgcccgtggtttcgcttgtctattttatatttgtagaggattgtcaagattctttggagatgctttcccattttctatcacaatggtcctgagtgctcaacaagcctgttatataacatgatgaacttgacaaagatcagttaaatgactcaaccaagaattcaaactaaggcttttcaactgggaccactgctgcttctaccccaggggtcatgataaacacctgggacagcgaggaggctctgaggtgtccgaaaatttacatccatcttcaaaaccaaaattaccaggggctctttcattttgatttgatgaataaaacatcttgtgtcctgaatgtttcagaaaattgaggaatgagatatggttctctcaaacttggatgtgcatatgaatcacctgggggatcctattaaaaagcagaatctgactcaggaggcctgggctgggacctgagatcctgcattgctaacaggctcccaggtgatgccagtgcagctggtttatggatcacacttccagtagcatgagatggcacctctgactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttacaatttttatacatttctgtatgcctgaaatatttcaaaatttaataaaaaagaaagtgcatagggacagagtaaagaacattctaacctacatgttgggggcagaagtgatgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagatctcagacacatcagatctcataagaggccacctgaaaataagagaattaatggaagctctacgcactgaactgtggggcctgtagggatggaaagtgtgatacctttcctcatctaccataaggattacggccaacactgctataacaaaagaggttaacaagagaaaagcataaatgcatttatttcatcagtttcacatgacacagaagccttcagaaatgaagactcaaagacccagggaaaactgtatttgtgcttaggttccatgaagaatgggaagccttgtagaaatgtgattggacaaaagggtgtgatctactggtaacagactgaggggaggaaacccagcaaggcctgtctgttcagattcttcttagtgtctctgagtagcattcctacctcccaggtaggacctctctggaatgagggttttcaagggagaagggagcgagtgacctttctaggttttgtggcttgctttgcaggagaggcattctagtttctatgacccactttggcgaaaaagaattcttgtttctatgacttacgtcgggggagaaaaagggatgggagacgggggcaggagagaaggtgaaagccttggcttctgaggcccttccattctcctttagttcaaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgccacagcagtagagctgagtagtggcaacagacaccatctggcccacaaagcctaaaatatttactatctaggccctgcagaaaaagcttgccaatgcctgccctagggaaaaatagacgccccagaggaaagactccagatccctcatttggagctcccattaaaatactggtaaacttccctatgacaatgaagcccatcagtgacaagccccatccacacgcccactgagccgccaagcaggtttcagtacctcagtcttaagtacaaatggatgtccaaagattttccagacactccaggaaggctcagcgtgaaagagtataatcaaaataaaccgacagaaaaaaggaacttggaagaaccaaaataattcaacaactggaagaaacttacaataaaagtatagaactcatattatctgagaaatgagaaggtatttcatccataaaacaagaactagacactatgataaccaaaagtgaactctgaaacttagaaagtaatggctcaaaattaaaaaataaataaatagttaaaagagagtttaacaaaaagacaaggagatgaaaaatgggagggaaaataaacaattcaggatgtccaatattgaactggaaaaaaaaatataggacaagcaaacaaaggaaacaaagggtttaaaattagtgatgaatactataaaattcctgataattattttcttatctatcacacactgtgcccagcatagtaaataacaacaaccagcaagggccatcatgaaattgcagaacactctagcaataaagagatgattctaagttgacagagagaaaagaaactgaaccaaagaacgagaatcaaaatggatccaggcttctcaatagtaacactgcataccagaaaaaaaaaaacatggagtgatgcctacaaatttctaaaggaaagagatttttcacctagtgttctatgtctagcactatcagtcaagtatggagataaaagcatttttagacttgcaaggattctcatgcatcctttattacgaaactactaaaggatgtgcttcaacacaatcagggagtaaaagcaagagatagacatggaatccaggaaacatgggcttttcaacacagaagtgaaggaagtcccaaaaagatcattttccatcaagtctatagagcaaatgatccagtttcgagcaagaagactaaagacttcaggaaagaggatctctgggaaacaagaggacagaactgctcaattatttgatgtgtttaaggtataaaaaaatgattgctagatgttttacaggtttgttaaaacacttgcttggaaaaagtagtatgatatttagctgaacagcaaacaatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaagtagatgcctctctgagaagggatgggaggaaaaaataattgcttttgcttttttagtatatataatcatttggtactattttattattctaactattcacatacattttgataagaataaaaattagtctaaaataaattatatcaatctataagatcaacatatctattagatcataattataactagaaaagttgcttttttggaaaaaaatgcaaatgtttactccttgtggtctgctgatatttaaaagtctttatcataagaaagtccttccgttgggaatgctgagctggcagtctggtggagctgtagtgtcttttgtgtgttccagatgcctcgagaatcagtctttgtgggagggtggaacacaaacagttttgaccagtgtattagtatcagtaaggctagcataaccagggagagatgcaccaaggttcaggtaaagaatcaagtgaggaaaagatatataaaatgcatgtatatatcatggctgcaacagtgcaaaaatggtatgttcgttataagaaggaaataaggacaaatgaaaacagtttgatgtgtcagaagtgggagcggaaataaattttttcctttaatttagaattatgtgaagactgctataatgtttgtgtaaaacagaataaaggggttttctaaggaaatcagtggcattctttgctctgcctccctcctgcagtttaattgcctacacggaacaatatgtggaatatgaccctttgataacaccagctgagccatccaacccttggatcagcgatgacgttgctttgtgggacatagagatgaggtaaaaaatgttttaaggtttgggagtgggatgaatgtagacaaaaatccatgagatcatgagattaccttatattctatcttaatttgacattttttatcgctagaacagaaacccctcaagtagcctcccagctgagttctacttacagtttctacctccttatagctttgatttgtgcatggatcctttgtggctcccctctgaccctttggataccatgataactgagacagtccctcaccattccctagttctgattgctggaagaaaagaatctgttgttccaattttttttcctgttagacagcaacaataatgataatagctggcacgtattctgcattggccacatcctgcagtaagtgtctctcactgaatcccctcgacaggtaaacattactattctcaccactcagcagttatggaaactgaggcacagaggagttaatgaacttgcccaaggtcatactgctagtacagcagagttaggactagaactcaggcagagggctccagaaccatgatttcatcactctgttcttctggagtaactgccagcaacgattccagccagtttctccttccctgtgagggaagccactgtgtttacttaagaggggaggaaccaaagcccagagggacttggaccactttcagaattacagaaggaaacacacagacaaagctagtgtggtgtgccttcacaccccctgcaccttggctggatgaatttttatttcccttttcatgtctctgtcactcacattgtctttcacttttgccccttttctggctgcttttcctgaaatggaaaaaatcttataaaaataataaaagtcgcagatgctcattctaaaaagttcaaattatccagatgtgcataaagaagaaaatgctctcttcctccaacccgatttcaccttccagaaagaacctttgtttatagtctaatgctgtggttcccagagtggatcagagcaccctgagcactgtggggaactcacagagttaccactggatagtccaaattttttatggaaacacagcgatggttgacacatggcagatactgcataaactactagcttaagatggttcagtttcaacattagagcacgttacatcccttatgatgatacgcatctttgcaaatctggcttttcggagcagtcactatgataaaaagcaagaactgcacaaaaattaacatggaataagaaatagggacggtaagttccaacctaattccaaaatttaagaaaatgcgtagtgcccaataggtgcatattgtagttatttaagaatgaaaacaaaattttcaatttatgtgtctttcaaacagctactaagttgttaggatacaaatacatattaagttgattggtcctagccataataaatgacactgttaagtatttcttttggcccaggggcactgtgaaaaacttactgagacgctaagggtaccatgagctcagcaaatttgggaacatctgatttagtgtctattactttggatttttatgcacatataacattctatccttttgtataattgggttcaatatatatacccaaatatgtacatatatatatatagtccaataatttttaaattaacaataggtcgtggcagtctttccatgtaaacacatatagatccaccttactctttttaatagctacatactatcccctggcaccggtgaagtaagatttattttaccagtacctggatcataaatatttagcttatgtcctccttttttgccaccataaacaatgattccgggaacatctttctacacaagttcaattatttcatcagtatatattttccaggagtagaattcgtagaaatggtatgcatattttaattttagttcgtaggtccagattcctcttgagcaaaactgtaacacatctttttcattcccttagcttaaaagtgcccatttccccacattcttaccatcccaagcatcatcaatcattttgtctttgcaaatccaaaaggttaaaataattctcattttactgttttgtttccttgttaatatacttgagaatcttttcacatgtttattagacagattctagcaatatgttttgctttggatatttggatataaaacagtcacatttacttgaatcatatattttatctttttcctgatatatttctgaatctcattctttgttcttgtttctttttctcttccctgacttttactttattaatgttatattaactttgtaaaaaccctagtttctattctagttgtattaacttttaaatgttttaattaaaaacatcatcgatttaaacaaacaagagtgaagtatataaaatagtgaagttacctttgcctcccttaaatcccattcttcccagaggtatgttaacttgatatattttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattctatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttttcttagtagcctgctctgttctattggtgtttatcatgttactccccctggagatgtgatatagatttttttcatagtttatattttttccatattttcatatctcctctctatttctgccgcttagttttattcggggttattcattagagaatcatcatttctgctcattgtttcattcattcctctggtcactgctcagagcagatcattctttttgtatgcccagctatttggaagactgctcatttttataaatgaaggtcttagctttcaatcctgccatacattagaaccacctggaagtttctaaaaaatactaatgcctggtcctcacacacagccaattaattcagaatttctcacaattgaacattgttttttaatctccccacatttttttttaaatctccctttttaaatcagggagatttaaaaagtctaatgtgcagccatggcctaggactctatcagtagctggtgagggtgctctcagtgatggtatgggccaatggttctaagccatgctgtgcatcagaatcacctgggctcctctttaaaaatacacgcatactggggtggctctgggcgtctgcatcttgagcaagcaccccaggcgttctgaggcacacgacagtttaagaagtcctggtttggttcacggagttccccggcaggctttcccctgagcagttcacacaggagcagggctgcacctgaatgtatgaatggatgggcatagatcaattgccaaggttcccctctgggtcccgggtatgtggtccaagaacagattaaaagattgggccctctcttacagtgagacaggtggcaatgggagtcttggggaggtagacccccacccttcctagtgtgacatccctgcagccaagtgttctactctgtgggtcaagccctgatggagtttctgatgtctttctatttcctcgccaaggtactccccaacaagtcgactcttctccctccactaatgggtcttaggggaacccacttggatctgcgaaagccaatgagaggtggggagaaagctaatgtgtctttaaaatctccctggttcccaagatgttttttctctgtgtgtgtgctgtgctggcaggaacacaatcctctggccttactgtccatatgagaagctggccgggaaacatcccccttaacttagcaaacccttttggccatgtggaacctgatccatgttcctgagttgcttccatatgccccttgtctgatgccacccactgcctccacttccaatcctgctgctcagagctcggggtttcccaaggcttctgttggggacactcagctattttcttctctgatgcctccactggaatcgtaggctgctgtcgatcagatatgtcacaagttcagtctatgtgcttcgtgccttcctgaaatttctcaaagctctcatctgctgataggaaatttctttgcctctacatactgtgtttagtttttttggggtttttttgttgtttgtttgttgttttttttttacttaactgagctctgggcttttgcctgttccctcctcgttggccacttgtcccccagatcctcacatggctggcttcacttctcattcaagtctcactcagcactggtgtcccttcctcagaagggctttctgtgaccaccaatctagagtggccacctcatccctccagctgttctatatcacatcctcctcctggttccctttctaaatagaatgatttcagcgcctaggcctatctggcatacagcgggcaccgtgtgggctggagggaggatggatgaacaagtcattctttatttgatcgtttcattggtatttgggaaaggaggagaggcaaatgtgtgaacctaattcacaatgataaaatgaacttcctcttttgttcttgaaagtcagcaaagaagtatgtaatcatgtaggaaaatggggtcgcatggcctattggtttattccaacctattcagcactttttccccaaggaggtgctacctgccccctactactcatgccctggttctactcctgttgttctagcttcgactctgaacttcatgcctaatctaggatagctacagtgttctgtccacttacaggcagaatcaagtgttcagatacaagtgaaaacgaagccctgtttcttctcccaacagactactcctacccacttagttgctggcagtgatgttaggaaaaaacagggtggaatcagtgtcaacatcacactccagccaagggatggtttctgtccacaaaacgaaggctgaagatgaccaataaaataattgagtcactttctctcggtttcagtttaattcaatacatttgtatagtagtcaactatgtgctgtgttctgaacaagaagggctctcaagataacaaatgtagcaaggtaaataaaacatgctatcttaccatctggcaccagaactcctccttgcttggcaaaggacattaagccacttggggcagaaggtaaggccctaagggcagaagggttggcagagactgaaacaacaaagggagagggttgtgctgtcctgctgagaaaacgagacaaatgtattctctgttcctgagaggggagaactaagggcaggggaaagcaggggagggagagaagccagaggccaacaaaaactaagtctctgtgcaaggccagggaaatgcctagcattgaggtgaccagggacttttcaaaagcaggaatgtctagtatgtgcttttttaaatagtaggctgccaggaggtgcgatatgtacccatttttcaagaccctcaaattcctgtaaggcccccaccctcccaaacgcttcatgagaggaggggtttggtgggtgtgggtgaaggtttgtgggaaaggagagacagtgagaatgcaggactcccttaggaattcctgccaatctcaggtgggctttggacttcactgggctgggtgaaggggtccaggcaggctcgttatgatttccagggcccaggatgtcaccgacaatgtctaaattctgcaaggtggagaatatactgagtctgccgtggggaggttacagacagccaaatggaggatggccatagcagctgaatagaatcacggataagatgacataggatatacaataaatagcagaaaattgtgctttaattctttctccttctcagacaagctattcgatctggaagtccaaggataagaaagttatattcagaggggaaaaaaaggcaactgttttaaaggatgggcaaactacacctcaagtttatgcaacatagtgagctgtgatcgcaccactccactcccgcctgggtgacagaacaagacccctaaagaaaaagagtaaattctgagaagtaaagtttaattaaagaaaatagtgattgccagggcttctcattgaggagaagtcagtcaaaagttgccagatgacgtaattctttatgtcatctgaaaaccaccaggagagtgtcccagggatacgtatgtaaagtatttctggtggtgccactaactagatgctggagtctaatgaaacctggtgttgtcagcagaatgtggtttgtgatttgctctctccgcatgacttcagtttagctctccctctctgctgggtatcaggcacatgagcaaagagctacaaggaacctggcttgtccagcttggccgtaggcattcactcccagccaacctgacctgctgagaggcagagatcatccctgagctgcccatgcacagcgagtttgacagaactattaatccggaatattagtcaagctcctttcttatggtggtggatctccaaatatggccccattggtgccttccctctttacatcaagtaggacaccaagaccaaggccagatgaaaagagagggagcacctttttccctctctcaaactatttgagaaccagtaatccagaacccctgtggtggcttccaccttggtcatttgaaatatttgctcttgagacattccttcttggaatccatctgccatgcttggagaagcccaagccgttggagaggccatgtgcagacagtctggtcagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccctcaggttgttcttgaggtattaaataaaattatgattgtttctttagtagccttggctctgagatggggacattggattattttctttttaaggaattgccttatttcgtaatttttctaataacttgtcttagtctgttcaggctgctacagcaaaaatgccatatactatgtggcttaaaaacaatataaaaatttttttcacagttctggaggctgggaagttcaaggtcgagatgccacagattgggtgtctggtgagggcctccttcctggttcataaatgtctgggtcctcacatggcagaaaggcaagagagctctggggtgtccttttataaggacactaatcccactccacgtgacctaattacctcccaaaggcttcacctcccaaaaccatcacattaggggtcaggatttcaacatataaatttgaaggggaacacagacattcagtccacaacattctacctcaagatccccagaatttatgtcatcttgcatgcaaaatacattcattccatctcagtagtccccgaagtcttaacttgtcctggcatcaattctgaagtccaaagtcttatctgaatatcatctaaatcagatatgaatgagattaaagataccattcatcctgaggcaaattcttctccagctgtgaacttgtgaaaccaaacaagttatgtgcttccaaactacaatggtgggagaggtataggatagacattttcattcaaaaagagagagagagagagagagaaataggaaagaagaaatgggtaatgggttccaagtaagtccaaaatgcaacagggcagaaaacattaaaccttaaggctctaggaataattctctttggctcaatgctctgtcttttagacccactggggcagcagccccacctccatagctctcctgggctggagtcatacacccatggctttcctgggctgatgctctggtcttccaggcccatttgggtggcagcatcatccccacagcttggtgggatggccctacagcagctttctcctggggtccctattgctttcccaggctggggttcctcacctgcagctcttctgggcagcccagtccaccatggctctgctgggtgcagcccatattgcagctttctgtggggaccccatcccaagtcactgggcaggagcatcctgatctacctaaattgaagagacgagttgatcctttaaaactgttctgctctcctactacatgtcccttgaactctgggcctatggtgcaagtggcagccctgatgaactctgaattgcttttgagtaattcttccattgtcttgaagaatagttcctggattctgttaagatgactcatccatactaatatacttatcaaacagtcacttggccacactattagtggtctcattttttgcatatgaatagacaaagaatttttcagatcttcaggttctggtttctttttgtgcttaacaattctgtctttaagtcacgttttactataagtagtcaggaagagccaacctgcaccttcaacacattgcttagaaatttcctcagctaaatatttaatttcgttgcttgcaagttttacctttcacagaatactagaaccaaataaaattcagccaaattctttgccactttataacaaggatcaacttttctccagtttctggtgatatatgtctcatttatgtctaaaactcatcagaatggcctttaccatctatatttctaccagtattctgttcaggattatttaggtattatctaggaagattgaggctttctttatagctctcctctttactttctgagccctcgccagaatatcctttaaaggcctggttacagcagtttaggttcctctcccctcctctcccctcccctcctctccccttccctctcctttcctttcctttcctttcctttcaagatggagtctcactgtgtcacccaggctggagtgcagtgtcgggatctcagctcactgcaacctccgcctcctgggttcaagcaattctccttcctgagcctcctgagtagctgggaattacaggtgcccaccaccacgcccagctaattttttttttttttttttttttttttttgtatttttagtagagacggagttttgccatgttgtccaggctggtctcaaactcctgaccttgtgatccgcctgcattggcctcacaaagtgctgggattacaggcgtgagccactgcacccagccaatttaggcttttgctgacatatatctcaagacccttccagcttctattcattacactgtaagccacgttcacatttttagttgttcattacagcagcttcccactcacagtacgaacttctgtcttagtctgttaggactgctgttacaaaaatactatagactgtgtggcttataaacaacagaaatttatttctcacagttctggagctaggaagtccaagatcagagtgctggcaaattcaatatctggtaaggatctgctttctagttcatagatggctgtcttcctgctgtgtcttcacatgacagaagggaaagggagctctctctggtctcttatagagtactaatcccactcatgacctaatcacctcccaaatatcctgcctcctaatacgatcacattgtggatcaagatttcaatgtattaatttggagagggacacaaacatttagtccttaacataattcttaagtgttttgaagatagcttgtatattccccaagtcttagtttagatattgattgaggcaaatgtagtagaaggcaaggtaacagagtggaaaaaaagaataggctttggagacaggcagtcctgggatccaggtcctggctgccacctaccagctgtgtgaccttggacaatctgacctcttttgaactctggatgtttaaatacaatgtcagcctccctggcttatattaagatttaaatagggcactgtaaggaaagctccttacaccatgtgtagcactatgaagctcctgcagaaatgagcattgatatagacaattgcttcctttgaatctggctttcttgtcctcagtttggtaactttcctccatctctagctgggggatcagcagaaatgaaagacagacacccttggagagctttgctatgtgttggtttgggctgtccagtgggaggcaggaacttgataagaatgaagaggcacagaggacaaataagagttagaaaaaggcatccagctagcgattagaaaacactgtcaggataaggacacttcatccacatcactatacacatttctaaactgatttcattttagtgctgaacacttgccatgtgaaaagtcctatgctcattacaaagacacatgaaatatggtccctgacctcaaagagctaaaaaaaaatagctggaaagacaatggcataaactctcgaaaatccaaatgctgacataaaactctactagagaatatgtcccaaggaaatatcgctacacaatggatgtaaagagactgtgcttctgtggattgtttgcttgaatttggctgagggacagttattgtaccacttacctggagatggatgttgaaagatattttaatttgcagaattattttataaccataagagaccattcagtggtaacaacatgttcaagtcttttcttaaaccttgaagtggatgatattgggaatactcaagtgatacagaagagatatgtatagggaagatgtatctaggaagcttttaatagaacagactcccagtagtgaaatcgtactaggaaaataaggaagaaatgtggatcatccagttgtagtaatacaattgtgaataatggatagttgagggaagccaagtatacatggttacattgtatcgactaaaaattcatgtctttcccagaacctcagaatctgacttatttggaaatagagttgttgcagatgcagttagttaagatgaggtcgtacttgaatagggtgggcccctaatccaatatgactgatgactttataagaagagaaagcaggctgggcatagtggctcacgcctgtaatcccagcactttgggaggccgaggcaggtggatcacaaggtcaggagatcgagaccatcctggctaacacggtgaaaccctgtctctactaaaaaaaaaaaaaaaaaaaaaaaaaaaaaaaaaaattagctggccatggtggcgggtgcctgtagtcccagctactcaggaggctgaggcaggagaatggcgtgaacccaggaggcggagcctgcagtgagccgagatcaccccactgcactccagcctggacaacagagtgagactccatctcaaacaaaaagagaagagaaagcagagacacagacacttacagagcaaacaccatgtggagacacagaaacacaggaagagagagtgcagtgatgcatctgcaagctgaagaatgccaacatcagaagttaaggaaaagtcatggacctggttctcccctaaagctgtccaatagagcatggccctgtcaacaccttgattttggacttctaggctccagaactgtgagagaataaatttctgctgttttaagccacccagtttgttagtcctttgttatggcaatcctaagaagctaatacaccagggtatcctgtctctctagacccatttatttctgctgaactatgaccttgccattttccagatacccccaccttctgtcctaagcatccctctgattctacatctacagtgacaccccaagatttctggcccactccaaaaattgcccttctcccactcttgccaccaccaaggaatctggtggaatgaatgtggactcaccacttgggtaccagaaaggggtgacactggtggtgggtgtgcatccatgaggcagtcactacaaagtctgagtgaatttctacagctgctaatatgggcacagccctcattcgagtacagctgccactagtaccatccctggagagccctgaatcctcctctggtaaagagtaaatggttgggtccatccttggtcatagcatgaccttggcagaaagagacaatgtcctgcagtctctggggcttaaatttactgccagcctcaaccccaggggaattcttccacaaacagtatttttggttcccttgaaagttattgagtttgattaggtctgtggcttgcgtttgagagaatccaggatttgtcttcatgtcttgttgtgaaaggcctagcctggtactttggaagaggtgtttcatggagtctcccattgtttgacctgatggggttagtctaccaccatgaccctattggactatgctggaaatgcagagttgcaagccagaggctccctgacctccaggctcatgatctattggtcatcatcattgtaattagaagatactgctgttgctgattatgtgtgttggtgaagaagtagttgggtttggatgcggtatgtctagagctgcataccaatatagtagccactagccacatgtagctatttaaatttaaatttgaatcatttaaaattaaatgaattttaaaattcagttcatcagtcacactagccagttttcaacagcccaatagccacatggggctagtggctgccatattggagagcacggttatgggatattttcatcattgcaggaaattacactggacagcgccagtctacagttatttgctttcccaagctttccacgcacacaagctcctttttttttttttttttttttttttttttttactaagtggaattttccaagtattgagaatatgtcagctccataataagaggaaacatgatttaatctcttactgtctgttggaaataataaaatatatgcatctattttttaaaagaggaaaaatgagtattgctagaccaatgtttcccaatttgtaatgtggacataaatcacctagggttcttgttgaactgtaggttctgatttagcaggtgcaggtggggcctatggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaagattgggtccatgaagcatcctgggttatagtactagtgaaaaaattagagtcaaaagttgagtccataattgataggaatggtccagggagtttaatcaatggcatggtagacagcagccatttgaagggcatgccggcaaccatcacttaacatgcctccttaaagaaactgttcatcattggttactgttggtgtaccaaagtctgcatttggaatttgtgcagcttttgtagaatctgccccttaaatatgagatgtttccctttggtgagtgactgcaaaacagacttgagtcactgaagagaatatgacacgagcttttctctggtattgatcttctttaaaccttcttccttcaccccaaagcaaagagcccagccaacagcgagtaaaaagatggggcttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagtaactggtgatgtaactgtagcagctacgtaacagtagcagctaataaaaacatgcttttttcttttagaatgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaaagggggtgaattgaaaggaaaagtctccttggttatgaaaaatttgggaacttgtttatttagacttttatggtattagatgaagaatcagaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaactcagagcatgtgctgcgggcaaaggactgcccctccaaagttaatgtgcaacatccatgcacttatttgaagttgagaccatcggtcccatacgtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaatcaaagctgaagtagttaaatcataagctggactttgaagaatacacaggataatagtagacgaagaagcaggagagagaatattccaagctggaggaccaaatgaggaaagaggtggccgtgggactctcccactccataaggtcctgagaggacacgtagatgccgactagctgtatggagcgtgctgttctaggcatccacgtgtctgttataaaccagacaaggttgagtatcttattttgggttattatacaagagcctttccttgtgctgaagcatgattccaaacacatctcagagcttcatttcaatgcctaatgaagcatttgtaacagaaggcttgacttctaatactcttcactagggtggtgctcagactagcctccctgtataggaaggaaggctctctgtggccagcttgatggacccaggtggcctctctgtgtagccagctcagtcccagtttccaccccctccatggtccctatgagccacccctgggagtccttctcatcttcccttcttacctgttccccttgggtctccaagatggagcggtatagaggccccctttacctaactacctctaagcccgtaagtagcctcaggaccctctgctgcctgcactcttgcagagagcttgaagaatgacccagagtttggtcattgtgagggtcccaggagcatccactggctcagctgccaccttgcctggtcagagcattcattctagaaagtcccgagtgtagccagaaccacatatcagttcagactagtttcacaaattatgcatcacacttaaagcccagagtgcaccaaggagtgtgtccctggcaggtgttcagtgcttcttcctgccatcacctcctgcgcctctgccagctcctttccccatgccaggagggctacatttaatcttgggtgaaagcatgcatgtgagcatgtgttcatgtgccagagcctaagccacacccccagaatgcagaaatccagacttcagagggtcacccctgctccatgacaggaaaggaaatagaatagcagggaggaaaaggatagccaagagcctctaaaatcctctctggatgcccaaattccatttttatgatattcagcataactggatacatggtgggtgagagagaagctcagtcgtaaatcacataactgtaggactcttcagtcacccatcacagggcagccttttccccgttccattgcgttcatcccttcagctgcagatatcatcttagcaccaaccgtggcacagggctggcggatttagagctgactgagtaaatatcagggtggccaggcatggctatacagatgcacctccactgtggctcatgccatggaggcccctgggagttgtgcaatatggcacaacttgaggatcctgccaacctgtcatgttggccgtgctggagtcgtcccttctccgcaggattggtgaggggcccaggccactggcattggagcatggcaggaaaaagcctgaccagaactcacctgggtaaattacaaagtgcttctccacttcctctgtcctcctgtgctccctctcatctctccagtgaaagggctgcttagatcataacattcttgcacaacccacggggtgccagttaagtagccaagtggctgaatttctatcagagcttcagaatgcggaatggaggagccccaaagtgtcaccctggatcctttaaggaacaatttctatgatgatgtaatagaagttgacatcccctttgatcagtgtcttctgggtgggtctgtgagatgagggtgggggcatcatctctgtggactgggtggggtatgaccagcagcgcattttgctgaagctgtgagctctctgtggcagggtctacctctttttctccttttctgacccacctgagctgggtgcaggctccctttgcaccgagtggacccacagacagctgtttgttgagtgccttgggaatgctcatggcttctgtccacaaggcaggggcctcacagctctgatgcagggagctccgctcagtttcttggcctcatccttcttcctgctttgtgcattttcccagaataatgacagtcactccttcccatctttgctccctctcccacatctcccctacacaaatctttgtcctccctggcttgacaccctctgctgcacagcagagaatgagttaaaaatcaaaacccacagcaaagagtgtcccccgtacattttttgtgagctgtaacatctcctgagagaaggtagttgttcttctaacctgcagattgatgatccgagttccacacagtgtcggctgaagggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagaggtgactcccacgacaccacaaccatctgcagtgtttcagtcactgcccagtgaacagaactcagcttcagtggtgctgggggtggttactaacgtaggcaccccggaattttagccccaccgggaactaaaccaagtttaagctctgctgcctacgtctctggttgaccagcagagggcatagaaacactttcttctctcctggagtttgctttttctctgggagcgaaccaaaagctgtattttctaacccatgaaaattctagtttatgaaaagatatgtaaactggtgactgagggcctgcccagacctcctggtaggatggagaatgatcaagggccaaatggtttgtcttacccagccagccttgagaaaatcctcttccttgaaagcctctagggagaaaggaggctcccactggggcagcccctggatggtcctccagccctgttctccactgcttcgccccagtggtatctgagcccaggctgcctcgctccaaaagctagtttccccgccagcatttctaagtcatgaacacggatcaaatgcccgcacaggggctgcctccctactgcagctatgacaattggcagagaccaggggcaggtcaggacaggtggtctcccagatattagtccttgtggcctgccagtcacaacggcccttctgctgcaagccatggaggctcagtgcaggatggatggatttgatgcagctgctggcatttcactccctgccgctgcccttggggaggagcggtacctgcaggttttttataagagcagaagcttccaaagcttcaaggggcttcccatgggcagcagatgtgcagagaggagctgctgtggctctctgcagcggggaatgtggcctgggctctgagttcccagctcaggcctgtggggctcgaagatggccaacactaaccaaagcctgttctgaatttcaaattgacacaaaggttcctcaaaaccagtgatggtaaacacatacgggatgtcaggatgctgctgtgacagcagttttgctgttgcctgagagagacaaggcaggtcaactccaaggcagacagaaggccagggagagtccccagtgtgtgcagggagagaaaactgctgtctagggaatgttaccccataccttccccctctcccttcttgccctttccccctccttccctccctttctctcccctccccttcctcttcctccagcatgcctgttgttttcacttgtacttaaaaaaattcttggttttatgtgacaaagaaaacctttttatttttacataaaagtttattaaatttgattccgcggcctggtgcaatggctcacgcctgtcatcccagcactttgggaggccaaggcgggcggatcacttgaggccaggagttcaagaccagcctggccaacatggtgaaaccccatctctgctaaaaatgcaaaaattagctgagcatggtgacatgcccctgtaattccagctactcaggaggctgaggcaggagaatagcttgaacctgagaggcggaggttgcagtgagccgagatgtagccactgcactccagtttgggtgacagatcatgaccctgtctcaaaaaaattgattatgaaatttgtatttccatcagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagcagctcctcctcagtgctgacagaggtgacagaaagtgacctcccatgtggcattgattgagggggcaggaaatcacccaggtgtcatccatttgtgtgagaagttgcaggggcccagggggcgtgggaagacgctgacccagaaggttgcttccagccagggattcagcccagacggcctccctctgtgaacctggttctcctgtctgcctagcatggggctgaggaagcctcactgacttcgtctctggacatttgaccccttctgggccttggaaaagccaacactggcttcttcctatagagccaggttccccgcatctttcacctactggtcagacatggccttccaggcagagaaagccttgtaggtactctcaccagcagatggccattttcacttggcaagcctcccggccacttccttcttttcacagcagacctgagagagtggacagagagccctacagaacctagggcaggcctgggagatggaggagacccatgccccagctcaagagtcaagggcccacctgaacaatgaggtaggggaacagctcctttcaagcccttccttccccaccctctctggactctggataaagaaacacgactgctttcctctcacccagaagccagaaggacctgagcacccaggacttgtggctgtcagagagctgtggaagggcaggggacaccagatggcagcagcaagagctgggcggcagcatctgcccaggccacctgcggagagaaggctggaatccgagggatcacactgggccagcattgagcctgtggccaccacactgacccctcctcagctccccctcacaggacctgaaagcatttctgagttaagtctgcataggaagttttccagagccatgccacatatccctccatccactcagtgcccattttacagatgaagagagaggcacccagaaaggtacaccaaggcaagatatggcgtagacaggatgagggcagagccagcttcctgatctgatggaagtcatgaagccttctctgccttacgcttggctctgcagggtcgctgagaggttcctttaaggagatcatcagaatcctaaatggcaaaaaatggcaaatcaggggaagagttggagcccagcatttggggacacacacacacacacacagtcgtcttgccttgcagaaattgggttgcattactccagtctgccactgagtggcacctttgggccatgcacttggctccaaagacatttctctgaacagcaacagaaaaacatgtttaaccctaaaaaaaaaaaaaaaagaaacaagtacatcttactttggatgaaatttgatgacagattgaatgcactgtctgcactttccaccacgtcatgtttcagcttcgcttgtccctccctttctgttgactagactacctgtgattcccgctgctctcggaaccagcacaggacctactctcttactcactgatgggggagctggcctgtccatgcacagggcaaaggatatgacacccagacctggatcctgctgcaaggctgccttgggaaccatccttaagacccggtagctgttgtccaagctttggctctggctgctgctgctctcagcagaaaagagctcactgctcccatgcggatgctgagggattaaacagaggcaaatacggaagtgagcagatttttctctcttgctctcagcagaaggagaaccattctgcagagaagttttcaacatatgcctcttcagcattgctccagatgcgtccgtcttcactctgaaacccatatattgagcacctactatttgccaagcaccgtgctgagcactgatgtgaattggctcagtttctccatctataataggaatggctggttcattcttacacagatagtctttatgattccaggacactgcctgcttctgggatctctcctccattttgatgccatcacttgatcccaactagatttgacaaagggtctcacactgtctgcatggtggcatgtatgtagcactggggttctcaaccaggaatgagttcatctcccaggggacattgggcaatgtttggaaacatttttagttgtcataacttgggaaggggggttgctattggcatctagtgggtagaggccaaggttgctgctaaacatcctacatttcacagaatagcctcaacaacaaagaattatccagcctgaagtggcaatagtgctgaggttgagaaaccttcatgtagaaggagagaaatcccgttctgataacgagaagcacattgatcttttaatatgcaattcttttctgttctgcaccataggaacacctttgatgttttcacaatctccatggtctttgcagctcatgtagtggcatcagggcaggctgagagatgcagcagaatgggtttcatgggacatcagctctggggccatctcaggcaacatcccgatgctgagccccctggaactgactgtgtttctgctcccacttcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggtttgcttatctactcaagtggttgtcataaggtgttcatttgtccccttcattgcctgacctattaacacaagttcaaggcattgtgggtagttaaaatttcagatttggttatttttaagttcatcagtggaaaccatttcagataggcgcacagcaaaatcccaggatcgttttcctagatgggttatgtattacatagaaaccaaaatgtgcagttatatgctttatttgttccaggaaagcctcaaagtgttttacaaaatctgaaggcttgtaataagtcagtgatagaatctggaaaccagaacacagcattggggaagtgggtgtagtgagttagcagggccatgagtcaaacccacatctgtctacctctgaagcccacactgataaccacctctctacactgcttccgcagtgatctccagctctgcagtgaatattttttaagcacatctatattccaggctctgcgctatgtgataagataccacaaagaacaggcaaaacccctgttctcaccgaggttgagtgggagacagacaagtaaatgggcaacttcaacagtgtgaaaagtgccccaaatgggtgaaccctaggttaaagcaagcctgcaggagggactcccaaccctgtaggacacaattaagatgctcacagatgctagtgatgctggctaaagaaacaggaaccaccctaaccagcagactaaattttgacggctgggaggtgccatttctaaaaataagcattgggttggtttcttacttcctggcccctaatttctatttcctgtcaccatcccacacccagtgacagggcttaagattttgcttatctccttgaccccacttacttctctcacctctggggcccccagtagagaatttgggtggtttgccccttgcagacattattatctgatttaggaaactcagtgtagctgcaccaatgcaaataatggcatgagaacagtgtcccttatcatccagaattaccttgtcatttgctcagaacttcaagatggaaacacctaccaacctcaacaccataactatctacttctctccccctggtcacgagctccatcaaatgcctgtgccaatcacgaaatcatgactccttcatataccccttgcagcttcaaagcagaatgtttgagtcatgagagctctttgctgagatatttttgcttatgtgtatgtacgtatgctttcaagcaccatattgacatggccagagaggagagtgacaggggagttccgtgggggttccctgcatgaacaagctgaagctcaaactccaatatttatgaaacacaagaagagggatactggtcaaaaccttgatgcatctagcacagtattaacactccaagcatgacatcaggagggatttattttaattttttattatgaaaacttttaacacttggaaaagtggaaacagcaaaacagcaaacatttatagaccctcatccagcctcaaaaatcatcagtacacgtctgatcttgctttatctctagccccatctactttttcacctgccaccaggttactttacaacaaatccaagatgttgcatcatttcatctgtaaacttagatatgtatctctaaaaaaaagatccttttgttttaatattgccacaatatcctttatctccctcccttcctcacatccccttgcaatttatttgatgaaggatttagatcctttgtcctgtaaagagttccaagctctggatttttctgattgcagccctgtggtgctatttagcatgttcttctatcatctctctttcctataaattcgttttataagatatttaatcagatttaggtttgatttttatggacaaaaccacttcatggattgtgtggtgctctcctatcagaaggcacatgtctagccacctctctttttgacctttttgcagatattgatgtctatcgcttatatccattagttaattagaggttacaaaacaacaacgtactaattttattctttcttcacttattagctggaatactttcataaagagaaacttccctccaccactatggtattaactagcagtacaattcacataagaaaagcaggataaatatttgattctctcccttcatttgccagttttcaaaatgagtggtttgctattatcttcctatggtaaacattagggtctattttggttttactatctttgtaaactcatgagtttaaacatatatgctatgttttaatccattttgctgattacttttattgatgcttggattgggccatctctggccagttggctctttctgacacagccctaagagtgatctttgacatcatccaaatagcagggaagctaagatattccagtctttgcccttacccagaataagctgtttctccaaggatccctgattcctcttagtgagaaatggtatttagagactaaaatctaggcacttagagtgtttcattgttcctggattgtttatcatttccagcccttttcagtcgacagagctaggaaatgtgttgctgtttataataaaaatacatcctgagttcatactgatacttttaattcaaattctgacctacaggggattttatttaaccgcttgtttcttacacctgtgcctcttttctctatgctgacaatcctgactttcaagggcactggatgatagcataattactcatttgctttatactacacagagcagtctctaaaccacaatgctaaaaatacagcaacagtatgattatcgcctggttctttaattgttgcatagtattccgttgtgtggaggcaccatagtttagtcaaccagtcctctcttcttggacatttatgttgtctctacttcaagaaagttttgatggaagaagtggggaagtcagcctaacgaaggttacatattgacaagtatctcaatatccaacctacagtgctctaccattttccaagtacttctaaatacattctatctaatttctacagcaatctagactagacatgaggatgtcttaagcatccccatcttcttcattatctgctaggattagtctcccatgaattcaaataaaacactcttcctaagccaatccctattttcagaccaatttcctattgcttctgaagtgtatttccaccataaatatacaaagtgttcctttctagcagagtgaccttggacaagttgcttaaattccctgagtcttcctttcctcatctgtagaacagggatacaatggagcctacacataggggtggaatggggaccaggtgaaaggaagcatgtcaaccactaacgatgtctggcccacaataagacagagtaaatactaccatcttatttttctaatgtcactaatattctctttttaagccgtagtgtttaatgtatttggtaaaaatttttaaataatttcacataaccttagcacccagagataacccctattttggtgtattttcttccttgatttatgtgtgtagctacgtgtaaggtctgctcaggctgctaccacaaaatagcacacactgggtggcttaaactacagaaatttatcacagttctcgagactgacaaatccaaaattaaggtgtcagcagatttggttgctggtgagggctcacttcctggcttgcaggtggccgccttcttgctgtgtccttataactctggtctctcttcctcttcttataagaacactaatcccgtcataagggcctctctcatgacctcatttgaacctaattacctctcaaaagacccacctccaagtaccaccacactgaggatcagggcttcaacaatatgaaatttagggagacacaacattcattccacaacagggcgattttgcaaatagcgtgatcctgtaacctgccttttacctaaaacaggggtcagttaaaaaactatacttttcctaaaaagagccagatagtagacattgcaggctttgtgagtcatgtggtctatgtcacaactattcgattctgcatacaaaagcagctacaatgcaacaacatagcaatgtaaacaacataaatgaggacctatggctgtgtttatttatgaacagtgaaatccaatttcatataatttttcacaaaatacaattcttcttttagtttttttcagccacttaaaaacataaaaactgttcttcgctcatgggatgtaaagatctagatcacaggtctgtatctgtagatttgaatcacagactgtagtttgtgaccctgtgctaaataaaatctagcacatggtcatgaaaattattgaaatgcttcaagaaatccagaaagctacaggatagaggattgggcataaaggatcttcagtttttgggggagagtaagttagaggagacttggttttgacgcagccatggcaacacagcaatctgaattgtgaatgtttctacatgaggattgagtgttgcggagcagaggtcagcaggtgccaagagactcacactgccttaccttcctggacagcactggctgcctgccccagcaaagtaggtgcagttcagaagttcccaggtataaaaaggaggttaaaatcctcagcagcccatgaccagccaggacttgcactcagatgtcctcgcttgctggccaagattctgctcagaccacactgtccctggattgttagtgctgagggcttggtggtcgcactgagacctggagaagttctagtccctagagaaaggccaagagtctgggagttccttctagaattatccatttaagttctttaaactttctcttctcggtttgcctctctgttaaatggggatgttaacacctcagcccatggggctcaggggctctgggtggcttcctcagctggtcatgatggttctcataaaccccctgcagtggtcatatgctttaatattagtgctcagtagcctgagagaaagtacagccagatttatggattcactggaagcagggactgggggtggggtgcagcctctctccaatgggttttgtttcttatttgaccacacgcattgttagagccaagttaattgcctgtatttgcttcctgtggaaatatttcacaagacaccctgttatcgtgggcccagcatttgtacttgtgttttgctgatccgtttagcttttttgaaaattttgggccaagaccaaatcttccataaaggtctgtgggctgtgaccatagtcctcagctgtttgctgtgttgttccaatttcatagatttagccttgtgaggggagaaaaatatataggccatgattatttttttttaaggactcagttctttatgctatggatttaattctctgttcccaaccatgtggccttaaaggacctgcattgtcacctgcttgctatgtggtctgaggcaagggccttgaccttttgtgccttagtttcctcatctgggtgatgggggtgatgtcttctttacagcccgctaaggatttcagagaaatcagatgagctaatagccctgaaaaatctttgaaaaagtaaaaagtgctatatatttgtaagtgtgaactcacaaaaattaatgactttagtactctctggggtttcgtaattctaagctggatccaaaagaaattctctcaaaatatctgcccttagatgggaaaaaatgccagaaaaggatgtaagaactgaattttcaggtcctggaatgcatcctaaggaatttgagcttctcatcctgaagacagtagcaaagcattgcaggcttttacctggaagatggtgaatcccatggtgatgggcatagtaggctggagccaagagagagttctgaaccctggggcatgtcatataaagctctgctggcagttgttggtggagagaattaaaccacaggaagtattgagaaccttcagcttccttgtagggcatttgtctctttccaaagccttcacaggctctagatgagatagaaatcaaatgccagcacagtggctgcctggcttccattttaaatctcagagtaccaaggatgttccaaggactatctccctggatccattcaatcatttgtccatctgcccatacacccatgtcatgaacatccattctcccattcaagttgggaaaccttgacccgtgcggcataatattctgtgcagagggaaataacatgagaaataggaggcccagatggctttttttttgccatcaggcagagcttatctaaaagcacatcattttcaaacaaaacaaaccagacctaagaaagcacttcattgagataggattggattggaaatctgtcctttaagtggactgatagtggaataggacaagccagtccagccccattggctttgatccttgcagtttcccacctcaccttcctactcgtcccagccccactgctttcctgacctgtggtacctgctaagatgccccaccctgccctgtacctggagtgtctgggccttccagacctctggatttgaaagttatttcatgggagcagaaatttggtcttctttaccttttataagttcctgcatcacaaaggtaatgctgaatgctgaatgtcagctaaatgctgataattcattccagaattataacattttcagctgtgcctatcaaagaagcgggggacaatttgtcccttagctttcaactttggagagacaaccttggggagtacacctagtagatagtcaagaaaagcaggttaaattaaattcctacaatgtgccgattcagcaaaacttggaatacccactaagtgtcagatgttctaggcgctgtgaatatacaaatgcgtagggaggttcctttccttaagcggccctgggtctgacttaccacagctctgcttggccttgatgaactcacaaaaggatcaaagagcatgctcaaggccagaatgaggtctgcgtgataaaagagctgagaaagataccgtcaagtccacatccgccatgagcagacaagaagcctctagcaaaacgtttatattattacctaagtgtagatgtttaaatgcaacttgattaaggaatgcaaggtttctaccatttgctttgtttaaaagccaaagcccagtagagtatgattttaggtttgcccagattattcagaagtagaagtcttcccagctgttcatctttgctccagtggtggaggtggcggcattgcgtgccagtatcacaagaccacaccaagtttcctggtattaatcctctattggaaggcatttcctggtagactctcatgccagacatattttaataaggaattctgtgacactgcttgctctgggggttgctcattttatcctgtaggtggttttatttttgggagatgaacagcagagggagggatgcattttgcagagaataaatcagtcatttgtgatccagttctgtttattaccacacagactagtagttcctgacagctactgagagaagacgtcaaagagttcaattccaaaatttcttggttgctacatctaagcatagattccttataccaaaccccatgacctccttgaggaggaaatgaaaatacttttcttcttttttttttttttgagaaggaatcttgctctgtcacccaggctggtgtgtggtggcacaatctcggctcactgcaagctctgcctcctgggttcacgccattctcttgcctcagcctcctgagtagctgggactacaggtacctgccaccacgcccagctaattttttgtttttttttagtagagtcggggtttcaccatattagccaggatggtctcgatctcctgacctcatgatctgcccgccttggcctcccagagtgctgggattacaggcatgagccactgcgcctggccaggaaaacacttttctaagttaacatccctggtatttgggtaggtgaaagacaatatgcaaagctgtctttgaagctacacttttctaagagtagggattgaacagcatgaaaatactgtgccctttggccagttaaattaaatctgtttttatagatgctttgcagagtaaaggcaaaggatcatttactctcacatcctcttatgacctggaatgatgccttatgtggaaacacagggctcccatgtcctacttaggaggctaaggaaatccaaagggggcacttcccattttagatccacatgatcccaggttgttcatccaaagatacatccagaaggagcaacagcttcctatctttcacttatgtggatgtccatattgttgcggtatcttttctgttgcctcttctatgtttgttaagcagatactgatttgtgatccacttcaagtcctcaccactgtgctgtcctgcaagaaccgtgctgaagaaaagctcattttccctaggcttcagctaaccatgcctaaggtctgaggacctttggtcaaacatattcaagtctcttgaaaggtgagactcaaggatacagacttatgacttcctaagggcccatcagccctcaacgctttaccaggttgggaccttgtttccaaagatgttcatagctcccttcaagtatagatggcaagttgtgcatggactgcctgttaagtgagaaaccagagcctgggccatccctggtgtcttggccattaccattgctaacagcagtgatagtgaatagtacccaaaagggaattgtaagcagtggccacaccttctactaggatgactcagatttaggactcaagaggaggctcctaactttcctgcaaccacacatggagggattttgtctcagccaaccagtactgactccccttgggacccaagtaaaggacaatgaaaagcagcacttcaatgtgagaagagcgtgagctttggggtcacagagctctgggttcaaatcctggttccatacttaccttgggtaagccacttgacctgttagagtttcagtatcctcatttgtaaaatgggggtgtttaaacctaagcactacttcagagcaaacatcaccaacaactgaaatagtacagctagactctgctcccaaatcctctttgcttctttctccagaatctctctcatcccacaaatcatcccttgcaaggacagtcacagcatgaaattattattgccacttgacatgtataatcatttttgtagtgcttccacttctacttccacatttaattgtgtgattgacaggactagaaaggtgagcttttggctcccagtccagttccttgtccatcaccccacacagcaacaccacattctgtccacacagcctcattttccttcaagagactacatgggacccaaaagctcccaaagtctggatgtgattctaggcagcttaggtatggagggcagagatgaggcacacacacctacaaaaagaaaaataggatacttgaaaatcacaagaagagctcttggccgctgtgcaatgctccagctgggtggttctccactccaggaggacgttctgaagctgggaaatgagatctgtgctgtcttaggagcccacagcacaggggaggacataagggtcttcttgaggagttcagctgcatgcttgtggcccagggccccagtcatttgtctgattagcttccccacctcttgagagagtcactgtgttttgtctaaaaagaaaggagatttccaaatgaggactctctgagcaaaatattgattttcagcaggtgtggttttgagacagtttgtactgcatgctctctccagctctcactgtgcctcggactctattgattctagttggttttgatcctgccttagcattccaggaaagcagagctctcctagcccaagaagagaaaatgaaggtggagtggctcatcggggtaacatccctccactacagccatcaaccactccagggatatgatgcctcccactgctgaggactctggctaagacactggtgtgatttagagccctagagcattggtttatcatcatatagagaaccaccctcatcttctttggaggaggtgcctctccactgcatcccaaggtgggagtgacctctggtagttctgcttgttcatagtcagcttagtcatctctgttgtagaaagagaaagagagagagggcaagaaagggaaagacggagggagagaggaaggaagtgggaaaggagggaagaagataaggcaagacaaaataagacaaagcaagaaagagagagagcacgcgggccagcacgctttttctccatccccttaggaatttactctcagcaggggcttggcttggctggttttgccagtgactcccttgcactttgcagattctgaatatacatttcccttaagactggttgtctgcagaataggggaaacaaaccagcacccccataaatcagcagaggtcactgccaagagctttgtacacttgctgtccctggcagtgataaactcattgcatttgggaaatggccaaagaccctgagtccaatcttaattctcattcccagaaaaatctcagttttctgttcacccacccccgtttactgtctttgtgtttcctagacaaagctggcaaggaggaaagaacacagttcaataactggatcatcaaaggctgcatttcgttgcttgggggaggagttgcagggcaggaaagagtcacagatccctaggctgtggaaaagagaggcccaggccagagggaggctgaagccatggggtctgcatggggtgtgagagatccgcagaggttctcagattctggttttctcagacccgcaccttggatctgctattactgctgtggtcggttgttcccttgaagggtggttcaggctgttataatggtggtcaagggctagcagtgggattggtgtggtgagaccacctcatgggactcatgctccagtaggttgtgttcttattctcttatctttctccccacaccatcctcaccttggtatctggctttggagttggccatatgacatggagaagatgagagtggtgtccaaactgctcctctgacccacatgggcctcctgagagtggacaacctctctctgctgccctttcctccttgccccttgattgtctttctcctctgattgatcagactgtgaagctgcaagaccagacccccccctccctgcaatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctggcacctagtaaatgctcaataactatttgctgaatattattttgattcagtgtttagacatctgctttatcctgctctattttgattgacaagttctttctcttcatgaaccaggcttttccctcctacaatgagtctataagaattagctagatcagaggggaatttggtgctgagccagaagagctgtctaggggaggtttcctcacttcttatggggcagcagaggggtattgtgagatattgagaagtcagaacaagaagcagggaactgttgctttggagaagggtctggagaggttccaggcactatgataggcttttccagatgactcaggagccacctggctctgtcagccagaaagaagtgatgcctgacacaaggagacagtgtgtcatttttactgtggactaacatttgtacctaagctttaaatgttaaaataatttggctgggtgtggtggctcatggctgtaatcccagcactttgggaggccgaggcgggtgaatcacttgaggccaggggtttgagaccagcctggccaacatggtgaaacaccgtctctactaaaaaatatataaaaattagccaggcgtggtggtgcatgcttgtaatcccagctacttgggaggctgaggcaggaggattgcttgaacccgtgaggtggaggttgcagtgagccaagatcacaccactgcactccagcctgggcaacagagcgaagactccatctcaaaaagaaaatgttagaacaatttaaagagacaacaaatgaaaccaaagaccaatgatacccctcagcctgggctctgagaccattagggatggctgagccaagattttcatgctcctctgagctgagtgtaatcctcattctccttctgtgcagagagcaggaacttgatgcagtcataaacccaagcaagtatggagccagtaaacttgctgaacattaaattccaaccggcatttcagtgaacatgtatattcgactaatatctgagcctgtgctagacagtatgcatctgtaaaaataaacacatactgttcctcaaggcacttaaacaagagtgagctggatttttgtctgaaattttcagaaaaacacttagtgaagtgtgttcacactaagtttgttaaatcagaatacgtctggactatccaagtagtctcagaaccaggccactattggaggctgggcgcggtggctcacgcctgtaatcccagcactttgggaggctgaaacaggtggatcacttgaggccaggagttcgagaccagcctggccaacatggggaaaccccgtatccactaaaaataaaaaaatcagctgggtgtggtggtgcatgcctgtagtcccagctactcatgaggctgaggcacgagaatcacttggaacccgggaggcagaagttgcagtgaactgaggtcacaccactgcactgcagcctgagtgacagcaagactttatctcaaaaaaaaaaaaaaaaaaaaaagaaccaagtcagtatttaatttcatttgagtccttccagtgggtttattcccattagtggggtaactcccctgcttttgtaaatatgagggtatctcaggaagaataagtcccaaaacaagattctttgggttccaaccaaagatgaaaccaagagggcctcacatgtgaccaagacattttctgctttctactttcactttctttttgtttattttttaaattgagatgtaaaagttgtatgtatttatggtatatagcatgcaattttgatatatgtatacattgtggaatggataaatcaagccatttaacatatgcgtggtctcatacacttattgtttgtagtgagaacacttaaaatctactctcagcaattttcaagtatataatatattgtttttaactgcagtctgtagtcaccgtaatgttcaagagacctcttcaacttattcttcctctctaattatgtggtgtcctttgaccaatgtcttcccagtccttctcactccccacagcccctggtagaatggccattctgctctctgcttctgtgagtgtgattgtcttagattccatatacaggcacatctcgttttattgcacttccctgtattatgccttatagattctgtgttttttacaaattgaaggtttgtggcaaccctgcatcaaacaagtctatcagcaccatttttccaatagcatgtgcttactttgtgtctgtgtcacagtttggtaattcttgcaacattaagcttttttagtatgattatatgtttatggtgatctgtgattggtgatctttgatgttactattgtaattgctctgggggtgcccaactgcacccgtataagacaatgaacttaatacatgttgtgtgtgtgtgttttctgactcctctaccaaatcagccattcccccatctctttccctctccttgggcctctctactccctgaaatgacaactatattgaaattgggccaattaataactctgcagtggtctctaagtgttcaggcaaaaggaacagtcgcatgtctctaactttaaatcaaaaactggaaatgattaagcttagtgaggaaggcatgttgaaagccaagataggctgaaagctaggcctcttatgccaaacagcctaggtgtgaatacaaagaaaagtttattgaagattgaacatgctactccagtgaacacacaaaagataagaaagcaaaacaaccttattgctgatatggagacagttttagtggtctgaatagaagatcaaatcagacacaacattcccttaagccaaagcctaatccagagcaaggacctaccttgcttcaattctatgaaggctgaaagaggtgaggaagctgcagaagaaaagtttgaagctaacagaggttggttcatgtggtttacaaaaagaaaccaagtccataacataaaagggcaaagtgaaacagcaagtgctgatatagaagctgcagcaagttatccagaagatctagctaagatcattgatgaaggtggctacagtaaacaacagatttgcagtgtagattaagcagccttatattggaagaagataaatctagggttttcatagctagagaagagaagtccatgcctggcttcaaagcttcaaaggacaggctgactctcttgctagggctaatgcagctggtgactataagtcgatgccaatgctcatttactattctgaaaatcctagggccttcaagaatgatgctaaatatattctgcctgtgttctataaatggaccaacaaagtctggatggcagcacatctgtttgcggcatggtttactgaatactttaaggccactgttgagacctactgttgaggaaaaaaataatatttctttccaaatattgctgttcattgacaatgcaccaagccatccaagagctctgatggagatgtacaaggagattaatgttgttttcatgactgctaacacaacatccgttctgtagcctatggatcaagaagtaatttcaacttttcaagtcctattatttaagaaatacatttcataaagctatagctgtcacagacagtgattcctctgatggatttgggcaaagtaaatcaaaacccttctagaaaggagtcacccttctggtggatgccattaagaacatttgtgtttcgtggaaagaagtaaaaatatcaacattaatgggagtttggaagaagttgattccagccctcatggatgactttgagaagttcaagatcctagtgaagaaagtaactgcagatgtggtggaaatagcaagagaactagaattagaaatagagcttgaagatgtgactgaattgctacaacttcataataaaactttaatgaatgaggagttgcttcctatggaagagtaaagaaagtggtttcttgagatggaatctactcctaatgaagatgttgcaaacattgttgagatgacacaaagaatttagaatattacatcaacttagttgataaagcagcagcaggatttgacgggattgactgcaattttgaaagaagttctactgtaggtaaaatgctatcaaacaccatcacatgctacagagaaatctgttgcgaaaggaagagtcaattgatgcgacaaacttcattgtcttattttaagaaattgccacagtcacctcggccttcggcaatcaccaccctaatcagtcagtatccaacaatgtcaagacaagaccctcccccagcaaaaggattatgactcaccaaaggctcagatgatccttagcattttaacaataaagtattttttaattaaggtatgtaccttgttttttcagacataatgttattgcacacatcattgactacatatagtgtaaacataacttttatgtgtactgggaaacgaaatatttcttatgacttgctttattgtggtggcctggaaccaaacccacaatacctccaaggtctccttacataagtgaagacaagtggtattttgtctttctgtacctgacttatttcacttaacctaatgttctccaggtttgttcatgttatcacaaatgacaggatttccttctttgttaagaccaaatagtattccattatgcctatatactgcatttcctttacccatttatctattcattgatggactcataggttgactccatatcttggctactgtgctctccctttcttttgtgctgggtaaggagtgagtcttggtgaatccttgtcattgctctgtctttttctggccaggcatctctaaaatgtgtcccccagctgatgggaggtctgtgcctcctccttcgatcccttccctggaaagagcaccaaggaagaggtccttaatgaccagtcctgcctctcagatgagcactctcctcctccctgaccagctctccatccccctcaccactagggcctttgtctggcttcatgagaagaacaatgagcatacatgggggaagatgcttcctccaccaggacagccattaactaacaagcccgccctccccagtgaaggccaacctccctcctaacacattctctcttggaacagccaagctttcctgtgcagctgagctgaattccacttcaatggataaataatcttgcccactgacaagtcctcttttctaagggaccaggattttccaacccttgatgaggacagatctgtttggaagggaccacaagattctaggaattagctggaaatcaggggtgaaattatttgccaaggccagaatgtataacaaatgcccctgggagccgaggaaaagaggcggcaccttgctgcagcacctgcccctcctgggtgttagttacatgtcctgtgatgtggttgccaagaactccttccaggacgaggtggtggccctgaaatgcacaaactgacccaattgcattattgcctgtttttttaaattaaactttttattttgagatacgtattgattctgatgcagttataagaaatactgtgctgtttacccagtttgccccaatggcaacatcttgcaaaactatagtaccatatcacagccatgatactgacatggctacaatcccctgattttattcatatttcccagttttacttgtgccccatgtatgtatgtgtgcatttagttctatacaactttatcacgtgttaagatgtgtcaaaatacagaaccattctgtcaccacaaagatccttcctgttgccttttataaccacacctcccttgctccctctacttcctcatctctaaccccaggaaccactaatctgttctttgtctctataatttgtcatttcaagaatgttatgtaaatgaaataatatagtttataatctggagcttggcttttttactcatcctaattcccttgagattcatccaagttgttgttgggtgtaagaacagtttgttcctcctcattgccatgtctggttttaatcattaagcaccccaacatggcacccaagcccaattacaaatccctcaggacatgatcctcagggaacttttattctaagagagcccatatgttttgtttggtgctgctgagtttgggggtgtggggatggaacatgttgcaagtttttctaggtacatgcaaacatacctaggttccttcatctccttccccaaaacagtgatcaattggattgtaatattctttagcactggttgacagcccttccttgtgtctccttgtcaccttcctccccaggagcacatctacaagctgatgaagagtgacagctatgcccgcttcctccggtcaaatgcttaccaggatttgctgctggccaagaagaaggtatctttgggaagggcaggcttgctcttagcactgttgactcttgcctgctgcttgctgctggtttgaaatgagaatatcatcccttgggttttatttatttcctactttcttctttcccttctctatctgctcccattctaatggaaaacagttaggattgtcaccaccccagccccactgcaaggtccaggatggggcatcctacctccacatccctactgcctctctctgcatgttctgcccatggtgggggtgggtacgtagggtgacaaaagactaaggccacagtggctcagcataggagtgcagggctggcagtaacaccagcaaaacccttaggacactggagagagcccctcactgcaaagtccagccccttcacctcagacttctctccctgaccagcccagagaggagtatgaggccagggttggggcagctctctcactggtcagaaagccttgtcagtttcaagagcacaatcaggtacctaaagtcatcctggggtttctccctccttgacacccccttcctctcccgcacctgccccacggtgttgcctttctctcttaaccaagaagtaactgcacccagctccttcctcctcctccttagaactcagccatggttccttgcagcccatggagtcatggatttgaggtgcaggggccctcagcatgcaggtgaggggtgacagaagcaggaataaattcagctagattcctgggaagagaggaggaagagtaggcaggagaatagggtccaggaagggaatggaaggcaagagagagggctcctggtttcagtacacctgcccaccctctgtgcttttcagctctgatctgaggcccatgtgtggttaagtgtggctcaacttgcaccaaaccctatgacttctgtgccatggcacttagggagcacaggcatccctttctcctccctcctggactcccagccccaggccctaagcacgtggttgcccatcacatgctctccgctgggctgcctctcagccacgcaagccttctctctgtgtgctgtcaccctcatgtgccaggatcctgtctgcgtatctggttgggaccacacaactccagagtcctggagagcatttataacctgctctcctgcccttgtgtagccctggaaagaggccatggagtctgagaaaggaaagaggacttctggggtatcccagttgtcagcagctctctgggtttcctgcatccctccccacaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaaggtcaaagtaagtttttcttattttctgtggctcaagacccctgatctgatcacagtttggtgactttctaaggctctggtagtttaaccagtctaggcctgtctacacacctagaagaagagaagctagaggccattgattctccttgtgggtttgaacacaaaggaaaaatgcaccccaaaccaggctgagacccctgtggctgcagatcctcccttccaagaagaaaacctctcagaggaggtcacttgagtgaggaaggaactggcaacctgcctgggaaaagttccttagagttatcctcccagctcccgaagtaagggatgttcttgagacagaaagcccttgcagataccaacaacgtctcaatactgaggagttgtttcccaaaacagtgacaaaacctgctttctccttctgtttcttcctgagagtctccaggtatggatctgatttgtaactcggcactttcaggtaggcctagagtattcttctgatttcagggacgggttcaccgtatccaggtcataaaaggtatgtgagattcacaacctccggcggagagagggaatatgaatcagcctcacttttctgctgagaactgacctggacggagtcttgaggcacagccttctgatccttcatccctaattcagcctcttttctaatattttccaaataaatgatagtcacactgaagaatcaggttctcagggggtaggtgagctgagtcctgagggctactctaggaaacttcagtaccagtgatgatggttttccagggcagctcaatggccagtgcaaggcagaggagccaagtgagccagaccaatggccaccctctgtgagccagaggataagaataacaggccgacaatgccagctgcagggcccaggactggcctgacttgagccaagtgtatgccacccaggctggccacagggttcaagctgagtcctgccatccccagaatagagacttggtatggtacccggggccaagcatgagtccttcagttcctagtacaagaagaaaggccagcccaactctgtggtgttatgtcgtttgtgttgtattttccttctgcaacctcatatctgtcttctggcagccagctgagctgacaaggggcctggctgccaaggaagccccccaacttcatccacacaggcggctgcctttggcctgtcccctctgctttcagcacagtccgcagacccacagacctcaggctgcctctttagctccctcatttcagttatttgctgggtgtatgtttgtgtctatgtgagtgtgtgcactctccgaacttctcagcctcgggctcaggaccctggaacgggatccaggatacactagcaggtatttgagcggtcattctactctcccggaacccctgcagctaggaaatgtggggtgaaaggaaagtcaggagcaccccacacctctcttcctcctgtagtagagggaggctaggcctggaaagacattcaagggctttgcctctcctcgctcctgttctgggaaccccagctaagagttccccacaatggtttctgagcttcctctagcctgtcgtacgtacatcttggcaggtgttatgtcaccttttggatactgagaaaacacacaatccccatgttattgtcttctgagacccaagaccctttgtccatggcaaaggctatgagtagaccctccttgctctaaggacacagaacgagggtcactaggaagtcactgaagttagcaaactttctggctgcctctgggcaggggaatctcaagagagaaaacagtcctaaggcagactcatggatgagtagataacttcgcttccccggcagccccttcctgacgtccctcccacaccctgctggctctcagagccagtctgttctgtgtcaggacttggggggcccccagggccccagggccacaaccaccagggctcctgcctgtgggcacggcaggttgaaagcagcaagcaagctgctcaaacccaccgactgtggtcctgcagcaaagtcatgatggttctgatccaagccccgcaagcaccattcatggcccccggagaagcaaagcccccctctctgctccctgctccaaggaggcggcaccatttctcgtgggcttctgtcttctgtctctcccattgactcttccaacagctctggctgcttctcttttcccatttttcgccccattttgctttggtttttgttattctttagctgcagctgctgctgtttgggaaccacgtataagctgaagattttttttttctgtatttttctccctacccttttttttttttcctaaagccagaaagtgagcaaggtcgtagaacttccctagaaaagttcactcgcagtgtggtaagttcagtcggttttcttccctcagcttttcttttggttttggttttttctttcttcttcttttttttttttttccctttggttgttgtttcctttggggtgggagggagtccagtgctttctccctcgactcagcccttttcttttgcgagtgtctgcagcttctcttctagggatgaaaatgcaaaaaagagcaagcggctccctctgcagaaggtgcacccttgatcgcccagcctcaggcctgggcatttgatcatctgttcagggctttgaggaggagggaccctgctgccctcggggctgtgcggtttgtgcatcttctgcagcagctcagggagaagccatcgaactataccgtgaaataaattggctcagaaccatagctcatcgaaaaaaaaaaaaaaagccaaaatttccctctgtgaaccctggcagtcacgccggtgtgggtcgcgagctaatgttgctgtgtaggcggcttttgctgtgtgcagaaagcggccgtgctgcatgggtcctggcgatgtggcctagctggcgtgtgtgttagtcgcctctgcatgagtcccttccagcccccatcagcctcatgtgcacagtgtgatagggagaggagggaagtagctgaatccctgcggtgtcctgggtactccccgggggcaaggtcctaccggcctcctcaggccttgattctaacaggctgggtaaagatgggcttcagattcctacaggttcatggtacgccccagctagagaggtagagctccccacagtggcacataaagacagccgtggcaacaggtgggagtggggagtccgtggctgttccctggggtgcatggctgagactctctaccatggtttgtagaacaacacaggccaatctcctctttccatgctggtcggcccaagatttgaacattgagctcagtgcacaagaaatactcaatcccgctcaatcacggggcccatcctgtaccatgaacatcaaaccagagggaaccagggagcagggtcccatgcagggagctggccacattcccttcccaaagggtggcagcccattgatattgacttgcctttgttccacctctgttgaggaggaaaatccttgtaaaacctgactactgtgtgactggtatacgtatttcatccttttaagaaaaagtctaaggctcctgggttgaaagcagcctagtcatttacgtgtcgtagctagatgcattttaagtgcatttaaacattatcttgaatttgctacatgtaaacctcaaataactctagtgggtggcaattaattaaacatcggtatccatcccttcccttcctcggtcttccctctctgtggcctttcctcatgagaaatcagaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggtagtgggatcccatctctctctgtttgtctcttttgaggactggctactgtgcgggtggaggatggttagggattttgctgacaagccaagggtgcctgtgtaagcagagccttgacagcccccggaagctcttgagggtgaccgtgcaggccacgggtgtgagaggggaagcctggtacttggacaaaacgtccagacattttcaggctgtttttcaagagaagtgagtatcaagaaaggcaagaatggtctcgcgaagctctgtgaggagcatttattgatttcctttcatcccagaagtggtgttggcttgggggttctcccaaggtctgttagcaaagcatttggaacaagaaagcaccaagacacccctaagtgtctgaagtgcacacatgggagagcttccagagggagtttcagagtgagctgaaggagaaaagtatcctaagctcctgagggtgtggataaaaggcccaaactattaaaaaaaactaaattcctaaattccctgctattttatgaacaagaaactctaacaggtgatgcattcagaatttggggttccagtggtggagatggattgccatccatccatgctcctcctgctcttggggtgacaccatagccccacaagatgtggctaagtttggggaataatatgacccatgtgttggctctcagattacttaagattggaacccaggaatctggtctcaacagcccagtggtctcatcaaacagaactaactaactgatcaaccaatatgccttgcaatttgatagccattctctgactatcatatgcctaaagtatttgatttctctaagagaagatctacgtgaatgttttatctgctatatactgcaagctataaaactaaatgaagggccagttcaatagcattcctgtgttgctgggaaagatgtgtaagaacatgacccatgtcatggggctaataatggaaacaggggagtgaagctgggcagctcacggaccaaagacgtgaggccaattaccatttaggattaattgatggcaaaaagaaataatgttgatccaggtgattggataactcattcagctggaggcttgtcaagactgaatctgaattcagaatttctccccagaacatgccaatgtcctttcttttcttggtagaagagaaacacttggaaaaaacaaattgttctttccaagtcttatgttgtgccatgacatagagggattatctgttaagaccacatatgcccccttttccatgagatcctaaggagacatttaatatggttcatggaagcttttagggccatgttagtttgggtgacgaaggggcctggtactccccagtcaatagaggaagtgctgtatgagcttctctttccaatgcaagcttcattccaggttactcaggacttggatatacaaagcaaatgtctggggacactgggccaagcatcctgtcattttgcagactgaaaccacaaaccctgcttatttgataaggcccaggttctgaactaaacatgactgaagtccacgacagggcgcaactagcctaccatgtacgttcatccaaaatggaaaacaagactccctctggtgggcccagcctcacagatgcccagctgaccaggcaaaacacaggctgggtttcagcccctattgatcctcagctgccctggtgcagtgaataacccacgccactgtacatggccacccttgtccgaggagcctgtttcagaaagagctgtaacacacagcagcttctccagggcccccaatacatggcctcaggtcatgtgatttggagcctgtctctgcctaatcctgctcatggggaagcttcctttcacagtggctgtaacatatgaaaaccacagtaggagaaatctggctagtcactgtgggttgcctttgcttcaccttccagctgttcttcagattctttggtgggaagtctcaggcattactgaccagggagaggaggtgccttctctcactgaagactctttcctgttgcttggtgatgtctagcctgccactctctgctatcttcctggttttgcagttgacagaggacaataggagcatgaaggtggccagagctgaaatgctcaccctcccactgcttcttgagacagagtctcactctccgagcctggagtgcagtggcacaatcttggctcactgcaacctctgcctcctaggttcaagcgattctcctgcctcagcctcccgagtagctgggattacaggcacacgccaccacacccggctaatttttgtacttttagtagagatggggtttcaccatattggccaggctgttctcaaactcctgacctcaagtgatccacctgcctcccaaagtgctgggattacaggcatgagccaccacaccccgccctctgctctctcttaagtgtgcttgttgcttcagcttccacagagtctaccacagtggggtggggggcctcaccaaagagggcctggctctgacatagaggaccaggagcatgcgtgggagggagagggggcaagaggaatcggggccaagccacagcagcagctcccttgttgagatagatactggctgaagccatctggtgagagctccaatctggggaggagaagctggagaaagtcctttgctcctctgtccagttccacagaaaaagccgcagagggtgatagcactgaagttaggagaaaatggcagccccgagtgaggctggtgtcagcctccctgggtacctttggaggctcagttgaaaccttacctgccctcttgagagcttcatcagctccagccttgggctccaaagatagatagatagaaaatggggttgctggtgccagagcaagcactggaggccacggaggagaagggagaggaggaccaggcgttcatccacctcctaagagagcatcgaagtttagctttgccaaggtgctccttggaattgcggcaggaagggccggaagctgcagaaggcttggcatgtgatgggtggcatctctgcgacaggctttcctgtcctgcctgcctgccaaggaatgcagcaggcaagtcagatggggagcgggaagctctgggagccagctgccactcagcctccctcgccccctccttccatccccctgttccttcccctgccaaaagccaaggaagagctaatgagagccaagaagtcaacagctcactcatccccctccaggcagctctgcagagagaaactcccagctccaggcccaggtgctgaccggaagtggagggctaaggctctccgcaggggagggggcaggcaggcaatcagggcagtcagccaaccggcagaagcagctcctgcccccaggaaggcggtgttgttttcccctcctcctcaaggtttcatggggaacagccttgcaccctggtggaatgagttcccaaatacctagactcagcagaatccccagagggctttgacctcagttgaaatgatctttctgtgcctctggcaagggccaattggctaaaaatctttccaaagggttagtttttattgcaaacagtccttggactcctttgggaccactgggtcacaaacattagtgccagcctctcccatctcagagcactgagatccagctgcagtgaaaccctggccctggctggagctggagggagacttccatcgaagtgtttgggaaggaaagcagggaaacctgcctctctggagcagcaagtgcatgtcctgggactctgagacacctcagcagccctcctgcagactggctcctgcttccagcctcagcttgctagctatgtgacctcaagcaaatcactagccctctctgagccctggttttctcctctgaaatgacttggactaggtcgtctcgatggtcccttccagctagcggtgttctgcaggtctgtgcttccctctgtcctgagatttctgagttatataactcattccttagaatgggagaggagctgtcttcttgcccagttagttacctgattcagaagtgcctgccagcctgtgaggctgggaaataaactgtggatagacttgagttgggtgtatttacaaagcctggacatgcactggcaggagaactgagtgccccaggctccccacacctacaccacaggccctgctcagttgttcagggttcactcgtccacggtgagtcgccggagggtcagggaggactcacagagaacagggtgagtgccctacacccttcagcttgccagttctgcagtccccacccttccggtctggatgcccagctgtgtgtgtgtgtgtcaggtggggtcagctgggcagaaaggtggaccccagggtcggtgttgccgcatcactgcatgcactgtggggtcccaggggccctatgggtataggaaggaatgaaatgtgagcacttgggaatctcagcacactctgctgctcacctgctaccaggctttctggttccccagggaaccctgggccagcttgttgctgtcctcttttagcgatgggaaataagagtatgagagacagtgttatcctgtttacaatcagtggtgaagtccgtggttaagaccaggttacaactcctctatgcttcgcttcttatcttgactctgtgtgaaattaggaaaagcatatttactgttatagttttgtagctggaaaatgaaaatataaaagtctattttttataaactacaaaatgtaaaacaacagactcagtatggctggtgggtacagagaagacaaagtggctcctcacggggttgacaggagtctcgagacttttatcaaaaaaggccagaagttggttgtcatttttgagacactgggccctagaccctgacgtttccgttggaaggaggagcccccagctgttcccgctgatggttcaacctgtccgccaaaagcagccaaaatgctctccccacggagtgcccacttggagaaaaaccccactggtgactcaccttctggacatgtggggcaatcagggcccggtggaggcagctgctcctggctttccctggtgggccctccctcgacccccgcccaggccctctcctgccttccccagaccccaatgtgccaagcagtcaagtgaaaatcaaatcctctgaggcagaaagacacagctgtgtgtttacagccactgattcagatccaaatcgcgtaccctgccagtctctagcaaggcaggctgggggcaaagtgtgtgtatgccaagcagggatctatttcgggaggtgacctgcaggccttcgccatgacagtgccttcctcccacccactctcaggaaaggtgctctcactttacaagcggctgatggggttgtggggtctcggcatgcttgtcacttgtgcagtcagaccccagtgccatcctcgtgcagccacatgggaactgtgtgggctcccacctgcctagtaagaaggcagagagtgaaggggagtgcagggccccccgcaggataaacagcgggaaggccgaccactcagaagacaggatgcccgcctctgcctaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagtaagacccccccccgacccatggaagtccccccaaaatgagctcctggtggaaacaacaggggatgcttcccccttttaaaatagtgatgagtgtccctggtttgagttgagttaggaaagcatgacattttggaaggaggccaggatacctgtccataggtaggaatagcctgtaagatgttgccctcctgcagtgtggctaaatgggacactgccgggggtgggactcagagcagtgggatttttagttttgtcatgtttgcccaaaggtggatgagagaaagacccttgggtgtttgcttagtggcttcccaatgggtgggaaggtgagacggggttggaagcatggagccaccccagcagtggcagggccacagggcagcggttcttccatgccccctaatcatggccacattgtatcagcctgagcatgagcaacagcaccatggccacatacgggaatgggcctcattggtgtaatatttggcagattctctccacaccccccgtggcggtctggcttactgttaagaagggtaaccttaaaaaatacatttcccactccagaaaatactcatatgtggcctgttagcagcacaagaagggtgaaagcaatgcccattcctgcctccctccccctgctcacctccacgtccctgtttgcccctttgtaggtgaagtgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgcgcgcgtgtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcagctttaggctatataacaaaagtgggaaaggaaaagtgttccattgctttttgttgctctaagcaatattaagtcttggttctaagcccccacattatcaggaactttaacatctagagacaattgagagagaagagctagagagagaaagtgaccctggaagccacgtcggaagaggctggagtaaaaatgtctagccccccagcagacttgatggccaccgtgagctctttgcatttgtcttcaagagtggacacttccgggttgctccagagagcaaggctagaacaaatggctagaagatagataggtagatactaaaaatattctaacaataacagaatattccaacaatagactatgtcccctcaaagggcaacgagctccatgtctagccgtttagaagctgaatggccaaggatagtgcagagtaggtttctacaccagatcccatgatcttttgcaactggaattctatgctgccccaaatacttgttaaatggatccgactgcatttcattctgtggtttataaataagtcctggaaaaggagaatgaattataaggaaggagtttgctgagattggaggagagggatctgaaagactcaggactagactccgccttgagggagaaaaagccacaagatgacacactcaaagcaagggaaaccgtcaggaagtggaattactgcccttcacatgtcatccttgccttcttttctgttttttgtttttttttttggcatttgctgccgcagcagctgagctctgggcaacagggctctctctcccgaatgtctgaaaggaggtcagcaagtggaggacacaggcgcccactggcacagggcattggcaaccatcgtgcagtgagccccagcacagccagggtggccatgtgcgtggggcgtcctggcccaaggttgaagaaaactcatcctgtcatagttcccatccggaaagggtgttttgttgaaagcaaaaaggatcataaagtcatttgccttttacccaatgccagttccagattccaggtaaatgagctaacatcaaaaacacctcagccggctgggcgtggtggctcacatctgtaatccgagcactttgggaggccgagacaggcagatcacctgaggtcaggcgttcaagaccagcctggtcaacgtggtgaaaccccgtctctactaaaaatacaaaaatgagccaggtgtggtggcacatgcctataatcccagctactcgggaggctgaggcaggaggatcactagaacaagggaggcggaggttgcagtgagccaagcttgcaccacctcactccagcctgggcgacagagcaaaactccatccccatcccacaaaaaaccccccagagacctcggactgaggagaaactatgcccccaccctggcttccctcctctagggccctgccagggggacttgtcctcagcccagctcagggaaagggaagggttcccatgtcacattctttccagctgtcctaagaaccaccccgattgccgatgacactccctcctctcttgggcttcaccagggctgctttcaactcatcgtgggattgtgtaattatggtgattacagcttgtgacttttttcctctccatcttttgctttcaaattctttgaggcctctcattaaacatggcgatcccggtaaagtcagcaaagttttaataagacactttttacagctaaagaaagcccagtcagggttgattgctactatgttctctcagatactccattaaaactctatcaggtgcagttggtgcctaggtataagaggtgggggagagggaaggcagggaggcagagggcacctgtacttagtgacagggctggagaaccattccacaccatgcccctggctttttttgtttgcactaagcaccaagtacatctgagcccccgtgcctaacaggaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaatcactagcctttgtgagtcatcacaatccggtggttttacacctgatggaggttttacacctgatggaggtttccttggtagtgattcagcttcacatctcattcttggctaatctttaatcatagcttgcttgcttgctttttgttgttgttttggtttggtttttgggggggtgttttttttgagacagagcctcgctttgttgcctaggctggagtgcagtggcgcaatctcagctcactgcaacctccacctcccaggtttaagcgattctcctgcctcagcctcctgagtagttgggattacaggcctgcaccaccacactcaactaatttttgtactcttagtagagacggagtttcaccatgtcagccaggctggtctcgaactcctggcctcaagtgatctgcacacctcggcctcccaaagtgctggagttacaagtgtgagccaccgtgcccagctcatagctttcttgaatagttatcatagctgtaggacatcatgagaaggaccatcaaggagtgtggcttgtgtgtgtgagccccgtgacccacccttcagcaggttcatccaggttcccctcatttctatattccctggggactacacagatgcccgcacagtgaagtgcatcttgctccagcaggactgtgtttctgagaggtccctgattggctgctcgtggctgaccgtcccataccaaccagactgccttttaccctgcaggtagccagttacctcactacctgtgtctcaaaagagcaaggagctggattgtgactgagcagcaccaaccacctggagttaaatgtcaaaaacgtggcagggacatttcccccaactgcattcccatccactactgaaggtggcctgctcgtgtgaccccttgagaacaacggtccctttagtacccaccagaatgcagagaagtaagctaagttcgagacaggcaaccccagctgaatccctttttctccacctgatattatgtgaccctgggcaagtcacttgcatgtctgacaggtacaacaaagcccactgcacagggtagatgttggcattcaatgaggatgtgatcacaagagctgccatttattgggagctcacactcacagtgttggactgtgtcatgctggctttgcctgggatggactttggttctacttcagctccatcacttagttgtttgaattgcacagcttctctaagcctcagtttcctcatccataaaagggagataagagtaaataagtaggaataaaatgcataacgtccttagcacactgtgtgcagtgcgtgtgcttaacaggtgtagctcttagaatcagtttcatcattatgatattatttgcagctcatacttaggctgcgcttattaccttatttaatttccaacaatattctgcaagataggcatcattatatacatcttgtggttgagggtgggtacgtgggtatctcctatatgacagtctgcacaaggtgcatgtattacagagatcagctcatggtaactactcaataaatggcagctatgattgttggcttatttttaaagtcaactcagagagttagtttttctgcatttcctggaaatgaagggactgtggtgcccagcaggccagcttctgttctatggtcgatttcctggggcccctaagcacttcccgggaagctgtgggaactggggggcttgtcagcctgtaaggtgctgggaggtggggagggccaccaggcaaatggtgcacgtgttgtggggatctggcatttggccgcctactgagttgaaggactcgaaggtgcctcctgctaccagagacagataaggaatgggtctacccaagataagaagatgaaatccactcctccaaatgtagccctccatgtgacagaaacactcacctctcagctgtctgcttgcctggagccaccctgagcaatgcaacctcaacaagtccagttgctccgtcagtccaataaacagaggtttctcttttttaaccacttattccaaagcgaggtagtggaggagtcagaagcacgtggcaggggatgctttgaaattccttgataaaccggacccctggggtgggcactcctactgcctatagtaccgacagaaacagaagtggagaagttgtttatttccaatgaggtcaataaatgcctttttcatgggggagaattccatttttatatatgtattttaaggtgaatgctttaagtttgcagtatttgtcagagtggcatcttaggagctgatagaaaactctacagccaaacaagcgattgcctgtgcaccttgcatgagatgcttctgtaagtgcctgtggtctcaacatgcacatgaacgcatgcactggtgtatgcacatgtgcacaggtgtatacacaggtgcatgtgccgcctgcctgatgttcgcctctgtgttcagtgtatggtgtgcatataaccataagctgcaaacctgcaagtatctctgttgcatggattgcatgccctctgcagctgtgtgtgtgtctgggcaggggctcctctaaagccacaggtcttcacagtttcagctggataagttattcttcacttcccttcctaaaaacacaattgcctagtgctgctggcgcagagtcagaatggccgctgcatttcacccccgaggtggcttccttccagcagtgggtgagtgatcccggcgttcgcacactctctaatctgtggaatccttctgcacagaaggtgttccaaaatccaaaagagatgatctgtttgtccatggcatcgtctctgcccaccactcctgttctcatgccctggttccagggacagtcggcagcacccatttcttggtgtctctgttttttctgcccattttttgtacccatagtttttctctcctaagaaacaaggagctgaggggtccagaaatgatgctgagatgagtcccttgtcccagaggcaatgtgcagataacatccttagatattgacccagtaactctcttctcctagtcccattccctagcagaacagggaatacccactacctttgaagatgcttctaaatccaataacagcatccttaggcttcatttcctggtgaaagcttccataactcttcctctgtgggccctgggccaaatcctgcaggaaacgtagcaatctcacatttctacacactacaccatcaggggagaaaaaagctgggaaaccgcccatcctctgtcccatggggaccaaaagcatctcagcagcacgtgaaaagagcctgtagggaaataaggttctctgtagctaagagttccaatgacctaagtttctgtccaggtatctcctgaaaacgctgcttagtctgttccctggtgtacttcctccggttaggaatccatgtctgataagtgcctgctaaattgcattcctgatagtggggaagaaagaaatgagccggccctctttgcatatgcatccaaatgggcatggacattcactgaattgttatgcttttgtggggggatgagaggtcagcaattctaggctccgccttttcagctggctaaaccaaggaccccaagaaatgtacgtgttttgggtgaacacatttgcaagagataagtgtcctcaggaggatggggtcagagtcctcataggtcctcaggagaatcacatactgccaaccaaataactttctcttgccgctttgtccacaatatcaagtaactaaattccagcttcactgtctcccgtagtcatagtcaagggttacttgaatttcctagttggaaaaaagtagcatcaacttgttgccaatagcaacacagccatgtccctgtttcctagagccttttggtctttgcctaatttggagtgaaccagagcttagatgccagagtccatttgggaaggaggaggagaagaggaacaggcgggcattaagtgggtcacaggaaggcatgccaccgagaggccttacaggcagaatgccaccctcattccactcctgaagccaccaagaatttcctgcaagctgagagaagaaagagcaacagggttgttccgtcagatgagaggagggagagaagagagagctggtgtgaaaagggggcatttccaccacacagggatgcagagtagcagggaaaatggagatgcacaacttggacgcgagaccggggagtctggacctggcattctgccactcatgtagggctcagctgctgagtccttgtctctcccaccatccctacccagctccggatttgtccctgcacagctggggggccatggagaaaggtcccccatcactcagcaaaactgacaggcagaagaaagtgatgagcatggtgaggccagggtcagagatgccaggaacaccagcagggagggcttcctccacctggctgggcaccccgaattaggcacttggcctagaatgatttaaagtggggttggttttcattagagtaaggccaccctgcctgccccaccttagaaagggaaacatcacacctgctcctgtcctccctggggcatttgccatgtgtgttcctagaggcatcagcatcagtaacacagggccacaaacagaacggtgggttcacccagcctgtccagcagctaccacctgaaatctacatgcaccaagccatggtgacctgcaccccagctcaatgcagtaaccaaaagccccttttgccaggcttgtcagccagcagatggcacctcctttctctcaggatttccaaatgggatgaggggaagccgcttcgcagcatagaacctgcctgagataagctcaagcatgctcaagaacttaagttcttttctcagggaagttgagaaaatcaccctgcattgcccagagaggttgcccagtacgggttgggcacaggggactccttcatccctgagtgtttccatctgcctccttccttgagagtgacagccatgtgcaaagtaagaggggcatgggtcgtgaaggccgaccaactcagctttgccactgactagccatgcactcccaggcaagttactcaaactccgtttgagtctgtttccttgttcgtttagtggagtttatagaaatgcctaactggcaagcatgttgtggacataagtaagtgcgggtgcttgtaaaatgcctcgcatgcttgacagacacacaatagttgctcaatggtccatcagcaggtggctgtttgttagtaactgtcctcacagctacctgtgtacctagtgggggaccattcccaccatgccactgtcaaggcctgagtgatttgaagaacaaggcacttgaggagagagggtccatgagctacccgtgccattccatcaaacaggcccatgggagatcaggggataggtgggtccttttacatttaatccagataggagaactggcaactcttcttttgtagattcaaaaactttttaaaatattttaaagcactggtagttgccaattatattagtccattttcacaatgctataaagaaatacctgagactgggtaatttctaatgaaaagaggtttaattgactcacagttccacatggctggggaagcctcaggaaacttacaatcatggtggaaagggaagcagtcttacttggcagcaggcaagagagagcgagtgtgtattaacacttaaaaaaccatcggatctcatgagaactcactccctatcacgagaatagcatgggggaaaccacccccatgatccaatcacctcccactagttcccgctctcaacacatggggattatagggattacaattcgaagtgagatttgggttcagacccagagccaaaccatatcaccaatacaggatagagtaaggtgtctgagcctactagtggtcccagtgacattctgtgggaattgctttcagaagacgtgactgctgggtacctcctccatccccagtgtttaccaggcagagcctgagtgtttacaccacacacagcctgagtctttataccactgtacatgagaaggtaggggtcgggggggcggggtggggggtgctgttgcaagaaaaaaaaatccattacgtttattttgatcaaatttattattttttaaacaggttcagttttaagtattcatgaatgtaccatttattaattctttaatcagtgaacgtctcttttttgattaattcacttttcatctatcccttgacttttttaaaaaaattggggtattgttttatgtttgtgatatagcttcctatttaaaaggggtcaaataaaaaaatattttaaaaccacataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattctaggttaagtgtggattttcccaccatcccctgccagcgtttctccgacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttatcctcagcaagtctcccccaaccccaccccaggcctctaattccacacgtatacatcctttatgaacttgagcaccatctattcaaaggtgaccttcaggctccttgagagcacgactcatctctctctggggcctccacttcttgcctgctaagttgcatggtgagctgtattcaacgaaacacgatttttcatgagcagggatggaaaatgcctgtgtgtcacaccaaagggatccgtttgcatcaatggaggctagaaatagtgttccacattagttctgttgcgagttcgaattccccaacagaggaatccaggttcctcctgtactggagggggaagcattgaatttctccaaacccagggatgggcccagcaactgaagaagggtaaggagtgggaaattccaaggcatagatgtcatagctgggacttttttttgtcctaattttttttttcttttgagatataattatgcacggtaaaatgaacagacctgaagtacatggctcaatgaatttgacaagtgtatgcacccgtgtaacgtataccccatcaccctagaaggctccttcatgtccctttccaatcaatttcatccttctcccccaggggcaaccgtggttgatttctttcccccataatagcctggattttgatttggcagacttgagatctgtaacttcggtcttagttcatctgagcagatcagcaaaagaatctcatcagaagctcagatgtctttactctcttagcattgaaaaagatcctccctgagccgctagtgcttggctctgctgtcccccagtatgccccaatctgacccccagggctactctctgagccacagccctcctcccagccaaagaaagagtttagcatcagtctcccaggtaagtaagtggcaaaagctcttggtaacccagatagtgcatgctttgttgattaatatgtggaagtgcaatgcacagagccacagcatgtcaagcagcatgttgatttttctcactgcacaaaagggggctattccttttgtgtgtttcctttcagaaaacaaaggattccatgaccaccttcttccaggctcctagccatcaagatggccacagagctgaaatgattaatcagagcggagggtgggaattgaatgtgtgggtgttagtgaacccagcactgagcccatggtccatgaaattgaaggatcccaaattctactggattacactttgccaaatgtctcaaaggtgaaaagcactttgtcggtatgcaaagctttggtgtctctggaatgtaccttctgcagctcagttcttaatcactgtatattttttcacttggacaaaggctgcctgctaatagcattttcaaccatcctcagctgcttcgctcagctacgccaaggcctcgggctgagctggctgcggtttcctggcaccatgatccattcccaactgaccaacactgaggaacattacacactcacaccctgaaaaaaacctgcttcctctgtaactatgcaaatgccagacacaggcaggcagaattaccattccccttctgaagtggttccttcaggatcatccaaactggagacagagatgagagtaaagagacggggcagtgccctggagggtacaggcaggagctcccctctctctgggcacagcggattcctcgggagcttcctgcaagcctataggggcatgcactttggggcagctcatctctgaacacaggtagcctctactatcagatttcactttgatcactgaaaactacaggagtctcagctcttcagaagggaagcagctgctgagcaagtgtgattgcagtatttcttccccaaagccccgggccaggcatctacccatgcccgcatcctgcatgattaaccgccttccagtctgagcctgccctcactcacgcgggaggtcactgggtagcgagtagattgcagctgggctgagctgcctctcaagccgacctgaaccctcatgacctccatctttagcagcaagctggcatttggtaaatgcgcgaaagcaggagtggggagagggagacaaaaatgccaagcagcaccgcctgggttgctgagaggttgggaacaatcccaagggtggcccctaagctggtcagctgcaccatcctaccctgaaatcctgggaaataaaagcagtcgggggaagcgaggagcgggcagtgacaggctggccacaggtccttggagtcagagcggtgaggctgagctccaggatttagtcaggaagagaataattagcaccttcaagcccagcccagcccagcccattctgtagaaaggggaagggttgagggtatggaagcctcagggccaaattcacctaaaacaaatagacacataatcctccagaaatagaatctccaacctccctcaacccacagtcccctctccagccaaaataaccttgttaataggaatgaggctgcagtgaaggtttgggcaactggtaaacctcacctcctttgtctctgggctttgaatgtactcattggcaacagactcttattcagaagcttgagtgattttttttttcccatccaccagctaaatgagagccccaaacgctgtggatagcaaactcagaacatatatatttgggtacataatgtgtgatttgtggccctggcgaaggagggatgggaggaggaggaggacctgatattggtgtgtggtggttatcacagcaataagtggcacctaaaaggagagcaaacttcctttgtgcctttcataggacagggatggacataggtaaccgggggtaggggaggtttgtaagagctctcacacaaggaggcccctaggctcagcagccccgtgtttccccagcaaggatgccccacacccccatgtttcctgccttcaggcctgccccaggaaggcacattcccgagtgacaaatgcctcacactctatgtaagaaagggcactcaaggagagtcaccgctgggtgtgtgccacagaacccggggctggggggagcccttgaaggtcagcctctgccttctaagagctattgttgtacctaacctggtctagacaaaggagtagtcattcttagtgattttcaaagactgacaccataaccctcttggattttttaaaaatctgattaaaaactccttagccaagtataaatgtatcctgctgcaggctaagtttagtgcacttgaagattcagataaggttgctgatggggtgattttgtggacgtgtgtgtgtgtgtgtgtgtgtgtgtgtgtgtgtgtgtgtgtttaagatggggagaaaaaatgaaaagttttgtctcactagtgaaaatggggagtgaaagcaatggggaggaaaaaggtcaaggagaggtagggaaaggcagactttctgacagctcctgagggcaatttcatttttggacaaactcccatctatagcaccagaattctcaaagtcaggctggccatgcctctccatggagatctaagccagatgccacattgtcctgtatccagcaaatccacagcccgtgttgtttattagataaacccgttatccatcaattcatcaatcagcaggtttattgaggaccctaccaggcttcacaaacctgatcaattttttaaattacatctagcttacacgcagccaagcccagtaaacaagacgagccctcacaccccacttggaaatgaacatgaggaatcgctggcccttgcaatctcacggccaaacactgcagccccatgctgacgagctatcacgtgctgcccttcacagatggcggtggtgtcgctgacccactgtcaataatatgggtttggagtgctttcccagacacagtgatcaatctgcctgggtctagccatactgtcctctaaagccctgtgcaatgatgcggatttctaaagagggtgagctggagaacgggcacacactatgtaagggcaataagcaaagcgacggagcctcgctcgtgcccctcaccctcctcctggtgcccagtcgcaactcccctcctagatcaggggcttctccgccatctctccagggcacatacacaacgggactctcctggcacctctatggctgatgcaccaggcctcatgatccagttcactgttttagtttttgagaagaactgccacatgggttatagttgaagggcttgtaggctttcctggtatggggtcatcaaactctgcctctgggtgccacagatgggaagccaagaacataggagacagcaggagtgcactgccctggggcctacagtggctctgagccccagcaaatgccccccactttcatggtcccagaactggtcatcaagaggactcaaggtctttgtgtctaccctgcattccaaacaggactctgccttcttaagactagttcattcattagcttctgatcagccagatccttggccaccctctatttgagtcaagcccccgtccctgatctcagaacaccccaagtccaccttttcctcccccacgtgaacaaaatcaatttcagggcagcccgccggcattaaaaattgctctacctaaaggtttaaatacctggtttttggtaagtaaaattcccataccacaaaaagagtaccaacaacacaccctcataaggggaccctccaggactccctgaaccttccctggagccctggtttctccagctgtccaaagttaaggctcccatacacctagagatcaaatatcaagatggtcagttgggttggttggtcgtttggcctacatggctcatgcaacaattaattcacctgtctggctctctgtctctgtccctctgtgtgtgcgcctgtgcgtgcctctctgtcgctgtctctctgcagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatccc

SEQ ID NO: 749 - DNA, 629678 bp, Homo sapiens; identical to SEQ ID NO: 748

SEQ ID NO: 750 - DNA, 633454 bp, Homo sapiens
catttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcaggtagggcagctttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaagagaccgtgtttacagtcaccagcaggctgcgtaaagaagtggcccagtgagacagggaaagtgacccagaaaatttagttttgttcagaatgaaagctgctgtatttcatttttgtttcttaatttgacggagtaggaacgttattttccttctctgtcattgagaccagtagcatttctatgttacaaactgaagatatttggggtctcgtcggcttgggattatcaatgcttgggaggtgagttctgatcaatacctttaacaaccccaaagaaaaacgcaaaaataatcaagtttaggtaaaacttccactggactttctttccagggagggtgagagatggaagaactgggcttgtaagtatcaaaatggagttagagaatgagctacaagtttgtgtgtgtatggtctgtcaaaaagtgttaagactgaaaggaaactgttaggtttagttaaatgtgttgacaacacggctcttacatatcaattttcataggcaaataggtaattacatagagtgggaactgggactatggtgggaaactttctgtaagatgtatattctttattcttaatttatcactttttcaatgggtgggactactctgtgaaggaaagtagagggctgagggacatttggtgagactcttgagagagaaacctttgcaagccaaatctcgcatgctatagatgataaattctaagttctttgatattgtaccactcttaagctaaattgtcctgtaaatatgatctcatgcaccataaactatatatatgtagagagagtctattcccaataactcatcctttcctgaaagagtctgcaagttctataaatgtcagctgttgggaggtattgtgatgaaggagagaggccaccagtgtttccttttatatatttattctggcagatcttaactttacttctgattttctttaaggaatttcagttaacattcactgaatttatattgctgagagtttcagtaaaacaagactagattttctttgaagcaataaattcatcttatcaagtgaaacattatgacaatgcttttgtggcagaaatgtttatttaaatgagtccattttaattatttatttatttttgacttgcagaataagatctgcaacatagatgtttttgaagtaagtagacgtttcttgagaaagaaaaataaatttaggttactgtggacaatttgccagtaattttggatgtctctttgtctacagggacataattttgtgtgaaagtagaatcattccatttcttatgtctctcatcttctcccatgcattttatcccctgaactcctaagactttgccaggaattgctgaacattctgtttcgtgccaggggttaaatatcaggggatggaataaggagctgtgtgtcacataaacatttttcaaaaggatgctgtcagagatctcaataccgggattaatttttcctttagctttgcagttagcttgtcttaattggtattgctctgaacctaggaatgcatttaacctcttcattttcagtttccagctggaaggaatatatttaccaaatttcatcttctttgtaacatatggcatgatataaataattactatacacacactatcctgctgtaaggaaagaaatagaattacaaaatcaactttcgtgttgagtgatatggatataatatttcaaaaaacaattttaacttttcccctgattccaaaagtaatatttagctattgaaacagttcaggaaaatacaaagaaaaaaataaaggttatccataatctgctagggagagggagccactgttaacatatctttaactgtatattcttccaaatattattctagtcaattatttctacccagtccccctcccccacacatttttataaatataaaatatagcttggaaatataacttggaaatgtgttaaaggcttgggaatttactgcttgtttacagaatgattttgatcagatattagtttttactggtggtccttattttcaaaaagagtaggttctttctttttctgttctttgaaaacaagtgtttgcactttgggctggtaatgcttggggcttccttttgaatttagggattaaagcatcagaaaagaagtagaaaggtcattggccattgtgggtgggagacctgagttctggttgcagttactccaacttctcctgtggcctctgggcctctgtttccctaaagggcaaaaggtacttttagatttaactaattaagctaatgacgtatttattgctttgacatgagaatgatctttgaagagggcttattcaaacacagaaacacctgggggtcatcctgggagtctctgattgattctgtctgagatggggcccgagaaggtacatatctaacaagtccctggatgatgctgactgctggtttggtgacagtgaaaactagagggttaagtgtactagggttctcttagagggacagaactaataggatatatatatatatatatatatatatgtacatatatatcatatatacatatatgctatatatatgctatacatgatatatatacatatgatatatgtacatataccatatatctataaaggggagtttattaagtattaacttacatggtcccaaggtcccacaataggctggctgtaagctgaggagcaaggagagccagtccaagtctcaaaactaaagaaattggagtcagatgtttgagggcaggaagcatccagcatgggagaaagatgtagggtgggaggctaggctcatttctccttttcatgtttttctgcctcctttatattcgctggaagctgattaggttgtgcccaccagattaagggtggatctgccttccacagcccactgacacaaatgtttaatctcttttgggcaacacccacacggacacacccaggatcaatactctgtatctctcaatgcaatcaaggtgacactcagtattaaccatcaaaagcccaccccttgtcaacttgaacccatacatatctcctgagatcatacataatcttcaaataaagacaataatgaggtcaaaattgtgcataacataatacaactatcctttgtacaaccagaaatgcaccaatccccaatgcaaatactattacataaagttaacaatacttacatgctgttgtgaagtcaataaatcttatgtcacatgataaaggaaaaggaaatgaagatattttcttagtatgagtgtatatatacacaaacatgtttttaacaaaagaaggaggaaatactcttgacaattacagtctgtttctgcagctggtcacatggtcgtagctggtattgatgactaccttcttctacccattcagtattccttttgcctacagcaagcacctcagcaggttcttttccctggtggagtgacccaaacctttattcctgaaggatctggaccatttgtagtcccgcctggattgggctgttgtagtttcctgttgaccttaatcacagggcatggtaatactgagagatgccctaatggatttcctgtgttccatatgtagtcttccttacctctgctgtggagtagtagactgatttcctcttgatagtccaggtcaatcatgccagccaacacagtaattttcttcttagcctgttgactgaaagataggagtatcccaaactgtccaggtggcaatcttaacttccagtttaatggaatcgttgtgtttcctggtggcagtgttcctccctctggaactaagatctctaggccagcagaaggtaatgtcttgggaacaggaagcaaaaattttgctagtggatcagtaggggtgatggtgagtggtgccacttccacttccgccccttgattcctggacctgtgaatcctggctataggagaaacagtaccatatattggatgctgattcagagcatacacggccctctggagaactctgccccagccctgcaaagtattgtcacctagttggcattgtaattgtgacttcgaaaggccattccaccattctatcaatataactgcttcaggatgatggggagcatggtaagaccagtgaattccatgagcatgaacccactgccacacttctttggccataaagtgagtgccttggtcagagacaatgctgcatggaataccacgatggtggataaggcattccgtgagtccacagatggtagtcttggcagaagcattgtgtgcaggataggcaaacccatatccggagtaaatgtctattccagtgaggacaaacctctgccctttccatgatggaagaagtccagtataatcaacctgccaccaggtagctggctgatcaccctgagggatagtgccatatggaggggtcagtgttggtctctgctgctggcaatttgggcactcagcagtgatcatagccaggtcagccttggtgagtggaagtccgtgttgctgagcccatgcataacctccatccctgccaccatggccactttgttcatgggcccattgggtggtgacgggtggctggggaaagaggctgagtggtgtccacagaacaggtcatcctattcacctgattattaaactcctcctctgctgaggtcacccgttggtgagcacttacatgggatacagatagcttcacagtttttgaccactcagaaaggtccatccacataactttttcccaaatttctttgtcaccaatttttcaatcatgcttcttccaagtccctgaccatccagccaagccattggctacagcccatgaattgatatataatcgcatattgggccatttctccttccatgcaaagtgcacagctaggtgcactgcttgaagttctgcccactgggaagatttcccttcacctctgtccttcagagatgtcctagaaaaggcctgtagtgctgcagctgtccacttttgggtggtgcctgcatatcgtgcagaaccatctgtgaacaggccctagtcttctcctcctctgtcaactgatgatagggaactccccatgaggccgtgggtgcaggctaggggagagaaggcagggtggcaggagtggagaccatgggcacttgagccacttcctcatgtaacttacttgtgccttcaggacttgcctgagtcagatcacgtatataccacttccatttgatgatgggatgctgctgtgcacaacccactttatggctagatgggtcagaaagcacccagttcatgatagaaagttcaggttgcatggtgacttgatgacccagtcaaacgttcagtttccaccaaagcccagtaataggccaagagctgtctctcaaaaggagagtagttacctgcagaagatgacagggccttgctgcaaagtcctagagtactccactgtgattcacctatgggcgcctgccaaaggctccaaacagcatccctatctgccactgacaactcaagcaccattggatctgctggatcatatgtcccaagtggcagagcagcttgcatagcagcctggacctgttgcagaaccttctcctgttctggaccccactcaaaactggcagcctttcgggtcactcaataaatgggccggagtaacacacccaaatgaggaatgtgttgcctccaaaatccaaataggcccactaagtgttgtgcctctttcttggttgtaggaggggccaaatgcagcaacttatccttcaccttagaaggaatatctcaacaggccccacaccactggacccctagaaattttattggggtagaaggtccctgaattttagttggatttcttatcctctggcttgcaaatgtctcaccagtaagtccagtgtgtttgctacctcttgttctctggatccaatcagcataacgtcaatgtaatggaccagagtgatatcttgtggaagcaaaaagtgatcaaggtctctctgaataagattatgacacaaagccagagagttgatatacccctgaggtaggacagtaaaggtatattgctagccttgccagctgaaggcaaattgcttctagtgggccttatggacaggaatggagaaaaaggcatttgccaagtcaatggctgcataccaagtactaggagatgtgttaatttgctcaagcaatgaaaccacatctggtacagcagctgcaattggcatcaccacttggttaaacttatgataatccactatcattctccaagatgcatctgtcttctgcacaggccaaatgggagagtcaaatgggaatgtggtgggaatcaccatccctgcatctttcaagtccctgttggtggcactaatctcctcagtccctccaggcacatgatactgtttttgatttgctatttttctaggtagaggcatctctaatggcttccatttgggctttccccccataatagccgtcaccctactagtcagccaatgtgggggttctgccagctgctaagtatgcctatgccaattatgcattctggccctggggaaatgaccacaggataagtccagggacccactggacacactataagctggacctgagctaaaactccattaattatctgacttgcataagcccctagcttaaatggaggaccacaatgatgttttgggtcccctggaatcaatgtcagctcagagccagtgtccagtagtccccgaaatgtctgatcattttcctttcccgagtgcagttaccctggtaaaagaccagaggtctccttggggaaagatgagagaaagatctactgcataaattttcagtcatgtagtggagtccttccttaaggggacccagcctcccctttgtccaaagggttctgggtctgtaaactggctcaagtctggaaattgaatgaggagccgtgattctctgtttttataattcaaattagtcttttgtccattcaacctagaagttttctgtttgtgtaattgaagtaggaatgcagtaggcttcctatcaatttcacttttaggaacaccatgattaattagccaatgccagagctctacatgagtcagactattctgattgccactttgcctctgctgtccattatggtagttatgctcaccttgcctttgatggttgagtgctgccacttgacccctgccacctggtccctgccacctctggatccaattattcccattttgtagttgagtgactgtggttcccaccattagatctgacatacagagaatggcaattacagggctcttcaaagatgcaggtgctgccctcccaagtctattttgcaaggcattggtcaagggtatatcttctggaccctcccagctgggatgagtaggtctaaagggactaatccactccaccaccccaatctccctaagcctttggattccttcctgtacattaagccaagggagatcaggcatttccagctcactcacagtgggccgcctttaagagcttgtgtctatttttccacaatttcggctctttctctaggagataagactctcacttagtgtaatcttagcagatttgaggctcagtatctgcttctgaagctgggagacagaatccctgagttcatcattttctttcatcactttgtccgttgaacttaagagcagccaacctgcttcactgtgttccttggttctccacatatggtcaaatgtgctatgtacagagtcgctaaactccctgcctctcatgagcggtgaattaggagtgtcaaaggcatttattttgcataactctctaaacagtttctgccaaggactatcagtgttttctatactattagaagtagagtccttagcatttttgggtctaatcatattaagcagccaactccagaaaccccaaaaccaacgaaagaactccattcttaatattctgttcatctagaaccactcctggtaccaaaatctgtattaggtttctcttagagggatataactaataagatatatatgtcttagggagtttattaagtattcacttacacaatcacaaggtcccacaataggctatctgtaagctgaggagcaaggacagccagtccaagtcccaaaactgaagaacttggagtcagatgtttgagggcaggaagtatctagcatgggagaaagatgtaggctgggaggctaggctcctctctccttttcatgtttttctgcctgctttatattcgctggaagctgattagattgtgcccaccagattaagggtggatctgccttccccagcccaatgactcacatatttaatctcttttgggcaacacccacacagacacacccaggatcaatactccgtatccctcagtgcaatcaagttgacactcagtattaaccatcacagtaagctccttacaggccaaaatgcctgtttgacttttcacaggctttcacagtaagctccttacaggccaaaaagcctgtttgacttttctttgcagccatccatccagtgccccaaaatatacctgccaataggtgttcagtaagcattggttgaatcaatattagttttctcttatggaggaatatctttctggagtagtcaagacaaaagaataatcatccagaatttggaaacattaagcctgtaataagagttataatcattcatggaccacactacttcaaactgcaaagaaagcaaaaatgcttataagtaggcaattaaattgaacattaaacctaatgagttacattaaataataactaggaatacctgtttgagatgttacaaaccacaaagcctaccaaatacttcaccgttacctctctcaggtctggaagaggccatttattttctaccacatacacatatttcaaaaaatggaagtttcactattaattaccctaattaccaaggcagcagataaagcaagcaatctccttgctcccctctcctcatcccccatccctcccaccaagaaaaaaggctcattagaactctaccaccattctataagataggtcccaattttatgaatgaagaaatgtaaaactttagagaaagaaattaacctgcataaatccacaaagtgaagtagcagcatcagaagtaagatccaggcctcctgataccaaagggtgttgttctttaccacttccctctggtgacattgaatgtgtatatttgatagctgggagattctagctggctgaaataccccagttagaacttttgattatccttatgtggctaccttttatatagaaaatatatcttttccttctacttaggtgttagtaacatagggtggtaccaagaaccaccatttttatgtgtggtaacttcaaaaaaagtgtaaatatttggatatgaacaaaatagatcctcattcattaatagctcaggctatgcaaatgaattgtcttagaggctgtcttggcatttcacagtaatttggttaaactatcaaagagaaagccacctttaaatctgtccatggtagagttcactcattcactagtatctgcttgacccaagaacctattttcttgcacacatggaagcatgcattctacaaagccagctgaggtgaggtcccctgcatgaatgagagctggtggtggcactcccttggaaataccccaggcacctgtgttgctctcatgaagacctggctagtctggagctcagacagagaactgctattatttgttcttaaaggagcacaacaggcattttaaaatcctgttaattgtgtttctgaaccttagttttctcgtctgtgaaagaataatttaaaaaataccctttgagtatgtgtgaccatgagaatagaggaccctgtatgaagtatggggcatagaaagcacagacacgtaagaagatgggactgtcacagcacagttcctgttttctaataatttttagagtgagtctgttgagaaataagtgtttcaggataatggttcctctttattttctgttcctgaggcattgctgtgttagtcaagcatttgatggactcccaagtctctgagaatcctgctccatagttctcacattgggatttgaggaggcttgtagaaagcaagtggcccacacatctaagtgggagaaggcagcgtgggcaagatctctgtggtagccaaagatgcctctgtttcctggaggcgaaaggccattaatcaccagcaggaagagaagtgaaaaaggagactgctgctgcattgatagggcttatgccagacacacagagcaagcccatgttttttctctgcatccttgggatttcttacagtgcttggcacatagtaggagtttggtaaatgtttgctgagttattgagttgcagagtgacagctgtgggtggaggaggaaggatgggctagtattggtaggaattcatggactagtgggggtgcatggattggtatgagtgtggatgcaaggtgcacgtggttatagccttcattcttattgcttgcttgattttgcctggcaagatccacttcatatccatgatatagtgagactgtcatcctagtttcacattattgtgtgtctattccattgggctttggtcggtttggcttttttgttttgttttataatttatgtttgtaattttatctccacctctagcacaagaccaatacacatagtaaatgcttgataaaaattcgttgcctaaacaaaaacttgctcagcctacaaaactatgggtccgtcatatggttgtgggctgatcttacaaaataacaatcagcatttgttaagctttttgcaaatcaaagtcctttaagagatgttgggtggtattatgcccattttatagatgaggaaaccgagtggaaacgaggttcagtcacttgccctaagtcagatagtcattgaggagccaagatttaaactcagatcttttctgaccccaaagtccttgtgctgttttatatagcacaaggtggggaataaacagagaccctacccttgagatcatttcagttgtattggagagatgataggaataaatagaaaattagcaataaaagatgttaaatgatagtttaggaaaaaatgcaggggattttgtaagtcagatttggtagcaaatagatgatgaagacagtaagcacattatagtttagttcagagacagcattttatcatcagatctggaagagacaggcttcaggaaataggaataaactttaaaggtgcaaaaagggataatggcaaagttttcagatgaaaggtgttaataatacagtcacgtgtcacttaatgaccaggatacatttggagaaatgtatcattaggtgattttgttgttgtgtgaacaccctagagtgtacttacacaacctagatggtatagcctactgtacacctaggccatgtggtatagtgctcctaggctacaaactgtgcagcatgttactgtactgaatactgtaggcaattgtagcgcagtggtgttttgtacttaaatatatctaaacatggaaaagatacagtaacaatatggtgttataatctcatgggacccccttcatgtatgtggtccatcactgacttgtggtgcatgactgtaattggttattaaaacaattgtttgatttcagagtaagggctaatataaactccttatagttaaagccatctcagaccaccctagctaaaataataactcctgccccttctcattgctcttcattgtcttacttgccctatttttgatcacagctttatcaccatgacattgcattatatgtacttatatattgtctgtctccctctgctagaatatacattccataaaagcagggactcttttatttcctgttgtagattcagcatctgtcacagattctgattcatactaattgtttaagaactatttgtgaaatgaaggaagaaaatgcattttaaaaatgagttgcaaactcaaacactcaatagaccagttaggtaaaggaaatgagggaagcaagtgaggtttcttccacaatggtaacaagttgtaatttttacaaatcaaaagcatgttttgtttgtacattacacagatagaaagtttttactcccagaaatacatttatatctatttttcttgaaatatggggtcatctgactcattgtcaagagagacctggataccaaataagatttccttttttctagaagcagaacagccatccacgtgtgatgatgaatggcacctgaccttggatctcagggttggggttgcattagggacaggtggagaatgtgtttaagcgagaagtatgtgctgctcagaaagccctgttgttgccaaattttaattcatttaaaaattattaaccaatttcaattagaaaaatattatgtatatctacactgcccaatccaagagaaacaccttttgagctggctgtattttatggtgtgacctctgtagaaaaaaaagattaaataacatatgcaatatattttctccttaaacttctatggaaatgctacagtgtttagattccaaatcaagcaggaagatgccattatattattttgctgaccatacatcctaatacaaagactgattcagcagctggtcaaaatagaaaggacgcattcacaaagaataaatatattgattacattttagacttttttttaggtgaagggactttcattttcaggatagcaggtagtttagggcttggctgttggtttctgccgatagccaggggtatgtgacaggagacaaagtagctgaactctcttgatctgcattcttcccagttgcagaatagggctgagaaattgtgattgctttgagatggttactgaaagagagtgtgtacctggaaacaatctctggtttagtcaactattaatggggttgcgggggcgggatgttccgtaccccaggtcacagctggcctggggtctctgctgctcctccccactccttgtcctgctggtccgtgtcagacagtgcatctatcttcctaccaaggactcatttccagataatgattaattggatatggctcctgtgttcaagaaacttaaaattctgaagaaggaaaacaaatggagagacggaatgtggtaagcaaggcctatatatggaaagttagggagagatgacttcctgctgagggatttcactgaagaggctaagtagatgaattggactttggaggacctagaggtctggggcctgcagaaatggggccaggggacagagatggcaagaatgtacttggggcatttcaatgtaaacaaaattatacaggtgatcaaatgcaaggaatgtgcaaagaatatttaataccccccatacagagtgaggtccttaaaaacctttctggcaggaggagtccgtgttgatgaacttaaaactttaatgaaaacaaggataggggaaacctaggtttaagcaaaactgttcaataagtatttgtcatatttactgaaagtaaaatgagaaaacaaaagtagattatgagtgacattttactcaccttatgttggtaagagcagtgtgccacagtgaatttccagttacttcttgctgtttttcaggctgtcagccccccttacagtgaaatgcttacaggtagttttgctttattacagttagtgtacaattcttatgcacaagggcactcctccatgccaggctcactatacaaatgttcaatgcctttcagtcagagaggctgactgctgactcctgggtctccctgtggctaaagggtaaagtggatagatacatcttggggtaaactttatttaacttagttggcatgactgatcaggaagtcctcagatacctcacccccatgcctagggtatttagtgtcatgccaaagcatatgctgccaattccaggttttcattttttggtttcctttaagctttcaaaagcttctctgcaaaaatcacttccgctgcctgccatctgccttaaaaccccctcccccacttaaaaaaaatctgtttctaatcccaagagtcttttttgttgttgttttcgagacagggtctcactctgttgcccaggctggattgcagtggcgtggtgttggctccctgcagccttgacctcccagactcaagtgatcctcccacctcagcctcccaagtagctgggactacaggcgtgtgccaccactctgagctaattttgtgtttattgtagagacagggtttcatcatattgcctagactggtgcgagattcttatattttctaattattcttaaaatgaccaattgactatcaaaaatgtatttggaaataggtataagttgaactttgcttattgggaattcttggttgggggagttttctgtagttgagattaccatgttgttgggtatatgaagatgaacagtgacggataaaactagaagtgcaagttgaggccagtgtgcgaaggaacttgaatgccatataatagtgttgatagtgatggggatttagtcttctctctgatgcagactaaacaaaaaaataccaataacccaactgaactgaagcaaaatccaagtatctcgagcagaaataaatttatctgaccacataatctgagaattcaggcttagctggatccagggacttagatgatgtggtcagcactcttactcaacaccttgtcttcttgacttcctccttctatggcacgagagaagaagaagatggtcactaatatttctaccctcacatcttttcaacagtcacctcacaggggaggaatcttctttcttccagcgtccttatctcagtctcagggaaggactttggtcctgattagtcacatgtctacgatggttcgatctgtgtgtctgataatgaggcatactctggccaggacagtccacagtggtaacagacacaacctctggctccttcatcatccctgcaattataaccctgccatgatgtcattttttgcatcactgtatgtgagagggctgcaatgccaccttgagaacccaatatgctgcatccttcctccagatctgcatttatttgcactattctttttcaaacatacagttctactgaagtataacatatttacagaaaagtattcaaatcattgttcaataaattttcaagcagtaaacacatccatgttatctctctgagatcaagaaagagaatattaccgttcttccagaaaccacctcatgggccctcccagtaagtacatatttcttttttcccattggtaactgctaagctgatttcctttctctctctctctcttttttttttttttttttttttttttaaagagatgaggtctcactgtgttgcccaggatggccaggaactcctaggctcaagcagtcctcccacttcagcctctcaagtagctaccactaacctgatttctaacactgtaactttctcttttttgaaacaaatgaaataaatatgaaatcatacatatatgcctgtacactttctttctagatccttatgcacaacattgtttgtgaaattcatctatgttgcaatgtgtagcagtagactatttttattactatatagtattctactttgtgatattccacaaactattcatctactgttgagggacatttgggatatttctaggttagacatatgaatagtgctgctatgaatatttttgtatgtgttttgtgacacacatatgaatgtgtttctgtttgatatacacacctaagactggattgctgggccatggggtgtgcatatgttcagctttattcgatccttacaaagagttttcttaagtggctgcaccaatttatattcctatcatcagttcatgagtgtttcagtttctttatatcattggtaagacttgagattgttaaatgtttgaattttagccattctggtgggtgcgtagtgatgtcttattatggcttcaatttgcatttttctggtgactgatgatgatgtgcctttttaatttttttttgccacttttatttgtcttttgcagtgcctattcaagcttattgcctattttaaattagatttttaatctttttctcattgagttgtagaaatcttcttttaaaaacaaatttttaatacaaatacttttgcctgtcatatgtatttaaaatatcttttcccggctctagtggtttgcctttcactctcttttgatgaattggagatctcactttgaatataatctaacttatcagtctctttctttatggttattgtttcctgtgcctacttaagaaattgttgcctaccctaaggctatgaagctactctgttttaatttatagaagctctatttttttttttttttgccttttagccttttatctttaggttgtaaaaatctacctgtggatgattgttgtttgtggtgtgataaaggcatccgtatttgttttgttttacttatggatatccaataaacccagcaccacttattgaaaaatctcttcatttctactactctgaaatgtcacctttgttatcagtcacatttgtggtctgtctctgtgttttctagtccattccatttttctatttctctaatataatattgataacgcactgtcttaattacgtgagctttataggaggtcttgatattcagtagtgtgcaccctctagtttgttcttatttaagaataacttctaaagaacaaagctggaggcatcactctacctgacttcaaactatactacaaagtgacagtcaccagaacagcatggtattggtacaaaaaacagacacatagaccaatggaacagaatagagatctcagaaataagactgcacatctacaaccatctcatcttccacagacatgacaaaaacaagcaatggggaaaggatttaataaatggtgctgggagacatggctagctatatgcagcaaactgaaactggacctcttccttacaccttatccaaagattaactcaagatggattaaagatgtaaagtaaaaccaaaaactataaaaaccctagaagaaaatctaggcaataccattcaggacataggcacaggcaaagatttcatgacaaaaacatcaaaagcaattgcaacaaaagcaaaaattgagaaatgagatataattaaggagcttctgcatagcaaaagaaactatcatcagagcgaacaggcagcctacagaatgggagagaatttttgcaacctatccacctgacaaagatctaatatccagagtctacaaggaacttaaatttatgagcaaaaaacaacccaattaaaaagtgggcaaaggacttgaacagacacttgtcaaaagaagacatttatgtggccagcaaacatgaaagaaaagattaacatcactgatcattagagaaatgcaaatcaaaaccacagtgagataccatctcacaccagtcagaatggtgattattaaaaattcaagaaacaacatgctggcgaggctgaggagagagagaaatgcttttacattgttggtgggagtgtaaattggatcaaccattgtggaagacagtgtggtgattcctcaaagacctagaggcagaaataccatttgacccagcaatcccattacagggtatcaacctaaaggaatataaatcattctgtgataaagatacatgcatgtatgtgttcattgcagcacttttcatgatagcaaatacatggaatcaacccaaatacccatcaataatagactggataaagaaaatatggtaatatacaccatagactactatgtggccataaaaaggaacgagatcatgtcctttgcagggtcgtggatggagcggaaatccattatccccagcaaacaaacgcaggagcagaaaaccaaacactgcatgttctcactcataagtgggaaccaaacaatgagaacctgtagagagagggaggggaaaaacacctgaggcctgttggggatggggggatggggagagggacagcatcaggaaaaatagctaatacatgctgggcttaatacttaggcgatgggttgataggtgcagcaaaccatcatggcacacgtttacctatgtaacaaacctgcacgtcctgcacatgtaccccagaacttaacataatatataattaaaaagaatagcttcattatttctaaccatttgcattactgtataaattttaaagtcatcttctgatgggattttgattgggattgcattaaatctctagcctaaattgggagtaaattaatgtttttacagtgttggctattttaatccattaatatggaatatcccttcctttatttagatctgtctctcacgtctgtcagcatttttgtatccctctatattgtaaaattattgcacatcttttaaatatatattcctagtatttgaaattattcgatgctattataaataatacctttaaaaatatatcattttctgattgttgctgatatacaaaaaatacaattgagttttatatattgaccttgtattcattgactttgctaaattcactgaatcctaatagttctgtgtattaggttggtgcaaaagtaattgcattcataaattattatgaatttccatgtacacagttaaattacttgtaaaagagttattacttttacctttctaattatcacgacttgtatttgtttttcttgcctgttgtataggctaagacctcaaatataatggtgaatagaagtggtgatagtgagcattcttgtctaatttccaatctcagtgggaaagttttccatgttttactattaaatattattaaatatttctgtaagtgttttacaaataccgtttatcagatcaagcaagcccccttacatttaaaattggccaagagtattttcatgaagaggtgttgaatttgattaaatgccttaaagccataattgcacagaatagcgggctcacctctgtacttcctttttctcttggatcatgatcccatgtgtcctcattgccttgggagctcttctttttataccatatctacctttctagattttcttgagggttggactgttacaagttagatcatcattgtaggaattggtactgtaaattcaaattgtactatttttgtctgccatctacacggtatgagtaaaactgtaaaacccccgagaacctattcaattgttatttctttgatctatattgcttttggctggtaagctttatgaaaagattttcttttgttaaattttgctatcttaagaggaaaagtctaccattgctgctacaaatggaggcattatggagtcattgaaagggtgcaccttatattacatttaaatgccatgttttacatataaacatactgattttacctgttcctttttaaaaaagaaagaaaacaatgaaatcccaaggaataaaactgacattctttaaaaaagaaaaagccaataggagtgcttttcttcttaggtcccctgggaacatgtcatcctcttcatctcttagtcatccacttcttgtgtataaaaattggcaacgcttctctgtcactcccacttcttctctagcagtgatacaatctttcatgcgaaataagagaataataaaatgttatttctgcagtcccaatagtcagtagtattagaaactataatcttggaacccatacttaacaaaatataagccctctcatgtgagaagagagggaagacccaagctctaaatgctgactcattgctaaccaggagggtggcattagaacgcaacttgaccttcccaggtcttagtgccatcctctgaaaaccaaaggcttggacttgttcaagggacagaaaaaattgtaatgtaaagggctaaatagtaaatattttgagttctgtgggccatacagtccctgttacaacaactcaattctgctgttgtggcacagaagtgatcatagacaataagtaaacaaatgggcatttatttataaaagtgtatttatggacacaaactcaaatttcatacaattttcatgtgtcataaaatactgttctttcaacttttttttcaagcatctaaaaatgtaaaaacaattcttagcaaagagatcatataaaaagaggtaacaggcttagatttgtcccatgggcccaagtttaccaacctttgagtcagttaaattgtcaagggctgttccagagctctgtgttaggcattcatatgctagccttttaaaaaatattttttttgtcctatgaacattattcaaaagggtctatttttttcttttagaccaattatgaataagaaaaatacaatatgttgtttttacctttattccttcatcagtgcttgttctttctttttagagatccaagtttctgacctgtataattttcctctgcctgaagaacttctttttgcatttcttgcatagcaggtttgctggtgataaatttcctcagtttttgcttgtctgtgaaagtctttattttttctccacttttgaaggataattgcactagatgtagaattctaagtgggcgtttttttttttttttttttccttcaacattttaagtatttcactccacactctggcttgcatggcttctgtaattcttatcctcattcttctataggtaaggaatctggcttcttttaagatttcctctttgtctttggttttctgcagtttgaatatgatatacctagatgtagtttttctttttttgggtgtttgtcctgattggtgtttactgacttttctggatctgtgatttattgtatgtcattaattttggaaagttctccgtcattattccttctaatatttcttctcctttctttcttctcttcttggaattctgattacatttatgttacagctttttatattgttctatagttcctgaatattctgctctggtttttttcctcccttaattctctctctctttttagtttggaaattcatgattgactttcaagctcatggagtcttaaaaaatttcttaaatttttaatttttatgggtacatatgtgtatacttatggggtacatgagatatcttgatacaggtatgcaatgcataataaccacatcatggaaaatagggtgtccatcccctcaagcatttctcctttgtgttacaatccaattacactcttttagttattttaaaatgtacaattgagttgttgttattgacattagtcaccctcttgtgctatcaaatggtaggtcttactcttcttggccatttgagtctgctgatgagcccatggaaagccttcttcatttgttacagtgtttttgatttttagcatttccttttcaaaggagttttaaaaaaatgtttccttctctctggtttcattaccatttactttctccattagaatccttaacatttttcatcatagttattttaaatttcctatctgttaatgacacagataattccaacatccgtgacatatctgagtctgattctgatgattgcttgtctcttcagaatgtgtttttcttacctttcaccatgcgttgtaattttttgttgaaagccagacatgatgtgttgggtcataggaactgaggtaggtaggcacttagtgtgaggttttacttaatctggctaggagttgggttgtgtttagtgtttgctgagctgtaggtgctagaggcttcaaatccccccaagggtccttgtttttgtctcctctcttgactttaggtttccctaactactattcctcagggacgctgtgtcttggaagtcttttatctgtaatccactgttacacctgagcccggctggtgtggtggtagggcatatgtgagcagtaatgttctattaaccatctaattaagagcaaggatggaataacttccctttggtaaatggtaacgttacaggaaaggggtcccaatccagaccccaagagagggttcttggatctcacgcaagaaataattcggggcaagtccgtagagtaaactgaaagcaagtttattaagaaagtagaggaattaaagaatggctactccatagatagagcagccctgagggcttctggttgcccatttttatggctatttcttgattatatgctaaacaaggggtggattattcttgactcccctttttaggccatatagggtaacttcctgatgttgccatggcatttataaactgtcatggcgctggtgggagtgtagcagtgaggacaaccagaggtcactctaatcaccatcttggttctggtgggtttcagctggcttctttagtacaccctgtttatcagcaaggtctttatgacctgtatcttatgccgacctccagtctcattctgtgacttagaatgcgtaactctctgggaatgcagcccagtaggtctcagcctcattttacccagcccctactcaagatggagttgctctggttcaaattcctctgacagaaaaactttcccccataagaaaaaggaagatggagaacatggtggcttcagtgagggtgtctgaagatgagggacttgccttctgctggcttccatttcttccatgaattttgaagtgagctcatcagctaagactatgtgttaaatatgagctgggaaaagatatgacatagccatctcagaaagggagaaacaagcttggtaggaaaacattttgggtttggcaggcagtgttgactattcatttaatgtttgtggccatgaatttaatgcagctagtcagcctggttgtgtgacttcctctccatcccaaagtgttcatctgtttggatgggagcttggggttggtggatagttgggttccatcagtgttggaatttggtaaggatagtgtgacacagaaagggggtgtattagtgttccctagagggacagaactaatagtgtgtgtgtgtgtgtgtgtgtgtgtgtatattctatttttatatatacaatagtatatatataacagtgtgtgtgtgtatatatatgtaggagtttattaagtattatcttacatgatcacaaggtcccacaagaggctgtctacaagcttgaggaagaaggagagccagtccgagtctcaaaactgaagaacttgtagtcccaagtttgagggcaggaagcatccagcaagggagaaagatgtaggctgggaggctaggtcagtctcaccttttcatgtttctctgactgctttatatttgctggcagctgattagattgtgcccaccagattaagggtgggtctgccttccccagcccacggacttaaatgttaatctcctttggcaacaccctcacagacacacccaggatcaatactttgcatccttcaatctaatcaagttgacactcagtattaaccatcacaaggggagatgcaggagtagagggtatgtgcaagggagtgattatgagtgagtataatgatggagccagtgtgaatagtgaaggtgaagcgaagggtaggaatggatagtaaaagtgctgtgtgttcaatggattaaatgtctaaataagtttgaagattgtttgcagtgaatgcagagtaagtaagtgagctgaacagaggaagggtggacagagtggaggatgcttgtagtgggatttgaggtgatgacaaagtttaggatgtggccatgtgagatagtgactcagaaggaaaaagcttcaggtgaggaaataaggaactgagaaactggcttttctggtaggtctttgactctgatgttaaagtcactgaaagtggtgaaggtgttagggaagcagaagaaaccctctgagaggcggaagctggagtcttcagggaatgagaaggcataagcaggagggaggtgaaaaacagcagtgaggatgagcagaaagtggcagagccagatggcctgagtgccacagagcagggatttgtgttggagggagggagggaaatcatttgaaggagcggtggagagccaggaggctgcctgccctactccctggtcttcagatatatgacgtgaggacagagggctgtaggagaggagaaggcaagtttccattaaggtcacagaaggttaaagttcagagaggagatggaaggacatagtgggcatactatttacagaaatgttgaaagggtgggatgagtctgtggggagtcggaggggttggggtttccagagcagcgtggagttcagagccctggtgagagaggatgactgggtagacctggctttccagcagagattgcagtaacaggactcccagggccagcatgccctgttacatggctatctttccacttctccctcctagcttaatttttagaaactttaacagatggaatgcaaaatttttatttttatttttacttcagagatcagtcctcaccctgtcgccctggctggagtgcagtggtgtgatcatagctcagtgtagcctccaactcctgggctcaagtgatcctcccacatcagcctcccgagtagctgagactacaggcaacgcaccaccatgcctggctaatttttgtatttttttgtagagattgggtcttgctatgttgcccaggctggtcttgaactcccaggtttaagcaatcctcatgcatgcatatatatatatatatgcagctttgataatttaattagtttagcctgtcaggcagctgtgatagtgtagagaacgttgtatttatttgtaagtcttaaggtaggattggaatggagaagtcaacttcactgaaaactagcaagtagaatgaaggaaacacagattagttgaggacctactatgttccaggctttgtgccaaacatctactttatgtaggtgatttcacaagatggacatgttggaaaaactgtgggcattggaatcagtcctgggtttgaattttagttgcttggctgacaaactgtgttactttgggcaagttacctgtgctcttcagtcttacttttctcatccatagcgtgggaataataacatccacctgttgtggttgctgtaatgagctgtgcaagaaattctaatcagcaggccgggctgagaaccactgctgcagagtgattagcatttgttccattttataggtgaagaaactaaggcccagtggggctaaatatgttgcttacggccacacagcacttaaatgatatagccaggattgaaagccagttttttttgaccccagaaccttgttgtatccatttcattgagtttttgccttaatacatgggaagctaaaggagcccccccattagcatgtctgcccaaacatcaggcagcatgggatgggaggaagggatcaagtgaagggaaggcaggctccatggaatctaggtcagcggtttccaaacctggctgtacttacaaatcatctggaaaatggttaatctgtaaatctccagggaccaccctaggcctattggatcagaacttctggagcatgggaaccgggagtatgtatatttagaatatctcccaggttattctgagactgctagcctagttccggtccttgggcaagtttttgggaaccactgaattctaatcgatgtcctaaaatgattaagtgattatatcccagtaaaatactgggtgtcttccagtgccaccaaaattggcctttaggggttgagtgctattgccgtactttaagatcttggtgcattacctgaaacggacactctgtctgtcattgaacatttgaacttcgaatatataggaaatgtcaagttggcatactctgctataacaggaagagtgatttgttatttagagctgttgttcttccttctttccccttgggattcctgcccactcagtcagattagagctatataaacaagctcgtactactgagctagcacacatcttgtaaattttttttcctgaagtgcttaacgttgctgatgtcagaaaaaaaaaatccattgggttttaatgggctgaggcaaacaatgagaatttgatataatatggaggagaggaaataacttcaacagaaattcttatttggcagcataaatattcaaactatattacagtcagagtttgattgcttctcctacatggcatttccctgaatagggttttgagggctgggcactaagagtggcaggcatgatgtttaaagcatttagttgcaagccatggtaatttcagtgacattgtagggtaattgtagttggttctcctcttagctctgtgtcaggatcacctgaggaggttgttggaccgctgaaggcttcatctctgatgcacgagtcagaacatctgagggtgggggttggggtgggattctccattgaatctgatgccagtggcctgggaatttcacttggccaaaccctggcttagaacaaggtcactggtcagtttcgatattcattctgtgctggggcatttccatgacttagtgtcttccctcttcaaaagcaaccctgcgtgatggaggggtctcatcttccaggcaaggagctggaaacgtagggtgggagagcccattgtcaaaggccacatagtagccttaatgaggctagagctgagatgtgattcccagtctgacttcaaagcccttccttttcctataccatcgaggcccttccttcctgctctgctcaacattgttagctgccgaaccctaggctttgcttgttccagaggggctggcattataaagtaaacagcaggcatttattgtaactgcaagttacagatgcagtgtcagtttggagtagacttgcaggcacaatcctgactttcaatgattcacgaatctgtttgtgtcacaggtgctcaattgtcctattatgcatagagcatccccttcactatattttcttccctcaccacatattccttcttacctaaattgcttatgaattccagaagtggattgctgagtccaggctggttcatatcaataaaccttggggaaaatctttatgtgtgatgctatacatgggtctttgttgatcaagagtcttctttattggccacttttaatggcttgttatccagatgaatcttctggaaggaggacactgcatcctggtggaattttatcagttccatcattcattcaaacatatttaagtaccttctatgtgccaggttctgctctaggtgccagggagagaggggtgaaccccaacgataaagtccctgcctatgaagaactgactttctagagaggaagtccctgatagacaagtaaacaaagtcccgcagattcagatagttgcgaatccctgttatctcactctccacacttggctgtctcccacttaatctttctgggatcagattatctttgtggcttttttctcttgactgtctagcacaaagctgagccgcttctggggcttcagatttctatgcctgtgtgtgtgcatagccttggctggaatggcaaactttgcctctcccaggcttctgctcatctgtcacctcctcctactctgtgccatcataattgagcaaccacatattacagtgtcctttctgtgaacacatctgttattcctaccggtctctgaacattttaaggagaggatctgtgtctgacttatctgtatatccccagggcctagcatggaaccttacaaaagtagatgctcagtatatttgctcaaagaataaatgatgagttccaaagaacctgagggtgggtggtgtggtataggaattccgtcatggggagggatgctgagtcagatgggggatgctccaccgcagtggttttgtgatttattctttgagacattgagtgctgtcatgaatagaggagatgggctgggatataggcagtattgacagagacacgtggcatggaacattctggtgagaacctttgaaggaaagttagaaatgtgaggttctgagggtctagctcagagctggaaggaactctaaggttgctggattttatagccaatgcccaactgaggtccagggaagctgtgtgtcctggttctgatagttggttagttgcaaaggagctaggggtggggtgataccaggactcctagttcagagggctttccactatgctggggctatggtgtgtgacagataacagattaaaggcacagagaggagaaggaacttgcctaagatcacacagctaggaagtggtggagcctggatttggacatggatctgtctaatgagaggcatcttgtaaccatcaagctgtattgtctcttcttgaagactgtgaaatgcaaggtcctagcccattttcagttttcctcttgggttagctgtgagtccatataggaaaataatattaacatgctttctttcttttggtatgcagttacatgttttcagaaaaatgttcacattcttcaaatgttaatattgaagcccctgggttgtttactgtgtgtatatatatgtatatataagtacaatgaagaacattctgtttttctctaccactaaatttaaacccatttctattgtactccatttaaaagaagtattttacatcatactataatgaatgaaaacctagtcctttaatttcacaagccccagctttaatagtcaatgaatttaattagaaaatctttacctatgtaggtttcacatccagttctctataacatctgttgacctatggactagaaagtatattattattttagaaatgattctttctagacacaggaaagctaaatagcttgtctgagtttcaaaacgagttaatagaggaaccaaaaatagaaacatttctactgaatacgaggcttactaaaattcttcacacagagactatctgcattcacttagtagtttccagtctagactctggaacatcagcctgttttaacacacacaaatgcttctgttggtgggagggggtggctgggcagagggaggccgggcagagggaggcctgacacgtttgtttctaggtcatttctaaccttgctattataatacagttttctagatagaagagaatgtgctcattaaagtgttcattttaaaataaagcgacagaaacttaaaacgtctctattacatggatacatgagtatatataaatgaactcaatttttgttttcatgctctgttgtattctgtattaaggcaaaggagtaggcaactaagtagttgtttaaaaataaaactgtgtgttgttcatttaattttaaaagccattggttagaatggtaatcagtgtttccatgtagtactatattcatagaaatcctgatattacagtgtatagagataatattatagaatgatgctctttacctctttatgtaatctaattttaaaaaacattgtaatttataaatagtgaagaaagcaggtagtgttattcgaatgggatattttcggcaattaaattcttagcataaattacaaattcctctctctcccattttccacccaaatttgtttttatggaatgacctttggtagcaacttgttttataataaaatgtttcctgaatttgtattttgaattgaaatggccttttctgtcacgtatggtatttataagagtttctttgatgaaaagcctctgaattttgtgcaaataacccaggcagcctcttagatgagggataacatttgtataggacttttatggctttatactctgctctcatactcagcttatttgacccttacctgcggggaacttggtggaattcacattttactgctgaggacaatgtagaggaaggtgccttggcatgactcagagcatatagcaggtgtttggtatgtttgttttaaagggaaattaacaaaagaaacccaaaagattcttgtacttgctcaaggtcacacaataaatatagtgtcataccaaggattgaacttccttcttcactcaaaacttccatatacttgttcttatctcactgttatcttttcaggcttttcaaaaaggccacattaaatatatttatttttcttaattgaggtgaaattcacataacacaaaattagccatcttaaagtgtataattcagtggcatttcatgctttcacagtgttctacagccatcacctctatcaaggcccctgaaggagaccctgtatccattaagcagtcacccattccatcctccctgcagctactggcagctaccaatctgtttcttgtctctgtggacttacctattctggatatttcataaaaatagactccagcaatatgtgacgttttgtgtctggctttttacacttagcgtgttttcacttagcatgttttcaaggttcatccacgttgtagtgtgtgtcagtactttatttctttttattgctcaatgatatcccattgtatggatatacacgttttatttatccattcatgcactgatagacatttgggttgtttcccccttttaactattgtgaatagtgctgctatgaacatttgtgtacaagtatttgatatttgttttcagttagtttgtgtatgtacttagaagtggaattgctagatcatatggtaattctgtgttcaacttttttgaggaaacactaagctgttttcagcagtgactgtgtcattttacattcctaccagcaatgtttgaggattttgatttccctgtatccttgccaagacttacttgaggttttttttttttaaattataataatcttaatgggtatgaagtggtatctccttgtggtctggattttgatttccctaataaaatattcatattttaatgcatagaattaatcagaaaatgagctttggcaaggtgaactcaacagcaaaatgattggcttcaactgtcttcaggagattatttaagactgccgtggctgggtgcggtggcgcacgcctgtaatgccagcagtttgggaggctgaggctggtgcatcacctaacgtcagaagtttgtgaccagcctgaccaacatggagaaaccctgtctctactaaaaatacaaaaatagctgggtgtggtggcacatgcctgtaatgccagctactcgggaggctgaggcaggagaatcacttaaacccgggaggcggaggtttcagagagctgagatcgcgtcattgcactctagcctgggcaataagagcgaaactctgtctcaaaaaaaaacaaaacaaaacactgctgtatattcactcctggggtgtgcgattctgagctgaaaatcaataacatgttgtttggggattagaagaatatttgtggatagtaagactgcaatcatcccctaactttaaaaaatgtatcatgtaatatcatgtttttgttcatggcatctgccaaaagttacttaattctttgcatttcaaagccctctttatataattccttcgtgacttaatggtttattcatttatttttgcagtgtgagtgaagacactcaggatggctcaaggatccggggatcaaagagcagtgggggttgctgacccagaggagagttctccaaacatgatcgtttactgcaaagtaaggcgcctggtcaagtgccgtgcgtgctgtccgtgtggactgttgtgttctgtgtagggctgataaaaagacaaatgttttctgcctaaactgccttactgataaatgcatattttcttctcacatcctctggttctctagttctaaaattcaaggaagttcatacttgagcacttggtatttaacacttgaaaaatattatgccatttagttttctttaaacccaaaggttgcctaagcaatgcagatgggaagacacattctccttcagtggaaaggccttagtgtaagatgtatgaactgaaagttcttcagactcgtagtatgtacaaaatctgggctgaatgctgtgggagatagagaggtatatttgtatgagatgcttacagttggtaggagacataagatgtacacaaataactgttatagagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatctctttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctattaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatcatgcttattaaattgcgataaagaaaaaaataggttaatgggactcagcaattagtgaaacatacagaataatagacattgagtcattgttactttcttaacccacccccaaactgggagaccccgtgccaggctggtaggaacatgggctttggagtgagacttaggttaaaatgccaactttaccactctttagcagtatgactgtaagttagttctttaacttccatgagccacaattttttcatctgtaaaaagaaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagaggaaataaatgataaaatctctaaatgttggtgctgttaataagttgtctagagcaaatttatacagtgagtttttttttaagacacaggaaaacaataaaaatatttttatattcttcagaggattgcaaattcatggattattaaagaataagaaatgcaaaggtcatgtaacccaaccacctttctactagaatgtttgtattatgtttacaggaaaaaaaaacttcctgcaggtttatgagaacttggtttttactttttggtggtagtaaggggcccttttctggtttaatttagtaactaacatgtcaattgctgtagttctttagagaaatgacaactagtaatgaaactatatcttactttcgtgtgacaaacttgtgtaaagagtatatatatatatatatatatgttcatgtttatttgctatattaattaccataaaagggacattgaattggttcagtctgttagaaagaagacacacttattgcacagtgtgagctcaggtcctgacaccattttaaacctagttaacctgactgacttaaaccatggttgtacttgaactatgggattttcatatagttttctactcctgatgctgtaggctgccttttggctacaaccaagaacttacttgctgtaggacattatcctcaaggtatcatcagtaagggttggattgtgaagccaatgacaattcaaagcattttctttggaagtccttttgtgtaatcaattattcaaagtcatagccataaacccaaacctttccttagatacccacgactacaatttacatttaaaaaattgtgctttcatttttgttttctttctcttgtttgttgttgttgttttttttctcttgttgtcagacactttcagtgtgaaatttttgcttggactgcattgtgttgattcagatgctgacatttaaaaagccaaatctagagaaatgaagcttttgggtaaactttcgagtaataagtggatgattatgtccataatgttgttgtgacttttaaatgacatttaggatggtaacctcctgacatatgagtaatgatgggtgggtttttaaagcccacacttttcagaacactcttcatttccttttcatgttttcatgtcattaactgtgagaagttgtactttcccaaggcatgacttatttattgacttgaacagactttctaatttagtttttcatccctcatattcacagtttggattggaggtgtgtatgaaaaatgtattggtcacattaaagatctatttaaaagaaaaccttaattattcatgaagacacccagacctgttaaccttttttatattcctgtatccttaggatcctgagttactgaattgcccagtgtaatgatgatatttgaacctagctatacatcacatcatttagggtgctttataaaaatgttaatcctcaaaggaccccctccacaaggtatttctatttaataggtctgagctgggtcctaggaatctgagtttcaagatgttctcaggaaaatctgatgcccaactaagtttgaaaagcacttacttagtcttttacaatatccagacatagtatgtgttgcaaagtaatgagagagttggtgttttgaattagatttttgatttcataattatttgtagatctctcaaaacgtagaagaaccaagctcttgtcatagggattttagtagcttttccttagatattttctagtcttattttatagatgaaagaactaaaagtatagagagggtgagtaacttgattaaggctcctcagcactttcccatggaagccataatggtgtccagggagcctggccactccaatcagttgcctttctagcaccctatgcgactaccatgttatcaaccacagactactgttaccacattgttggagctgagtagccatggggcacattaaattaatgaaaataatatgtggcagatctttgactttcatgtttcttctgggagagttgacttggattaatgtctcacttttttattgatttttaaaaaatactttaagttctagggtacatgtgcacaacgtgcaggtttgttacatatgtatacatgtgccatgttggtgtgctgcacccattaactctcatttacattaggcatgtctcctaatgctttccctccccactcctgccaccccacgacaggccccagtgtgtgatgttccccttcctgtgtccaagtgttctcattgttcaattcccacctgtgagtgagaagatgcagtgtttggttttttgttcttgcaatagtttgctgagaatgatggtttccagcttcatccatgtccctacaaaggacacgaactcatccttttttatggctgcatagtattccatggtgtatatgtgccacattttcttaatccagtatatcattgatggaatgtctcacatttttaatgctaaagtttcattctactcattggtgcttttgcttcttcggtaaagattttctaaaatgtttacataggtaagattgcttttgagtaagagtaggttgctttctgattttgtttggatctttggtgttaacaatgcctcttgacaaagttctcctaactagactggtaatttgatttgtttgggtcaggaggcatggaagacatcacactctggatgtcttctacatccagaaggatggaggcatggcagatgtcacactctggatgtcttctacatccaaaagctggaggctctgcctgtctggtcccagctttgtgtggagaacttcactttcctgattctacttcttgttttgttttctaccttcttcattcttttcctccttccttttcaattgtgagatacttctaacacaaaaagaatatattcagtgtccatgtaaagtagaaagaattaaaaaatgaattatatgcactcaccattagcttaataaataaaatgtaatactttggcctcatttccccttctgtaaagggaggaaattggtctaaaaatgtacaaatacctttctgcaatgatttcaaagttccattctataactttttgatctttcgtaaattagtacacttccctgatatcaaaacaatgttgtgagactatatgcacgtttaaaggtcttttgagcttttgaagaaatattttagatagttgtaggtaatctaaattggattgagataaagcccagttaagtcaggcattagaataaaaagctttaattgtaattatttaatattcaacagtggaatttagatgacatcttggtggcaacctgtttctttggcttgctaataacatttaagacatttataaaattatcattttgtagtattaattatatgctatatacataacaagtggtgtttaagtagcaacactgtacattgccagtagtatatagtgtcatagatgaaataggggttttagaggaagacaaaaaaggccaatgttcttgtatatcaacaggttagttgcctagcctcgtcactgatggcttccttcacctattcatttctagttattgactccttttctgctggaatttgagtctagcctttatgttgctctgataccccaaggtcactcttcctaatgatttagggcccttgaagtcctgggcagttgttggtttaggcatacatccagaaagtaaatgtcacactattttagttacattggctgtggtatgcagcaagaagggaaggatctagcctggaagaatccgatgctatggaggaagctagggatagagtgtggtttggaattcatagagggcagtggtagaagccagcacaattgagagtctggggacctgcaggtcctggtgactaaggcatgatgaggattagaaactgtcgaatcaggaaatacgtattgagtgtcatttgtgtgccagacactattagatgctaggaatgcaagatgagaactgagccctgaatgagcccacaggccagctgggggtaaatggggaactagacaattacagtgttggtagaagcaactgaggggcatgggaggaggtagaggggtcatgtagtccatcccaggagaggggatgatgatgtagaagacatccagaggatttggcacctgcttcgattcttgaaagatgactaggaattaaccagatggaggaggagagagaaggtgtaggaggcaggactagcacctgtaaaagagcagatttgtgatgtcgtataccgagttcaggagactttaagtggttgatatgaagctaggtttctgtgatgaaaggttgaggaatagagctagacagatggattagggccagatcacaaaagaccttatgtaccatgccaaggagtttagacattgtaaaagtatcttccctttgggcctccacacccaagttcaactcctttgcatgctgctgtctgccccagaggctgagctgtgaggactacatttacagggctcctgtgacctctgggtttcagttgggtttggttagtaaaagtctggaaagagatgggagggaaggagaatcgcaatgtcagagaatttcttctcctgggtctcactctgcaaaaccttgcactggccatatccgtctactgaagtttgttgattctctcaaggcagactactttcctcttctgggtccggacatcctttttgtctactcatccttttgggcctttgccgactactttcctcttctgggtccggacatccttttcatctactcatccttttgggccttggggtggttccagtttgtatttgttatctcttgctgtgtaacgagttatctcaaaactcaatggcttgaaaacatttattatgtcacaatttctatgggttagtaatccaagtgcagattccgtgagttctccagcacagtgtctttttaaaaggctgtgatcaagatgttgactcggattatggtttcgtctgaagtctcagctggggaaaagtctactcccaaacttacttgtgtgactgttggctggattcagctccttaggggccgttggaatggtggactcggttcttcgttggctgtttgccagaggccattcttagttatttatgacacgtgtctctccatatcgcagctcataatatggcaggttttttttttttttttttttttttttttatcagagtgacaacaggcagagaaggaagatgggtggtagtagtcttagtgttttataacctaattttggacatttttttctttattatactttaagttctagggtacatgtgcacaacgtgcaggtttgttacataggtatacatgtgccatgttgttttgctgtacccatcaacttgtcatttacattaggtatttctcctaatgctatccctcccccagcccaattttggacatattatcccatcccttttgatagtaagaagtcactaggtccacccctcactcaaggtgagggatttacacaaagatgtgaataccaagatccagaattcagaaaatctttgtgggccattttggaagccatctaccacacagctctacttctactagccaggggtttctgagtgttttttttttataatttccctgtaccctagaactcctttaaacttggtccttttggaaatacattttccttaaattgtcctatgtatatcatctgtttaccaataagaccctaacgaatgcaagtattatcccacaagcaaagggaagcgattgagactctgcgtttcttgataagggaattcttcatgaaagggtttgaagcaggggagtcatttgtccaaagtggaggatgggatctgaaatggggaagtcaatgtggagaagattcagtgtggaggtcaatgggtgatcgatgtggaagggttcggtgtggagggagagtgttggagaagtggtaggattggaggtaggaggacagtttagagattgaacaggaatccaggtgaggaaaaatgatgcccaaatcagtggcagtggtaatacagatgggaggatgtgtttgagagatgtttaggaggttcaggcaacagaatttgggggctgagaagacgtagggagaatttgagaataatgaggaggaatgaggagtcttttccctaggctatatctgtgattctcagaaagtctcctgggataaacttttgaagcaaatagctgtagaactggattgcctgcccctctcttccctgtatgtagataaattgagagagcccaagacagagtctgtaaatggaccaggatatctgggtatttgttctggctgccccactccactagctcatttatggccatgcgtaagttgttcctactttttgttaagtctagttctttaatttgtgaagtaaggggttagctatgctgggtgatctctaaagcatttttttagatctaacattctaggtcttttgtaatctaaaatagagaaacccacattttattattttactacttcatagcctcctttactttatttttaattttctttaaaaagtgaaccgagccaaaactttaaaaacaggtaagtcagaatgtttaaaacaaatggcttttggtcttcagcacttagggcttgttttttttcactctttttttttttttaacattaaataaaattcctggccacatgcagtggctcatgcctgtaatcccagcactttggaaggccaaggcaggcagatcacctgagatcaggagtctgagatcagcttggccaacatggcaaaaccctgtctctactaaaaatacaaaaattggccaggcatggtggcacacgcctgtaatcccagctacttgggaggctgaggcaggagaatcacttgagcctgggaggcagaagctacagtgagcagagatggtgccaccgcactccagcctgggtgacagagtgagactctgtctcaaggactaacttcagaaagtgttcagggtaactaatttaattgttcagtctacattttaagattcctttcattaaattttttgaagctttttttattgccttaggaaaaaactgttctgttttccttttcccccaggattagacttgctggaagaaaagctcccccatcacattatcttggttggcaggagacaggcatgcaggcaagtcccagaccagtggtatcagtgtccacagatgaaagggatggtatttttagtgtggggaatagctcagtgtggtttcatatgatgcattttgatgagtataactttctaatttgaaaagcctttggtgtgtttacgtcttcatttaatctttccaatttctccccctcatttcatttcaaggagtctaagatttttcattttggcaggcagttgatcactcttgttattgacactcctttgcagtattcttacactgtggagaacctgaatggctgtaaattccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgcttacagctgaaataatttttagtattttctttagtgcaggtctgctgaagataaattctctcagttcttgtttgtctaaaatatctttgggccaggcacgttggcttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtgcttggggattctttttttttttgatggaggcttgctctgtcacccaggctggagtgcagtggtgcaaccttggctcactgcagctgccacctcctggaatcaagtgattctcctgccccaacctcccgagtagctgggactagaggtgcgtgccaccacgcccaaataatttttgtatttttagtacagtcggggtttcaccatgttgaccaggatggtctcgatctcttgacctcgtgatcctcccacctcagcctcccaaagtgctgggattataggcatgagccaccatgcccgactgtgcttgggaattcttaaccattaacttttcaaatattgtttatgcctagttttctcatttctctcttcttgggattgtgttcatatgttaggacctttttcctctagatttcatgtgtttcttatgctcttttctgtattttttattcctttgtcattttgtgcttcaacatggatattttctaccgacttatcctccagttcactaattctctcttcaatatattagataatctgtggttaaagtcatcccattgaatttgtaaccttagttattgattttttaagttctaaaattttcatttaattttctttttatagtttctagttttctgctaaacttctctattttgtcatttaattcctaaacttattaatcataattgtttcaaagtccatatctgatactttaaagtctttatcacttgctggactgtttctactaaccttttctttcttttttttcttttttttttgttcttctgtttatttattttattttttattttttttaattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccagtttcatccatgtccctacaaaggacgtgaactcattcttttttatggctgcatagtagtccatggtgtatatgtgccacattttcttaatccagtctatcattgttggacatttgagttggttccaagtctttgctcttctgaataatgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgtcttttggctgcataaatgtcgtcttttgagaagtgtctgttcatgtccttcgtccactttttgatggggtggtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgacctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttctccattgcttgtttttctcaggtttgtcaaagatcagatagttgtagatatgtggcattatttctgagggctctgttctgttccgttgatctatatctctgttttggtaccagtaccatgctgttttggttactgtagccttgtagtatagtttgaagtcaggtagtgtgatgcctccagcttcgttcttttggcttaggattgccttggcgatgcgggctcttttttggttccatatgaactttaaagtagttttttccaattctgtgaagaaaggcattggtagcttgatggggatggcattgaatctataaattaccttgggcagtatggccattttcacgatattgattctccctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatggagttcactcatgatttggctctctgtttgtctgttgttggtgtataagaatgcttgtgatttttgtacattgattttgtatcctgagactttgctgaagttgcttatcagcttaaagagattttgggctgagacaatggggttttctagatatacaatcatgtcgtctgcaaacagggacaatttgacttcctcttttcctaattgaataccctttatttccttctcctacctaattgccctggccagaacttccaacactatgttgaataggagtggtgagagagggcatccctgtcttgtgccagttttcaaagggaatgctgccagtttttgcccattcagtatgatattagctgtgggtttgtcatagatagctcttattattttgaaatacgtcccatcaatacctaatttattgagagtttttagcatgaagggttgttgaattttgtcaaaggccttttctgcatctattgagattatcatgcggtttttgtctttggttctgtttatatgctggattacatttactgatttgcatatattgaaccagccttgcatcccagggatgaagcccacttgatcatggtggataagctttttgatgtgctgctggattcgttttgccagtattttattgaggatttttgcatcaatgttcatcaaggatattggtctaatattctctttttatgttgtgtctctgccaggctttggtatcagggtgacgctggcctcataaaatgagttagggaggattccctcttttcctattgattggaatagtttcagaaggaatggtaccagctcctccttgtacctctggtagaattccgctgtgaatccatctggtcctggactctttttggttggtaagctattgattattgccacaatttcagatcctgttattggtctattcagagattcaacttcttcctggtttagtcttaggagagtgtatgtgtcgaggaatttatccatttcttctagactttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatctattttgttgatcctttcaaaaaaccagctcctggattcattaattttttgaagggttttttgtgtctctatttccttcatttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttgaaagaacatctttatttctgccttcatttcgttatgtacccagtagtcattcaggagcaggttgttcagtttccatgtagttgagtggatttgagtgagattcttaatcctgagttctagtttgattgcactgtggtctgagagatagtttgttataatttctgttcttttacatttgctgaagagagctttacttccaagtatgtggtcaattttggaataggtgtgatgtgctgaaaaaaatgtatattctgttgatttggggtggagagttctgtagatgtctattaggtctgcttggtgcagagctgagttcaattcctgggtatccttgtggactttctatctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggtatgattttgcagcggctggtaccggttgttcttttccatgtttagcacttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggcccccactctcttctggcttgtagggtttctgctgagagatccggtgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaaagttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacatagttgtcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccgtccagctttgttccgttgctggtgaggaactgcttccctttggaggaggagaggcgctctgctttttagagtttcccgtttttctattctgttttttccccatctttgtggttttatctgcttttggtgtttgatgatggtgatgtacagatgtttttggtgtgggtgtcctttctgtttgttagttttccttctaacagacaggaccctcagctgcaggtctgttggaatacccggccgtgtgaggtgtcagtgtgcccctgctggggggtgcctcccagttaggccgctcgggggtgcctcccagttaggctgctcgggggtcaggggtcagggacctacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcacccctcccccagcctcgttgccgccttgcagtttgatctcagactgctgtgctagccatcagcgagactccgtgggcgtaggaccctccgagccaggtgtgggatataatctcgtggtgcgccgttttttaagcccgtcggaaaagcgcagtattcgggtgggagtgacccgattttccaggtgccctccgtcacccctttctttgactaggaaagggaactccctgaccccttgcgcttcccgagtgaggcaacgcctcgccctgcttcggctggcgcatggtgcgtgcacccactgacctgcgcccagtgtctggcactccctagtgagatgaacccggtacctcagatggaaatgcagaaatcacccgtcttctgcgtcgctcaggctgggagctgtagactggagctgttcctatttggccatcttggctcctccctccttctgtttattttttattaagttctgggcattatacaaataatatagaagacatcatttacggctctaggacaatgttacgttacttctgagagaacttaactatttttttcttttatgtcagtcaaaataggaatggattaccttaatcaagtcagacacaaagattacttgtagctggacttcagttcttcttagggctagatatatttctagatctcctttactctctgtagggagcccttctggttccaaccaaaaccctgggtgcccctcctccttggaggactctgacctctaatttttgtcctttaaactctatgacactgccaaaagctctgttcagcttcttgatcatgccttttgtttaagaaattgacaatgctcttgagaagaacaagcagctccaattgctgggctcatcttcttagttttcttctttcaggtcatggcctcacaaactcttactgtcttggttgcttttcagtgccctcaaacatgtttaacaaaatgtttttcagcatttccagttgctctcatcaggagggtgtttctgaaacatctagttagccattgtcagaagtagaaccccagaacattggccttgagagaaggtggatccatcttttatagccttggtttgctcttaaaatgttttagaaaagacatatcctgagtgtcttagtggtctagcgtgatggtggtagaggtgaagaaaagtgaaacttccagtatatttaaaaagtggaattaacccgttattagttttagatggagatgagagaggaggattcagggctaatggccaggatctggactgggcatctggatgtccagtcactaggataagtggttgggttagtgacactggagcctcaagtcaccacagtaacagaatgacattcaccacagcctagttatgtaaaactctggacagagggaataaatccaggcaaatacctctacgtatgaaatggacctgaaaagaagctttacctggaggaaaccttacctgactccagagacctttttggtttagaaaacaggaagtaacttgtatctgtcagtatgacacttttgaacatttctgtattagtttgctaaggtgctgtaacaaagtcccacaaactatggcttaagacaacaggaatatattctgtcacagttcaggaggatagaaatctgaaatcaaggactgggcagggctacgctccatttgaaggcttagggaagtcccctttcttgcctcttccaggctttctgtggctgctggagatccttggtgttccttggcttgcagcagcatcaccctggtcttcgcctttgtcctacctcaccttcctcatgtgcctacctctgtgtttcacatggccttataaggacactagttgtgggatttaggcctacatccccatacccccaattgattgtgacctcatcttaatgaattacatctcaaagaccctaatttccaaatgaacttacatacgcaagtcccagggtttaggactacaaaatatctttttgacagacacaactcaatccacaacaatttctagtttatcaccgcgtgaagcttagtgctctctgcaaagatcaaatgaacaagtagtgtacttattgagctgttgcttctgacaaagcactgtgtggggaataaaaagtagcgtggcacacagtctctgtcctagacaactttactgtccaactggggagaccaagagtgatgcagaactcaggaggaaaataagctttggttggccacctaccatttaccagatactgcagtgggggctatacatatattgagccatttaatcatcagaatagcttgctaggtaagtggtattcaccctatattacagataagggaactgagggtcagaaggagtaaataactagtattaagtggtgctatcagaatttgaatctagatttgttgtattctaaagcctgtggttttggggaagaaactgaattatgttaaaaaaaaaaaaaaaaaaaaaaaacaaagctgttagaaattaaccataagagagttagtgtgagagctgggtgtggtggcttgcatctgtagtcctagctactgaggaggctgagatgggaggatcccttgagcccaggagtttgagaccagcccgtgcaatatagtgagaccctgtctcaaaaagaaaaaaaaaaagttggtgtggacaaggaaggcttattgaggaagaagaaatttgaagagaaatcatctgaactgtgtttttaagaaagggtaggagttggctggtggaaaagagccaaaaactgattccaggtgatgggagctacgtgaaccaaggcaaggggatagaatatatcagatgtatttaggagaaaatatattttataacactatatataagatacgtgctttatataattatagcctcattcttcatatggagaccttgaagtaagaaaacaaacatttttagctctgtgtctcacatggtaaggtattggtaaagctgagccttctgccaatgaattttttttccattcctcttcagaaataatcgctttccatttaaaaagtaataattcaatttagaaagaatcaaaatataaagtagagaaaaaatctcacatattcctatcatgcaaatatgactaaagttaacattttggtctcttcctcccagtccttgaatatgtatcagtagtatacataacacattaacctagagagtaatcatagtgtatgtgctattttgtgcttttctaccataacctaagcactaatctgtgccataatatgtcatcattatcatagttttatttatttttattatttttaattttgagatggagtctcgttctgtcaccaggctggagtgcagtggtgtgatctcggctcactgcaaccgccgcctcctaagttcaagtgattctcctgcctcagcctcccgagtagctgggactacaggcatgtgccaccatgcccagctaatttttgtatttttagtagagacggggtctcactatgttggccagaatggtctcgatctcttgacctcatgatccgcccaccttggcctcccagagtgcggggattacagctgtgagccaccgcacctggctatcatagttttaaaggttgaataatattctaagtagataatgtaccatgatttacttatttagggtttgttattaatagcaaattaaaaaattcctaggtcaaaatgcatgacctgtgttacaactcctattatatatatggttttctggaaggtcaatattgattttggcatatatagactgggcttctctgggttgttgtaaaagttctatgtcattgaactacagaaagagggtgaggggatttctaacaattagggccagtgttttcttcacctctaaaccgcatccccatcctagtgtctgcttggctttgcaacaccatccttatcctgagagctttgttgatgcctggggatattcagaaattttcgacttggaacccttccaagacatttgctattttattctctatttgtttttcttaagcaactaactaaataagaataacatttcaacctctttctactccccacagcattttttcctgcctgcaccacctctgcctacagtttaaccatggggttgcttcttatattttaaagctaaatacaaaagcacagttctgagaagcagccaagttctgcagccaagtttgaagaataaaactttaaaacagctcttctgtcacacacttgagaggggaggcaggctttgctataaataagtcacattccatttctatctcatcctttgcagtcctcttgggtaatgctttttgtatatgactacagtgttctcgaactgcccactcacccctttcaaccttccattttgtgcctcactttatttaaatgttcaatagttttggagtttagggaccctgcatgaaaggagtagacctttcctttcattcttcaggcttagatgtaatgagattcagtggctaacttattagaaactatactttctctttgtctgtaacgttttcagcagctgcctggattagtttcctattgctgccataacaaattgccacaaatgtaatggcttaaaacaaggccaggcacagtggtgcatgcctgtaattccagcactttgggaggctgagatgggattgcttgagctcaggagttcaagaccagcctggccaacatgatgagaccccatctctatttaaaaaaaaaaaaatacaaaagttgtctgggtgtggtggcgtgcacctgtaatcccaactactcaggaggctgaagtgggaggatcacctgagcctggggagctcaaggctgcagtgagccatgatcgtgccaccgcattgcaacctgggtgacagagtgagaccctgtctcaaaaaacaaaaaaccaagaaaccccacaaatgcattttcttataattctagaaatcaggagtgaaaaatgatttggcagagctgcatgccctcagggggctctaggagaattcatttcctccccttttccagcttctagaggctgcctacattccctaagtcatagccccacatcagtcccacctctactcttggcatcatatctccttctccaactctgaccttcctttctctctcttataggacccccggtgattacatggagcccacacacataatccaggggtacctccccatctcagagtccttaacttagtcccacctgcagagtctcttttgccaagtcaaataacatatttataggtttgtgggattagggtgtggacatctttggagggccgttattctacttatcacactgtcttagaaaaggaaaggaaaataattttggaatttttgtctttttcatagctagggaggaggtacgctgaagttttgtttttccttcctgtatttgtgatggttgatatgtggcaatctaaactaagtctgggatgtctgtttgtattggctgaagttcattggagggcagaaaagaggagagtttcagagactggcagtgaggatgggagggtggcttaaagaccttcacaacctgctcactgggtgctcctgttaggccccacaaacaagcccatgccatcgaggagaagtgaccaagcagatacattcaaaatgaataaaaggaagacctcatttactgtagtcccatccagtgtggcttccttataggactatttgtctctaattattttatttattttttattttttcagagagagtctcactctgttccccaggctggagtgtaatggtgtgatcttggctcactcagccttgacctctggggcttgatcctcccgtctcagccttcccatagctgggactacaggcatgcaccaccacacctggctaatttttaaacttttttgtagagacagggtctcactgtgctgcccaggctgggcttgaactcctgggctcaagtatatcctccctcctcagcctcccaacatgctgagattacagatgtgagccaccatgcttgaactatattttaaaaaaatattaattatgatactaaacaatacagtgaataaataaccttctcatgactgtccatctggcatagtagaagactttatgtgcttttttcaaacaatgagagaaagtgctggcatatcgcacttcccttagcttgagagacatgtgccaatctgcttgttgactctgccaaggcctctctttccgtcattttccatgttctggtcaggatttgtgacatatagtggctgacaaaaggcacacaagtgatagtgttggtggccaatctgccagggaagagtctgaccctgggcgctaatgtgactcaaggtagatgagcccttcgaggagctagtcaaggaaacagatgataaagtctaactatcagtgagcgagcagggggtgagcattttctttctgaagggagttattactgtcattaacttcattgcgttgctgggaaggaggggtcagtagttgaaacaaaagtctcctatggctgatgacatgttacaactttaggacagttgtcagcaagcaacttgctgttgggcctaatctgtccccatgcctttgatcccttgagcctcaggatggtttctacattttgcaatggttgaaaaactttaaaagagaagccatattttgtgacatgtgaacattatgtgaaattcaaatttcagtatctgtatatcaagttttattgaaacacagccacatcatttgtttatgaattatctatggcttttttttttgagctaccacggaggagttgagtggttgtgacagagactgtccgtatgaccggtgaagcctaaaatatttactaactggctttttacagagaagtttgcagcttctgttttcggagatttgaaagagactgaaaaagcatcggcaaatgtccttgttgggacaatatttccataggaaccaagacccagtgattccatgtggtgctgatttatttccaggaacccatggagggtctaactggggagggggtatacaagataaattagaaacaagtgcacattcctgtactacaaaaaatatacaagacctgccattcacccctcaaataatatgtttcctttcctgaggggtcacataatttatgccagtacattattgatgagatttttgtttgtttttttaaaataaaaaacaggcatattgagctgctggaagtgttgagctggctgttctgaaatatcccactaggatattccacttgctggctggctacctccatctcagatgcaatgtccaaatggctgtcaatttctgcaggacccactttgtgccaggcattgggccagtgctttgggcacgtgaattgctcacactgagagcactgctgtaaaatcattgttattcccatgccgcatatgaagaaaggagcttacactgggtaaacccatgcctgggcctcccctgtaagtgggaatcccgagttgcaggtcaggctgtctcttcttcacagaccatgctctttcacaagacctggaaggaacaagacaaccacctggggagctgcttacttctgatctttcctctgggatgccagggctatcacaacctcataggcaagatactctaatcactgagttatggtgttcggtgataatatcgacttccatttttataatttcttctagcactctgcatcctgcatgttatatttgtaaaaggcctgtgaaaaacataaggcagacatatctatttctgctttgtaaatgaggaaactgaagctcaggggtaaagaggcctttctaggctcaaccagcttttagtggcagagccagacctcttgacctggggtctggtgcctgtacactacttcccatgggccaggtctttgggaatagagctgcgtcactcacacttaccttagcagaggctgtgatagactctaagccgtatggtttttagtttatcctcagtgaacctcaggtcatcaactgacctccagagacgaatttcacgttgtagatggttttttttgttggcattactttacaactgtgactctgctgaatgcactgtacctttctctttcctattaccacatccattgcttgagtttcagtcctgtcttagtccattttgtgttgctgtaaaggagtaccagacactgggtataaagaaaagaggatttataaagaaaagagggttatttagctcacagttctgcaggtgtacaagaagcatggcaccggcatcaacatgtcagagaaggtcaaaggagaagtgagtacgtgtgaagagacaccatacccaaagggcatcctggctttacataataataaaccaacctaatcccatctcgccagagtgagaacagcagcccagcacgaagtcattcatgagggttctacgcctataactcaaacaccttcccctaggccccaccttctgacaccaccacagtggggagcaaatttcaacatgagatttgatggggacaaaaaatcccattatccaaaccatagcaagccccaatccaaaccaaaagcagatccccattcgtggttcccctttccacatggttccaaatgaggaagggcaaaattcatgtgttctgctcagtaaaaggttgaaaagttattgggaaacacatcttccaaggtttgtgtcctttgggacatgggaatatgttattaaccaggacagctgctcacagctgcacagggatgtactgaaacagctcattttaagcaaattttaagtagtggagaggatcattcctgggcacatttcacaagcattctgtcttggttttaccccaatctctgcatattccttcttcgtcttcattcccggggcagcttcttctgcccaccccgtgaaactttggcccattcttttctgtatgctgtccaggggccatctcctcctctctacatgctgcattgaggatccccaaattgctatcctctctccaaactccaaatgcctatatccagctaccaaaaagacatctctgtttgaatcttcctcacttaccacaaacataacaggtagaacatagcttatttcttgccctgccaaaactgttctccttctgagcttcagtgcttggtgtagcatcctccacatagttggcatcggaggcagaacctgaacctgattctctttgacaggcctaatcactcaccactctacgcaatatgaaaatgacatgccatgtgaatccaatgccatgtaaaaaaagataacattttctgtttgtctccctaggatattgtaaatgcttggcaccaagtaggtgataaataaatgtgaaggacaaacctgttgattaagcgttcctgagacatatcctttatctttctcagatgagattctctgccacatagcttatccctgtattgggtggattgtgtaactctgaggttcaaacattgggtattgcctctaaaccttgcacagttatttatctcagaactattgagtttggcggctgtccacatcatgtaacaattctgctgttaccttcctttccttgttttcttccttccctctctcctcatcttccacattcctatctgtgagagaggatgagaaaaaaacagacaagaagacaaaccaatatttctctcaccaatgaaaaatacctttccgttctgtttttaccattaaatgtggtatttgccctctgtgtctcaattaaaacaggttatttccttcttagtttcttcttttatattttttttcttgtttcagaaatggttcatgttaattgtaaaagaaaaattccgaaattatagataagccaaagaaataaataaaacatgtaacaaccccctgctcagagagttgtggttaacttttgaagtacctacttccatgcttcttttctaggtacatattttaacagaaatagagacttactgtacttgctgttgggaagcttcttttcacataatagattgagaatattttcttgtgacagtcaatattcctctagaccagcaattggatcactttgtttaaagggccacatagtaactattttaggctttgtgggacttactgtctctttcagctaatcaactctgctgttataagtgcagaagcattcacagaaagtgtgtaaatgaatggacatgtctgtattctaataaaactttatgaaaacaggcagtgagccagatttggcccatgggtggggctgtagtttgcctatgcttgtctagaatatcttttttttttttttttgagacagagtgagacagagtcttactctgtcacccaggctggagtgcagtggcatgatctaggctcactgcaacctccacctcctgggttcaagtgattctcctgccttagcctcctgaatagctgggactataggcctgcgccgccatgcttggctaatttttttgtagttttagtatagacagagttttgccatgttggccaggctggtcttgaactcctgacctcaaacgatcctcccaccttggcctcccaaagtgttgggattacaggcgtgagcccacactccactagaatatcatttttaatgcctaaatagtgttctatcttattgatatatcattatttacttaaccagtcagagtaatagctaatgttgtttgaggccttactctgcgcttgcaacattgcttcgtttgttctatttgcattctgacttacacctgcccacagccctgtgtagtgtaggtattattctttctatttaacagatgagggaactcggataaagaacaggtgggtaatttgcctaaggttagatggttagtaaatagaaaactcaaaatttaaatttgtttgatttttagaagccatgctcttaactactcattatgtttttacgcacgttagtaattatttgcttggataaattcctagaattagaataacacatgcattttaaggttttgatatttgttgtcaggttgatatatttggccaacttatatttcttgagtggtatatagcagggctgtgtttctacacccttgtctataacaaggactcttttgacgctttgctactttaataggtaaaacaagcttcatctttttttatcttatgaatactctctatatttcttctaaggtgagtgtctgatgcatgttctttctccattgttcaataagagcatttgtcttctctattaatttgttggagccttttatgtaagggacttctgtggtttttaagttgatgctacatgacgtgttatgaacatagccttttactttaaggagatgttgtctttacaattgaagataattaaatggaaaagtatttagttttaatgcagcattaattagactcctggaattgaaaaaattcccagaaactgtaaggtaagggaggacttactcctgttggggaacttgtccctttagtttccatctcttaagtactagaatttgtgttctttaattggaaccattgctttgctgtggccatggcaacacatcttagctgccatgaacagcgcacactttgacaaaatattttttttagagagtggcttttagatggaattcattttccaatgtattcatggagtctagatgaattaatggatggtagacccatacttttataataatagtaataataatgaaatgaatagttactatctattgatcccttactgtattctagccacaatgctttattttatattatttcatcggatctttgtgataatcttatgtcatagatattgttgttatccttactttatacataaagaaattaacacagaagagttaagtggcttgctctggcttatacagatggtaagtagtggagtttgaccttgaccttaaccttgattttctactgcgtgagtcttacaggtttattatagcctttagggtatatactgaattcaacagtggtagcatggatggcaaatcttgatgtcatctagagtctaagatgacactagcatcagtgggccacagggaatctgacccagactttcataacttgtattattatgaagattagagttctgaagcttactggattagaagagcacgagggggtagctgccccaatatattctaatttctcttgaggaccaccaaattggcagagtgtctctgatagggaaaaggaagagttggaaggcatcttagcctctaggacagaagaaccatttttattggccaccaaagttacatctagttgcctacaaatttatatccaaactccttatcctgccaattcagggttctgcaaactgatgccaaactatagtttagtcttctatcacatgactgcattatacatacccaattatctgggcaaacagacctgatccaaacacagtttgtactttcctttcctttcctttgtttagcctgttccgtctacttggggtgtctttgatttctccagcctcagtctcccgctgttagaattctgggcctccctcaataccaaggttaagtagtacctaacgaagaattttttatttttacagacaaaagcagtttctctcctcctctttgattcttatggttatttatattactctcaagtcaatcataaccttcttatttgtaggatagtttctccctgtaggacttgcaggattcctcgaatacagtgcttttccaaaggtaaatgacgacataccttaatcttgttgttagggattctgactctgagagacatgaaaccactgtttagagtcttgttatgtatgaattgtgtccccctccacccagtccatatgttgacatcctatccgcccatgtctttgaacgtactttgaaatatgattgttgcagatgtaattagtaaagatgaggtcatacaaaagtagggtggactcctaatccaatttggccgtcacactggaaatttgggcttgcacccaccgagaacattgtggaaagattggaatgatgctgtcagaagccaaggaactaccagaagctagaagagaggcctgaacatacccttccccagagccttcagagggagcatggccctgccaacacctaggtcccagacttccagcctctggaactgtgggacgatacatttcttttgttgaagccactcagtttgtggtactttgttgctgtggccccaagaaagtaccacaagcctgaggttttcaccgtccttacagccagcaagacgggatgtttcagatgaccctgtcctatgtggaactgggggctgaggtggggtggcctgataacagagtcaccaaagagctgcctctcttatctgtactcctgagttctcacagccttctgggcatcttcagcaccagcaactcagcatgtcaaaactgaacatctttcctctccaaaccccttttccctcataagcccatctaaattatggttaccatgtccctctcagtccctctggaattcttcccttttctcatccccaattgaaaaaaaaatctggaattctatgttcttctggaaaataaggaagatctggcaacaccaggcctttgttactgcatggctataattggccagatggatgggctgcccctgaacatagagaatgtgtcctgggtcctgtttgacatcgcatgccagaccctgtgggcattggagcctggcccctggcagggtggaagtgattgcctctgcctcacagggacataagtggaaagcttcagatcattctctgagtcaagctgtccggtttatgtcctgctgtgtcgcttactggctgggggcagccatgggaagtttccttgatctccctgtgcttccgtttcccagtctgtaaatggagataataatggtgctcgcctcataggggtgttgagagaattaaatgatttaatgcgcatcaggagattggaacctgacacgtagcaggtgcacctgaaatgttcccttatattcttatgtagtcaagaaaatcttgtcaccctttatctaaactgctttattatttttcatgacgcacggcatatttacttcttggttttactttgctactctccatcccccaccagcttgacacacattcagaaaatgtggccatagtttatacacatagattcagggctggcctaccaaggagtttggacaaagctcccgggatctcacttggtggagctcctgggcctctcctggctgccgagtcccctgtgctttctgccttctgtgttgtttcggttccagtgaccaagggcacagcttggtgactggcctcccgaggccttccgagtcaccgggggatccctctaattaggtacactgttgagcatgcaggtgtatatcctgcaggcaagaagggctgctgaaatagtagcttaacatgaaatccaggcagcaagtcgggtgttcgttagaagtgtgtttttttttttttgtgatttgggacactgacaaagcccagacaaacctccccacaccaattgtttcccccagctgtattccccttattgggccactcctaagcagtgctgatgacttatttagctaatatttgttgactgaatttttattaatcaatagagatttgttaagtaaatggagcattattcagacatgtggcatcagatccattactagatgtaagtgataaataaagtggtaggtaagacacagtcctgcctgtaagagatgtgcaatctagtcattgagagagaccctatgagaaacagtgggtggagctgggggattaccggtgttgtttatgggatcccagagaggaaggaccctgactcagcctgaggttgggactgggggcaactgggggatcatcagacttgtcattattgatctaatgtcccagtaaaattgggcgttttcaggacagggactgtgactgtctttttattgctctatgtcttgtcctagcccagtggttgacatataacagacggtcaataaacatttgatgagtaagggaattaagtgacatctaagctgagaactgaaggatgaggagtctgccaggaggaaagtgtgggaggtaggggaggaagggggtggcgggaggaagtaaaatgatgacgaaggatggtacagggagggaggagcatgtgctccttgagggtgacaaggactgcagttctgggaactgttagcttgtatggtgggtggcatggagccatttcaaggtgggggcctgggcagagctgaatggtgagaataacatagagttcttagtttttacatgatgaggtttgatatgcatgatccaaggtgcaggaaatggattggagaggacagggtggaagaggagaggccattcgatggctattgcagcaatcttgagagatggtggtggcaggacaaattactgacacctgagatggagaggtgactagattcagaagcaactagggatgtagaattgtcagaacctggcaattaggtgtctgtggggaaggaaggagagatgtatgaatgatgctcaggcctccaggggatgtgggcaccacttacttgtgatagatgagaagaggagctgtgagaaggttaaattcacacttgggcatggtgagtttgagatgcctgtgggaagtccagagcgcagttgtatacagcaggcttcacctccagagagtgatcagatttgagatacaggtttgaacactcattggcatagagggtcagggcttcatagcctagaaggacatagataaaattaagaaggcctatgaacttcagaaattatattaaaatcataatgcatgtgcattgttctgaagagctagctttgtatcaacttttcaaaatgtctgtgtcctcaaaaaggttaacccttggtgcatatggttaatgaagccagaaggagagatgagatttttcaggcagcaagaagggaagagagccagggtttgtgctgcagaaaatatcaacatttcgggggtgggaggcactgtgctgagtcagaggcctgggggtcagagttctgggaatgagataaagacttacaggtagcaatagctttactgttcataaagcacttttacatacaatgccattttatctctcaggaactcaactagatctttataatttggctctgtatcagttagagttcagtacaagacatgaaaacttggctataaattttaaagaagggatttcctagagggaataggtgcttactatggacccagaaaatctgagataggtctcagttaatgtagaaagtgtattttgccaaggttgaggatgtgcacccatgacacagcctcaggagggcctgacgacgtgctcaagctggttggaatgcagcttggttttatacagtttagggagacatgagacatcaatcaatgtatgtaagaagtacattggttcggtgtggaaaggtgggacgactggaagcaaaggcaggaagactcaaagcggagagggagcttccaggtcatagataggtgagagacaaacagttgcattattttgagtttctgattagcctttccaaaagaggcaatcagatatgcatctatctgagtgagcagagggatgactttgactagaatgggaggcaggcttgccctaagcagttcccagcttgacttttccctttcacttagtgactttgggggcccaagatattttcctttcacattacaaaatctctggaagggcagccccagggaaagattcccagaacaatatagaactaaggtcagagtacatccctgtagctgccaccctggcatcgaaaagctgggactggaaagccaccatggctgcagctctttctcggccttcatggagctgaaggaaggatgctggacactactgtattaagaaatctgttttcgtgacctgccttgatagcagtgaacagtcaaatagaagccaaagcatggccctcatctcacttccaccttctagaactccttgcttgagtacatttaattagtggaatccacttcagtcctgaatctctagatgcagagaagtctggaagatatctttataccacctctcttcctaaaaggagtgtgaaatggagctagagaaggggtcttattttgtaagggtcaagttaagaactgtttcagtcttagtgagccatgtggtctctctgcagccttgccattgaagtgtggaagcagccagagaccatacagaaatgagtgagcatattgtgttccaataaaactttatttataaaatcaggcctggcacagtgtttcacgtctgtaatcccagcactttgggaggctgaggcaggagtgagcttgattgtgccacagttctccagcctgagcaacagagtgtgagaccctatctctaaaaaataataatgataaagttagttaattaaattaaaatgagtgatggggcctaaaggccacagtttattgacctctgaggtaagcaaatcaattctcaataattatcgtaggttcttttttacagatgagggaattaaaaccggagagcgtcagtcgaagtgaaaataagtcctggttatttagttttcaaagttcatgttctccaggaaatcctgatgctcagcctctcctcttacaaggcttgtgatctaaaagaggagataaaatatgtactttgttggtgcagaccatggtaaatgctcccgggatggtgcggaatgcttttgcatacaaggcatttttgacaggagaaatcagaagtatgatggtgaaagtagttttagctagatgttgaagaaaggtataactctaacaggtggagatggagaagggaggagtcaaaagagctgatagggtttggctctgtgttcctgctcaaatctcgtgtcaaatcataacctcaatgttggaggtggggcctggtgggaggtggttggatggtgggggtggatccttcatgaatggtttagcaccgtccccttggtgctatccccgcaatagagttctcatgagctctggttgtttaaaagtgtgtagcacttcccctctctctttctcgtgctctggacatgtgaattgcctagctcccccttcaccttccgccatgattgtaagcttcctgaggcctccccagcagctgagcagatgctagcatcatgcttcctgtacagcctgcagtgcatgagccaattaaacctctttttttttttttataaattacccagtatgaggtatttctttatagcagtatgagaactaatagagaatttttgatggagtcaaaaactgcaagagaagtttaggaaaacagctagaaatggaaactcatctgaacattgtgaccttctatggtgttagtggagataagactggatcagggagaaccttagatagtaggattaggaatccgaacttggaaaaggggaagcactgatagtcttcgagcagggttgtgatacacacattacctcaggaagaattatctggttttgttctacagaattttgtgtaagtcagaagatacagccagcaagaattcgctcaggcggttgttgtaatatctttacatgaggatgcaaaggaagaagtggacatgagtcttgggccattcatgggacagggcaacttgtaaatgtaggtggaatagaaggatggctttgatgggaagagatgaaatgaataacaatacttgggaaatttgaggaatgggagcttgttttgtgggtaaagtaatgggccccatcttggatatgaggtgctgaggggcagaaacggaaatatggagtaggcgattggaaatgttggcttcatcttcaagatggggttggttgggagtcatcccatacaggtggatagagagccaagtaagagctcagctctctgagggagtgtgtacagtggaggatgccggaaggagaacccaggagacaaaggtattccagaactgggagagggacaagagataggaaaatgtagtaggcagggtagtgagagtggcaggatggatgttgtaccagaggagtcaagttagggagctatttccagaaaaagaaagagccaggaatgttgcatgccacagaaaggtcaagaaatactcgaaaaaccactggatttggtgaccacatctcaaggtcatgggcgaccctgagagagctgtttagtgtgtgttcttctcttgaggagtttcatattgaaagaaaagaggagagaaaatgggagattgaaatttgtggcttgttttaaagtggattaattcttcagtgccagaagaccacaaagaacttggtctgagaatatatcctgatttctccccaagacttttcttaagaaaaagcaagttgaaagaggaacaccctttagtttcgttctctcttgatttcaggattcggtttttggtcagttgtttgtgtctgactccacttttggccctgtcgtggggccgctcctggcaacctgggaggtcacgcacaagtgtgtgcagttgttaagcaactgctcgcagtcgcggtggccctgctaaattgggaacatgtattcgtcccagtctgagtcttcattcagtgggaaacaatgagtccctgactttgaaatctcagaggttacacatttgtggaatatgaaatcagtgtgttgatgatttttcctacctcatagaattctttaaaaataacactggagaattgctatgcaattctgtgaaaatttagttctctctagggccttttctagaaaaaacgttatgcccaaatcccaaaaggaactgagtattttatatcaatgctttctaagataaataaaaacagaacacacacacacacacacacacacacacacacacacacacacacacacacaacgcagcaacaacagcaaaagtcaataaaacaactcaccaaactaactctagagtttcagatggaaatgatgttatcagtccaaattaaagacatattctcttattttcttttacaccttggtttgtggcttccataatacaatcatctgagtcttgtatggtttctgaaatggatgctagaagagataacttgaatgagtacttttcccctggtggaattctcttcctcatctatatttaaacagttgttttgcacctaaagggccctaagttacgtttctctggagatatttagagataagaagtgttgtaagtactctttcacatttgtgcagaactttagtctttgaagtgtttagacatccattaatctttttttttttttttttttttttttgagacagggtttccctctgctgcccagactggaattcagcagtgcaatctcagctcactgcaacctttatctcctgggctcaagtgatcctccctcctcagcctcccaagtagctggcactacaggcctgcaccaccatgcctggctaatttttgtattttttgtagagacagggttttgccatgtcacccaggctggtctcaaacaatctacccacccttgcctccaaaagtgctgggattacagacgtgagccactgtgcccagcatccttaatctcattctacctcactttctgcctattgagagataggcaccccaagtaggaagtccaaatgctgataaagaaattgggattcagagtgacttactaactagccccagatcacacagcttattagaggcagattcagggctaaaggtcagattttccagctgcagatttattctgctttgagtggcattttagacattagtgttttctttaatccttaagcatttcagtgtctaaggtttgtataacatcaggttggtttctggtagtacgttgattgtggagagggcccagaagcagaaaccacagtctttacatgatagttactcttatctgaggtttggcctttattgaatggaagtctcttgttaaagaagggtatgcattgaggcaagagtcttgccaacttttcaaaaaaaaaatgggaacccctgggctccttggggatggctaatgacaatgattatggaggaggctgcaaatgtgaagtactttataaatcctggaggtgtggcagtagactgtgtgtttctggggagacagatttttgcatacattatcctctggacacttctgcctttggtgcatgcttgtttttataaaaaagcttgttttgttcctcctgtagaaatgagcctatcatctagagtcatggtggttttctgtatgtgtgagcttatgcttcagttacactgaacactcgtactactgcaaaatcgaattcagtgacattgccaatatcttcgctctcagtagtctttaaatattcttagccctgggaactggcccaagaaactgcttattcttttccctgtatcacttagcatataaatcctgaattactgctgactgaagatacataaagtacaaatcaataagtattttgtttctatattttggagaatgagacaatgagtgaaagagaacccctcaatgagggctttaaaatattgtcattgttctatggattagtagagctgcggctactattttacttacccactggccaccaggtactcacactgcagtgaaaggattcctaaaaacatctttattaagatattcacatactatacaatccacccatgcaaaatttaccattcgacgttgttggtatattattactttgtaaaaatcatggccctatgcacaacatacaacttgccactttaatcattcttaatgtacggttcggtggcactaattatgctcacagttttgtgcaactgtcactgctacctatttccaaaactttttcatcatcccaaacagaaactgtgtacttattaatcaacacctccccgtgaaagaatttttaaacataccttgattattagctttggatgtatataaaacctttaaggaagattttgtttagtctgttttttttcagggaaagtttattttttaaggggcagttccatacagtaggtgacacaggttaggttcctccagaaagcagcctcttatagtagcatgtgggacattgccagagtctcaggagcaacacttctaggggatgggggaagggatggagggaggactgggtaaaaggagaacgtgtactgtgttgtcattggaaggcctcaccctacccagtggaactctggaactggcatttcccaagttggggcaacagggatggatctttgtaccatatcattcagtcatagggttcagctcccaggacggcgcatgagcttggacaaattctctccagccaagggtcagagaaggttgacagctgagagctaagagccagcagctgaggggtgaaatgctcagtccatactttgccaaactttgctctccactggaatcacctttgcatcctcaaaaatactacgcctgatttaattggtatggggtaagagacaagtggaatgcttccaaagctccccaggaggtttgaatgggcaacacagattgggaatggctgctttcagtcttgaaggggagtcagcatagtatacatcatcatgggaaatgcctggactttggattgaaaaaaagttgaacttggctcaaccatttactgacgttgtagttcttatttatgttctgttaagattttgctactaggctttaaaaaatatgaatggatggtgcacctgggtggctgagagggcacttacaaattaaaacaaaaacagtgaacacctccagaatttgatagaacacaagaatgcataattcataaagaagaaattcaaatgctttttaacatttgaaaatatagtcttaatagcaactgaaagaatgaaagttaaaactatattttgcttattatattagcaaagatgaaaaataattgctattgctcagtaatggtgaaggtagtggcagaagacactctcaagctcagcacagtggttcatgcctgtaatcccaacattttgggaggccaaggtgggtggatttcttgagctcaggagttcaagaccagcctgggcaacatggtaaaaccctgtctctacaaaaattagccaggcatggtggcatacacctgtggtcccagctactcaggtggctgaggtgagagaatcacttgacccccaggaggtggagcttgcagtgagctgagatcatgccactgcactccagcctgggtgacagagcaagaccctgtctcaaagtaaataaataaataaataaaacaaacataaaagaaggcattctgatcctcttggtatgtccattggtgtaacacgaatggtggaccatttggcctccattcatgtgtctaccaatgcaatgtagataaaaattcataaaaagcgaatgccttttgacataacaaatctaattctagaagtttatcctgaggaaataacagaagagtatgtaaaaatgtgtgcataagttgtaattgcctgggtcttgctggcaattaggagaagcacaaatggtcattaataaaatattggttaaataagttctggtacatacctatgtacttctaatgagagaagccattaataaaatagtgtgagcctatttttgcattaaaacatttgcattgaaaaatgactttgagaaaaatatcagatgttaatggtaaacagtgtttttccccctgagtataagaattatgggtgaattttattgtctaactcatatctctttataatatttatacttagaaagtattacatgttatttaattatgtgttaattttatattcataaagagcatagagctatttccaaaaattacatatttccaagattacacacctgcatatctctatctatctatctatctatctatctatatctccctattcattcagcaacctaaaatgaaacagcctataatccaattagtagttatccctagaatttgaggtcacgggtgatttttattttctttcttgtgcttatttatactttacagatttttataatgagatcatatctctcttataatgagaaatgttttaaaaaagcttttaatatctcagtgcacttgcctgacctattttatatccattcttgcatctatttcatttgaagggtcctttggatagcatttctttctccatgtctttcttcctgctgtcctatttaaataatcacaattctgtgttgaaatttttgtatgctttacctaattaggacaaatattctgactcttgcatttgttatcaagatgtacatttttactttattcattattgttttttttttcttaagcaaagtttggcctttagatgatgcatttccaagcctagcatccatcatctaccattatgcttttgactcatctattaaatagtaatgtgtcctccaaaaatattgatgttaaattaaatgactctatatttgtccttggaaaaagctttgaggctataaaatttaccaagcaggtaggacatgcaaaaagagaaatgcatgcaaatgcttcctataggcaggagctcttcaatgtgtctgacaaatctcatctatcctttaggtcctaaattaaacatcacttctctgtgatgcccaccttgactttcccagggtaagctggtgctgacttctccttatgtttattatgcctcttattaaatcttattttaagtagttattgatgtctaccaatgcattagaccaccagataggaaatatggttgccatccaccaacactcttccaacagtccctacctcctcatattcaagcccctgacaaatagatgatgacagacgcgaccatatgtcacttccaagattaggttttgaaagacagaggtttccgtgttgggctgtttctcttggcccactaacctatggaaagctagctgttgtgacgataggcaatgtatgcagagaggctcatgtggcaagagctaataaaaaatggaagctggccacacacatgtgagtgagctttgaagcagatcctcccccttgtcaagccttcaggtattacaggcctggccatcagcttgattgcaaactcataagaaactctgagtcaaaaccgtccgtctaaatggctcccaattcctgaccttcagaaaatacgtgaaacaataaattcttgttgttttcagttttgagttttaggatagtttattatgcatcagtagataactaatccacattggtactagaggtgcagtgcttatgtaacaagaaactaaaatgtgataggactttgaacgaggcagcgggctgtggaaaagctgtaaggattaaggaccatgttagtaaaagtgtaaagtgccttgaacacactgtccatagaagtttggactttgaggaggctgccattgaaggcttcaaggaaaatgggagaaatcctattggaaactggaaaacagagaatctttgttacgtagtggcaaaaaaaagaaagaaaaattaacaacactgtcacctgcagtaatgtagaaagtagaaaatgtgcctgataaactggtgatatagttaaggagatttctaaccagagtgctgaaagtgctttctgattttttttttttcctgttgcttagagtaaaactgcaagaagagaggagaaactgaaggtaaaactattaaataaaaaagagccaggacttgctggttttaaagattcccagcctccccacatggtacgtgatgctaaaattaagaaatggcatctgagcaaagaccaaattcagggcacttttaggaaaacaaggtccaaacattaagccaaggatgcgactataaagtcttttcttaacatctcagtaaacaaagatagtgtctcagaatactgtttagtcagaaaaacctaaagatactaagacaagcttgtccaacccttggcccgccggctgcgtgcaacccaggatggctttgaacgtggcccaacacaaatttgtaaactttctcaaaacattatgcgtggacctttatttttatttttattttttagctcatcagctattgttagtatattttatgtgcggaccaagacagttcttcttcctatgtatctcagggaagccaaaagattagacacccttggacgaagggcttgccttacagatcctctctatcaaccagtagtgctccctggaagctcacagacattgtacctcagtccaagctcaagaaggacctgtttcaaagagatttgtgggtgtggcttttgtgtagtggaattaagcctaaagggattcccagaagacccatggagttgaaagggggttgtgcttgaagaaacaccatcagctggaaagaaaagagacataaagagtacaaaatgcagagaggcctttggaccaccaagtgtcaacaagtaaaaagcagactgagaaaactaactccccaagcacatgttacctttcatgaaaatgaaaggatgcctgagagggcacactcaagatttcaaagggtgagactaaagccatagagaaatattcctaggccttaattagagaccaaatcaaggagcttccatcatttgcttgcctggatttcagaactactatccttgcatacttcccattttcccctttgtgagttggagtgtctatggcagttatcctctccttatcctgcccttgcatgttgggtgcatggggccagataacttgtttctttatttgcacatgcctctatatcaagaagaaccacattcaattgttgtatgtcagagactacacccaagaaggctgatttagatgatgagggtctggacttggaactgatgctctgttgggatgagacttttggggacagtaggaggggtgggagtccttgggagccaaagggtgtcctgtgttaggcagcctccaagatggctccctttgatctctgactcctggactcacagagttgttaatcccctccccatcccacattgtactagggttggcctgtgtgaccaattgcaaatggcataagtgatggtatgtcgctctcaatattagtttattaaagactgaagcttccattttggtcctgctctaatcccgtgctttcctggatccctcacggtggggaaagccagctgccataagttgaggacattcaggcagtctggtggaggcccacatggtgaagcagttccagccaatagccatgtgaccctctagttccaatcaaggcttcagatgatgcagaccagattgacagtttgactgtaacctcatgagatactatgtagaaaaaaactgctgtaggccttagacttctgtacttacaaagacttcttgcaaaattggcttggctggcatccaggaatttggatttaggggaggcctgacaccatttcctaatggataagagtggttcactgtgcctaaactgtaaacaatattatttatgctgagcacttgctttccatatgggagtcttggatttttatatgtgctaggcagagggtgtgtaatgagcaaccctcagtaaaaaccttgggccaggagtgctggcttacgcctataatcccagtgactcaggaggctgaggcaggagggtagcttgaggctgggagttcaagaacaacctgggcaacagagcaagatgccatttctgaaaacagaaaattagccacgcatggtagtgtgcacctgtagtcctagatactcgggaagctgaagtgggaagattgagcccaggaagtcaaggctgcagtgagccattaactgtgccactgaactcccgcctaggtgacagagtgagaccccccaccccaaactctaaaaaaaaacagacaaaaacattgagcactaagtctgtgataagcttccctggtagacagcattttccacttgtcacaatacgatgctggaggaattaagcccatgctgtgtgattccacagcgagagaactcttggaaacttgcatttggttccttgtctggcaaagagaaaaggtgctgattttgctttatattcttttgctataataaatcctagctatgaataatattatatgagtcctgtgaatcctcttagccatcactgaatctgggggtggtcttgaggacctccaacccagagctcctgagctaggagcacctagatcttcctagaccctcagaaaccataggataataaatatttgttatgttgaggcactgagttttggagtagtttgcttcacagcaataggtaactaattctggaagccagtcatttctctcttcccagcatttagtttagtgtcttggaacataggtgttaaagaaatatttgttgagtgacttgacactatttctgcctttgaagaagttcatagtccatttggttcctttgctggaggaatctaaatcctggcttggtattatgaagcaggcttactctcttttttctgtggcctagaagaatcaatcgcagtggcagcagcctgccttaacgttgtcaggttctgccatcttccctgttgaatgagatccatgggtataagaattagtgtatgaccatgcctcttctcttttactcacttcttaggtcctttgatttttattttctctcccttctatgtcatggcagtggtagctattcttactattgaaataaaaacttcttcctgctgaaaaattaattaccaaatgtttcagggccttataagatattaatatttccatatcgagtcttgcctcttactctatcatatgattgccttgaggaaagttcagacaaattaactttccattttacattgcaccccactttcccagcttctgcaaactgtcttgaaatagactttatagaaagataggaaccatttccactaaaatgagtttaatgtagggaaaaaactcaaagtatacactgaaagtagacttctttgagtcatttacagttaaaaattattttaatctaaaggtgtatttgagtgtgtgcacaggtatacacatagaccgccccccaccccatactcattcctgtggcacacttcttgctagttgttggcactgttaaataaaaattacagggggccatcgttttggactaagcttctgcacttggccccaacaaaccagattgaaaatcaaaatggagtcactcatgctaaagttccatgtcaccttccaataaatcaggggaggaagataacaatctaattttccaaacagggcagtttcaatcttcaatcagcctgatgaagttctctctgctttaatccttacaacaaaaagtaacctgaaggaacgtgatgttaactagatatttttttctctattgttctgttttcctgttcctggattacaaagaaagtaactatgcaatgaccaattgcttttgttctgtgtttctgctttctctagcccttttctgcttacaaagccaaccatctctgcccactcattgcagcacttattaatggcaaaaccgcaatacttttgcaccaaaatatttaatggaatgaagtgttgttctattctaaaattgcaaataaagctacttgagctcctgaaagtaaatttgttgtaattttgtcctttgacagatccttttcctcctctttgagtctccttccggttcagcagatgaccttggttatgagtttcatgagaatcccagggtgatctaatagaagctctctcatttatcttctttccatctaattttttacaatttttattgttttttcttgtgtcagagaatcatctacctttgtttcaaagggttctagtcctgctttcaatcccatatacttgggcctgatggatctttcgaaagtgaaattgtggcctcatgatggcatcatttgaaagcctccgatgactgtttcccgaggagggtgaactttctctccttacctgctcttgctttcctgcctccattttgctcatggcattcccttgaattaggttctatgagtggaatacagctttgaaggcaattccagagatccaacaaaaacccaggagattggaaggaattcatatttgtcaaaaaatgtgtagctcaaaaatataaaaaaaaaaaataatgcaaataaaacccaatagagtataacaactatttacatagcatttatattgtattaggtattataactgatctacagatgatttaaagtatagaggagggtggcataggttatatgaaaatactacaccactttatattaatataagagacttgagcatctgcagattttggtatcctctgggggggtactggaggcaatcttcctgggatactgaggggtgactgtaacttattttcagtactttggtaatagtgtatttaacggtctattgtttctcagggtttgtggatgatagtccattaggatctgaaaataagatattagaagttctatttacttttttttgtttttctgaaattttaagtgtatatgaagttaagggaatacatgtaattttgaaataattaaatattcatgtttggaaatctgttcaaatttttgggtggctgggaacacaaccaaaaagatatgaaaaccaataacaattatgtatcagtaggcattttataaatagtctttgatattattttggatataagtgatttgattggcacttctcatttaattgcttattaggtgggtttctgttttgtagagaacatttaaaaaaaatttagacaagcaaaagttaataaaatcacctgtggtatgaccactcagaggtaagtataatgaatgttttattgtatcttctttgcagctagttttctatacacatagacatgattttcttctaaaaaaggaaagatcatgatgtatttataatttgtaaaacttttataccttgctctttgaactttaaagaatgtcatgaacatttccttagatactaaactctttccccatatattttaatggccttattatatgaacatataaaaataatttattttgataccttaattcatgtgctgttggatttttaggctcttgcaccattttccccacttctctgcttgctgttataaacagttctgaaaaccagatgctgttagccacaccatacatatctgtgatgtttcctgacaagattcctaaaagtagcaccttcctttcataggtgaggttttacctctacctttgttgtctgtctctaaggcaaaggcaattttgtgtaatggtgaagaactcaggacagaatttgaattgtgcctcaaccagttactactgtgtgactctgggctagttgtgaacctctctattcctcatttcccctcatctgtaaactgggggaaacactaataccaacattgctgggtggttgtgagcaaacaataaacaaataatagtgtaagcaaacaataaattttagcaattgtttataaggtatttctcttgtcaagtaagccaagttaatcatctaatggctcctataaaataaagcatagggccaggtgcagtggctcatgcttgtaatcccagcactttgggaggctgacgtgggcggatcacctgaggtcaggagtttgagaccagcctgaccaacatggtgaaaccccatctctactaaaaatacaaaaattagctgggtgtggtggtacgtgcctgtaatgccaactactcgggaggttgaggcaggagaatctcttgaacctgggaggtgggggttgcagtgagccaagatcacgccactgcactccagcctaggtgacagaacaagactccgtctccaaaaaaaaaaaaaaaaaaaaaaacaacaacaaccataaaataaagcatagttatagtattcagtaaggtgaatgacacattaatgactccattttccatttgatcagttcttacatccaggaaccatgaacacagctatctcaacatatggtagtttatagggatagtctgtaatcttgcaaatttaaaaggtaaataggagtccttcagtaggcagattcatatattgacaaatgaaggaagaattagtcttgttagaagaaacttgccatttcgtttgtgaacaatgtagttaatttatcacaggctcagtgagggcaaggatggagctatttcactttactatttgtgtacagatccagctcttgggccgtggtaggcactcagtgaatatttgtgaaatacataaatattcatgagcaaatatatctatactttgttgaatgtattgcaatgtatgttgtaaacataatgaaggctttgtgtgatgaaccgacaattgacaatgaaattattgtctgcaaagtgggctggggccttcaggcttttctcctgattatagattcagaaataatgcaagaggctgttgctcaaagtgaatcccttactccgtgctggtcgtgttctttaattcatgtgctgttcccttgtgtgtgctcagtccttattgcagctgctgggtctgagctcactgtgaaaatcgtgtttcctttctgccgacccatagggctcagtgtttgattaataagtttcccattttctgagaaaaatacctaggtaaatcccccttggacagcacaaggatctgcagtaatttacaaccaccgtgtgagccttgtgttgaatgacatgctctttgtaaggatatggcataatttataatgctggccccaacgtccactcctagggcgttctcagtgcagtgccttgactctgatattggataatgttgacagttaagagaggaatgactttagttgctgctgctgaattaaaaaagtcagacacacagtctaaatggattttgctgtcttcaaagtagtgaccttgggatagatagaactctttgatgcttccattgatgttgctattgccccaaacatttccggaatcctttaaaaattacctttaaagcatgtggcacattcttgtgaatatttttgagtctaacaaatactcattctttgtatgaggctttgatttttggaaagagtgaagagtcactggcatcaagtgcaacaactgaggtgggtgatgagggcagagagtgctggttttgtttagggcaacatatggttttagaggccttttaataatgtcatgagacttgagcatttgttctaaacatgatttccttttaaaataatgtttgaaatgatgaaatagtccaagcctacagaacacaacattacatgccagataggcacgttcccagcatggatgttaaacagatgttaacgtgctgtgtttgtttgcgtgtgttctttcatcttgctctccttccctgttttttctttgaaagacagtgttttagatattcctaaacaccccccgcttccctccatacccgtctgccttctcccctttttccatcaatattcatacttctgccaatgttgccatgcttcattcccaggtgtgcttgtaccttttgaggaaatgtttagaaatttaaaggaattatcttgtgtgtgtccttctaacattgtctttgaggtttatccatgttgatttgttttaactgctgttttagtccatttgtgttgctataaaggaatacccgagactgggtaattaataaagaaaagaagttcatttggttcctggttcttcaggctgtacaggaagcatggtgccagcatctgcttctgctgagggctcccagctgcttccactcatggaggaaggtgaggggaaaccagtgtgagcagatcacatttcaggaggggaggagagaaagagagagaaagggaggtgccaggctcctttcaacaaccagctcttgagggaactagtggagtgaattaactcattactgcaagggcagcaccaagccattcatgaggaatccgccattatggcccaaacacctcccatcagttccaacctccaacattggggatcaaatttcaacatgagatttggagaggacaagcaaaccaaactatagcaactgctccataggattccagtatatacgaataaatcaagagtcttcatctgttcacctgagagaaagttcagatgctttcaccttttttgttattacaaatagtgatacagtagtaactgtgtgcatatctatctagaaatatgtactagaggttgtctagagccagtactcagaggaaaaatggctaggttctagaacgtgcacattttaacttagtggacattaccaaattgctctccaaagcagttgtaattatgcttccattggtggtttcccatatcctcttagttatcagatttttaatttttgctaatccgattggcacagaattgtatctcattgttttatattgcatttctctgcgttctagtgtgattgagtgtctcttctgtactcagtggccgtctgagtttcgtcttttgtgaattgcccatttatattccttgctagtccttctattgccattggcctttttattaatgatttataagaatcatttataatctagtattctttgtcagtttaatgggccccaaatatctttactactctgtggcttatgttttgactttttatgatgtctctaattaaacagccgtgctaaattttaatgtaatcatatttatccatttctcctttgtggcttgtacttttttatgtgtttttaaaaagaaatactgctctatcccaatgtcataagaataatttcctatacattcttttaaagttttcaaatgtagtgtttcacagacacttagaattgatttttgtgtatatgtaacattggaatccacttttatctttttccatatggatgtccagttgtctcagttacatgtatcaaatcttttcccactgtcatacaccacattcccaaacacgtgtgactgtgtgtggcttctgttctttattttatttttatgtttatttttattttttgaaacggagtctcgcactgttccccaggctggagtgcagtggcttgatctcagctcactgcaagtgctgcctcgcgggttcacgccattctcctgcctcagcctccagagtagctgggactacaggtgcctgccaccacgcccggctaattttttgtatttttagtagagatggggtttcaccgtgttagccaggattgtctcaatctcctgacctcgtgatccgccctcctcggcctcccaaaatgctggaattacaggcgtgagccaccgcgcccgactgttctttgttaatggtgtgtttgcttactctggctctaccctattttaattaccttggtcttataggtttgggtagtttaagtttcacttcagttttcttttttggaattttttttggctattctaagctcattatactttaaactgtattttaggaatgtggaagccctattgggcttttgttggaattactcagatggtttacagataaatcgtaagaatttgctctcttatcctgggtcttctcatctacaactatggtatagctatgtttatttagttctctttttaggtctttcagtagaattttgtaatttttgccatacttttcttacatatctttgttaaatgtctttgtaagtatctcatttctttctttcatttgttcctttttttgagataagatctcccaggctggagtgcagtggtacaatcatagctaactgcagcctcaaccctcctgggctcaagtgacccttgtgccacagcttctttctaagtagctgtgactacaggtgctcaccaccacatccagctgatttaaatttttttatcccacattttttgttgctgtcaatgatatctttttattgtatcttttcctattattgctggtgtataggaatgttatttttgtatatcttgctgaactcattaattttcatggtttagatactcatacattatgcagacagataaaatcttttaataataatgacaggtcttttccttttcatgttatgtggcattcacttctttttcttgtcttgatgtactgacttggactttcatgatatcacctgtttttgttaataaagttttattgaaacacagccacatccatgttgtctgtggtaccattgtattataacatcagagttgaatagttgcaacagagactacctagtttgcaaagcctaaatacctgccttcaggctctttacagaaagtttgcctatcttcacaaaacagggttgaacagaggcagtgatagtaacctttcttgtctcatccctggctttaaaaggagagcttgtgccaccaagaataagtgctgcttctgggttggttgatgtgtgccttttattgggttaagaaaatgtcttttttttttcttcaacttttattttaagttccagggtacatgtgcaggatgtgcaggtttgttatataggtaaatgtgtgccatggtggtttgctgcacacatcatcctatcgcctaggtattatgcccagcatccattagctattcttcctgatgctaccccacacctcacaggccccagtatgtgttgcttcctcccatgtgtccatgtattctcattgttcagctcccacttataagtgagaaaatacagtgtttggttttcttttcttgtgttagtctgctgaggatgacggcttccagctccatccatgtccctgcaaaggacatgatctcattcctttttatggctgcatagtattccatggtgtatatgtaccacacaagaaaatgtctttcttagatttgtaggaagtcttttcttgtttgttttgttattaaaaaaaatcatgattgaatgttgaattttatcaaatgtagttttggcatctgattattttttctctcattttaaacatacgcaattatattcttttgaatttttctattatttctagtccttggggctagaatccgcccctttgatgtgcttttataacttgtgatctcagtgggtctcattttttctgtaggaattgtctgcagcatggattgtgggaattttgctctggcattttccctgcccattcattagtccaggaccaatttttatgtgaatttctcagattgggcatttccggaccatataggaagcctaaatttgtaccgccaaaatgttccagaggcggtggtctggagtttaaactttgcaagggaaggcttttattctcctcccttggagacagacagaaacatacgagtctctttgtggttgcagctctttgaggagcctcactcagggcagcagccttctacctcgggcagagcccacagactttgcctgtttctcctctgtgctagttgaaatctaaatgcctactccccctggaccaatacttgtttctctccttctccctcaccatgatcctgtcactctctaaggggagtgaatttatgcttgcttctggttttagttgttgctttgtttctggcacctggtaatttcttctttcttattgcaggttcagctatgaatttaaaaatatatataatatttccaggtgcttgtaggaggtgagtgtgaatgtgtgtcttctcaccctcttgctgaaatgagaggctgccctctaaatgaaatttcaatattgaaaagataaaacccaaataaaacaaaaagcaaccccccaaatcagctccctaaccatgagccaggcagcacgtgaagtcctttgatattagctcatgccattcttatagaaactctgtaactctttttaagtggagaagttaagaaactggcccaatcccatgtcagggcagagccaggccaaaaacccctctgttttattggctgttacctcattttacatgtctgaacagtaataacagtgggtgtcaagtgtacctttcctaaaggtaactactacaaaggtcaacactattttccatctaacactcctaatatatttttacacattagtctcacctggtaattctaagatagaataatgatcatgcttgtctgtgagaattagcaatttttttcatggatttaagttcaagaaaaatcagaaattagcagttcaggagttttcaacatttgtaaaaaggcagatgggtgcaccattagcacttccttctgagtgaggtagatctccagggaattaataggaacccgttgttttccatgttggcaagatattagagaaatatgtcttactctcaggtttactaagacatgttttaaagataatactgtcatgcatgtggcttatggaaggctatagggatgtggatttttatattctctctagatttatttgcccatactctgaaatcaaggcagacggtaaaggtggagtcagtggtcattctgtttttttgattaggggtttatagatggctgacattttaatctcagttaatgactggggatggactccagggtccttcaccacagctcacccttgtttgtgatctaatttagcagcatcttgatttgaattgaaagacagccttgggaatattagctcggcccttgtgagagcattctggaatgctgcatattacctgatgctacctgagatgtaggtggttgggcagtgacagcctctctgagccctgacctgtcggggagaggttgagaagtggcaaaactttgattctaccagctgcaaagaccgatgtcaccatgaagttatattaatgactttgacaagaattttctcagtgtacagtaggcatatttgctgaatgagctgatcttgtaatcccagtatatctggagtagtcaattatgaattttctaattagcttgatgtttggtctcccagctaagtgagctcttgtgaactctgccagaatctggatttccaaattatctgacaggaggaaaggaaaggattgggccaaagtggccattgcaagtcagtttcttataagtcaaaaatttaatcagaccaagtgcctttcttttctgtgttcagaaaatacccattctttgtttctcacaactgttaacctgtcctaggatgaactggttctgcctccctttgctgtttcctgcattagtacttggaaaagcctgtggctgcatggtctgaggtgtgaccttcatggtgggcacaccttgtctctcttctctgcccgaaaggaggccactgttttcttgtctctgtaactgctctgtgaattcttcttcttcctgatgactaagtgtgactattctccaaggtctttatctttttgcaagttttctgagatcttcaccaataagcacgaatacttactgaatatgttttgtgtgccaggcactttttaaagcactttaataacaataactaatgtttattaagcatctactgtgtgccaggcactgcttttggtacaaaagatgtgaaataaaccacacaaagaccatccctcttggaacctatgttttattgagatccagccaggtggtagaacacatcagtaaacaaacatagacttcagcaggtggtgacatgtgctctgaaggagaaatggagtccgagtagagagtgactatgcatgatgaactggtcaaggaaagtctgtctgataagggggtatttgagaagagcacttctccaaggaagtggaggagcaagcccagtttgcttccaatttcttcctccttgtgtcttgccaactgggaccaagcatgcctggcgtggaacaaactctttctgttctctgctgatggagccattttctcccagagcccaggctctaggtctgaaccctgatccttctcttcacttttcttttctaatggccagacgtctttgtccttcctttgaaatagaagtgacagcaaaatcttctttcccacagccgttgtggataggaagcctctgcctggctgagcactttgctactttatttctgaattcctgtgccagcctcctcaatgatcttagctgctagtcttgctcttctcacccatctgtggccaccaaagcactggaacacgtaagccatcatttgagtgcttactccataccacacactggatcctcacaacttgctgatgctattacaatatgttttttttcttttttcctttttctaactttttttttttttttttttttgagatggcgtttcgctcttgtcacctgggctggagtgcaatggcacgatctcagctcactgcaagctctgcctcctaggttcaagcaattctcctgcctcagcctcccgagtagctggaattacaggcgcctgccaccacacctggcttatttttttttgtatttttatagagacggggtttcaccatgttggccaggctggtctcgaactcctgacctcaggtgagccaccctcctcggcctcccatagtgctgggattacaggtgtgggccactgcgcctggccttttttttttaaagttttatttaggttcaggggtacatgtgaaggtttgctatgtaggtaagctcatgtcatggggagttgttgtacagattatttcatcagccaggtgtattaagcctagtacccaataattattttttctgctcctctccttctgccacccccaccctcaagtagaccccagtgtctgctgtttctttttgttcataagttcttatcatttagctcccacttataagagagaacatgcggtatttggttttctgttcctgtgttagtttgctaaggaaaatagcctccagctccatccatgttcccacaagagacatgatcttgttattttttatggctgcatagtatttcatgatatatacgtaccacattttctttacccggtctgtcattaatgggcatttagattgactccaccatgtctttgctattgtgaagagtgctgcagtgaacattcatgtgcatgtgtgtttgtggtagaatgatttctattcctctggctgtatacccagcagtgggattgctgggtcgaatgatagttctgcttttagctctctgaggaattgccatactgctttccacaatggttgaactaatttgtttttcttttacaaagttttttttcaagactagtcaagtacactagtgagaagggagaaaaaagtagagcaaggagtttgatctgtaactgactgaacaatcaatggagatacctcttacctttggaccagttgctattacaattatgattcccattttgcagagaaggaaacagactttcctatggtcacttgctaatacaggaggtggctaagccaggatttgaactcaggtccaatggaatccacaggctccttccagccaccagaccaagcttcacataccctgctgtggagcaccatggagaccctggttcgctctttcactctttggctggctcaggattctttcatgcttcctattatcagtgggataaaagtccaaatgttctggaataatatttgagatctttcatgcctggaccgtacttcacctgtcttctggttttgtatctgagctccctcctgtaacaacctttgctgaacatactcaaatgtatcatggaggtaaacacagcgatgcctacgtttatacagtgagtgctttttctttccctttacctgaactcactctttcttcatgccccagctcagactccacctcctctcttaccttcgtctgtgttcatctatacttccaaactctcctgtcagttagaaggcgtgtcctgcctgtttcatgtcattcctaacatcagaggacatagctcttaaagatcttattaccaacttgccatttccatgaatttccttagcccttgatcctaaactattgagaaagcttacatatccaaaatgagtctaacttttctaagcaatggtcttgggagatgtacatatttcactagggcttcctggagctggaaatatatttggtggagctcctttttctaaattgccttccggctacccaagaaagtcaatttccttctttaatagctgtgactcatttttggactgatgatggcactattccagttcagtcacctatctgagtcatcagtagggactccatttaaaatttgactctttccctaaattgaatcaattctcaagggattaaaactagatattcactagaacattccccaggaaaatttagaaatcagagttctgaaaatgtttgctcaaaatgtcaaggggtgaaactgagagaaggcaactggaacgtttctcttaatccactgtccctcacttacctgcttggcagaaagaaggcgggggaaggaaagcattagaataaaaagagaaatgttcagaggcagtttgagtcatgaggaaacagctaaaacttccaaaacagaaactgaatgacatcctcttcctaattcaagccttcctcaggggaaaattgaacagaacatttcacttgataaatggaatgagacctggtcctggagtatttggaaagatgaatgacaggcaggaggaatacagtggaagggaatgccatttatttacaaatgcatctcctcaggtaagggaggggatttcacagagagagggaggtggaaccgcagagggcttggtccaagttagaacatgaacttactccttgctctcgtttctgggggagaaagccatgtatacctccagcactcagaagtgctcgcgacaatgagctcattgggatttgctactcaattagattctgctttgtacatgtagcacttagcactgtgtctagcacataacgaggactcggtaaatatttgttgaatgaatgaaaaataattgctgcctgggagaagttgagaggctttgtaattctgccctgtcatttctggtagtgaccaccaggtggtgccttcttaagaacaggaggaaataaaatcactccagtgaacacagaaggcttggggttgactcagaaccttgcccctgtgcacaccgtctaacagtacatcacaatttcttgttcctaacgttgaatgtgcacacaggattcagatacgtggctggcactgactttctttacttgagtcaaggtcaagtaaggttttcatcgttggctgagctctgggatttaaaaccagttctatcccaggccaagtgggtttctgttgttcctgcttatcccctgtcctccaggagaacacatgctgcccttgcttccatattttctcagaaattcgtccccagcatcactaatggattcatatccagctcttgcactcacgggttgaaaaacttggtacccctgtgtattttaagcagctacctgatgagtacctatgttgaaataggtttctgtggtcgaaattctcagaaaagtcccacaagatgggcataaatgaacaaactagctcagcaggcttaggtggctctcccaaagtaacacagataagtgagttggcagagaggattccagcccaggacagtctgcccttaggttgtgctgtgatctctattctgttttatgtggagtgagtttaatgtatctgcattaacgagatccagggacaaaaatataacaaaattcaaggaatgtgaagcaatgtcctatagaaggaggacagttcactatcagtgtgagccaacacactcagctcttggcagttttcagacagttgcaaagaaatacttagcctgaggcttcttcgtgcccataaacctaattaagggtactagagattctgattggcaagagctagggacagagaggctgagtgagactatacgtgtccctatgtttctgtatataaagacagaaagagggagtttgagagagcgaatgagttaaatcctaagtagacctggaaaactatcattttgctaggactggacttaagcaaaacagcagagcaaagttcagagttaagccagaactttgccttgaacctcaggcccattgagccctctgctccaacagggccaaatcagcatccaatagtccccttcaagttgtatctgtcccgtgtctcggtgtttctggtttctgttatttggtaggtcacaattaattatacagggttaacaaaaatagattaacataatgtacttgccgaatagtgtttctttgggagaaaatgacttaactcacctaaaatatctccaggcataaaagatattaatgttgggaatatcaggagtgattaacctctgagagaggttgaagggaagcaaaattggacaggaaggataggaggaatggagataggggatttcgggtggggagagcctcttagagtcttttatttcagaccttactctgtgcctttccatagggccaagtctgatcatcctctttttatggtctgaatatctttgagcccttcagaaactttcaaattagtaatatacatgattaatatttttgacacttacatgttaggaactagacattatttcagtaatcctcagaggagccttgagtggtagatgctatcattcttccccctttcttttaaataatgaaatagaggtttaggaagacccaaagctagttgatgtcagagccaagatccaaagcccatgtgtggttataaagccgtgttcttaccactatattatgctgtaagaataaagggacaaacctcaaaataaaagctttcactatcagtaacacagcaaaaaacaattattcattcaataatgagcaggatgaataaaaacagacaaacctcatcacatgaagttgaacttcagagaatagtcgaataaaaagttccctcaaacttaggagaaacctaaggctatgaaactgattgtttcatagccttggtaataagtagccatcaggggccgggcatggtggctcacacctgtaatcccagcactttgggaggccaaggcaggtgaatcacctgaggtcaggagttcgagactagcctggctaacatggtgaaaccctgtctctgttaaaaatatgaaaattagccgggcatggtggcacatgtctgtaatcccagctactgaggaggctgaggcagaagaatcgcttgaacccaggaggcagaggttgcagtgagctgagattgtgccactgcactctagcctgggtgacagacagagactccatctcaaaaagaaaaaaaaaagtagccatcagaacccatttaaaatctgttcatttggtcaacaacaacttgtcttagtgaaagttggttttaaaactggcagaactgaccagtgtcaaatccttacttcagcccatcagggatgcagtttccagtaaacatctctctgagtgccagccaatcaaagaatcaattacagcctcagctgagcacccacgtgctgtcaacccacgtgtgcctctgaacatctcacaaccacagagctccatgctttcaaagccctctaagccatcagccatctgtcctgctcacagacactgtttggccagcatagctctcttctgtgatgagcaatgtattcagccttggagttctgtgtcagatactaagtggtgatctcattgttatttgaaaaaacaagcacacatcagtatgtatgtagtgtatggctacagagacaatagcacaggtaagaggttgggtagggcaggtgctagggggggctactttggatgggaagctcaggagagcctctttgtgggtgcaaggtttatgaagagacctatatgatttgagaagagtccagacattcacagatctaggcctggggcttccaaaaagaaggaaaggtcttaaggtaggagaggatgcctgcgtgtctggggaaggagtagaagaggaggctggagaggaaatgggtggaggctgatccttcagggccttgtgggtcatggcatggtcaggatttgggattttgcttcaagtccaacggggaggcaggaaaccacccagggaaggactatgtcctctgctttaagagagagagagagagagtgtgtgtgtgtgcatgtgtgtataatatacacttgcacatatgtgcatattgaaagaaaggggatggaggcttagggtcaggagtgcctcttagagtctcttactttataccttactgtatatctataaatgcacatacatgcatatatacacacaagttttgcagttaggttcaaagatcctgtagatctagaagaatgtctatgacattgacaatgtgagtcagtacaccctccactgtgtgctaccaaatctgcccaccctcttccactgggagtcccataaatgaagtggttttactaccctgttgtagcccagtgacagatgatcagtgatgtcaaaagcgtgattctggagaggttggtcactttgttgcaaagctgctgtatcatttcaggtacatagtctgggaggtacagagtctagggtcagagtagagtctcaagccattgtgcatgcctgcccaagacagagtggagttggtctactcctgaatatattaaccattttttcccttagtcattacatgtaaagcttcatgtctgcatttgtcagttatgatttatccggatcacctttcttacagaaagcggtagatgccaaccagaagactggaataggcttccttttatctcttttgcacagttgtgtcttcggtgagatgacttgactctctgatgttgagagtgtttttgttaatttttgaagcatgatctcagttggtttaggatatgaatgccatacacactcattgttttcgtttggggactgccgctgtgctgggtgactgcgtgtttgtgctgctggcccttgctgacactgatattggatttacaaagccaaccttgcagttttgtgtgggcaggtaggctgcctttaatttgtggttgctttgcccttctgaaaacacgaacttctatctggttggaagtcattttctttttcatcaatctcaactactgaacctatttcttcaggcacatctccagactgccttggatatttcgaggatatgttctgcgtgttcacatttgaactgcagcttggtttgcagacaccctctccttagattggcagctgtttgtggaattcctgagtaccaattacatccagtagcaggaaataaaagacaaacaaggaactagtagagctcaaggtattctttcatccttcctccttcttagctaatacatcttacagttagctctgaaaggagaatttatttaaacatactaaacactgtgcatagtgactcttacatcttttctggtaatagcatgctaatgctatacttcaaagtgcagtgaataagccctgtagagaaatatcctcatggtatggtttcaaaggacaggcatccttctggaacatattgttatcttaggtttttgttttaaatgtcagcacatggagaccttattctaaggctgcgtctgtgctccgctagtgagtatggaaggcttaggtgattcatggtgggaagttgaagtaactagagaagacttggtgctgtttggctttagtgaaatttttagaagctgtagttgaaaaaccaacacagattggccctctgtttgttgcttttggctgtctagggactgcaaagtaaaaaatgacattttcttgatgtctttctgacagtttctcacctgtaggtcaagtcctaattgaaatatgacataaatatttggcgtcataaaagcagaatctccataacacattaggtgatttctagagtaatgctcacttttattgtttgggttccattgatgagttaggcagggttatattttaagaattttcttacatcaggaagagtcaacagaggatggataacatattttgaacgtggacattgcttgtaagttgcaggacacttgtaaacactattgagtgtcacctatagcaggaaccagtttttctttatccctcgttctgtgacagctacctgggttctatgttggagccccgtagtatagtttcaaatgcaatagccactgcataatccttgtcacccaaagactgcagatcttgacagaacttgtacaacagtggccttgctgaggagtgatgtacatttcttttgtcatttggccacataagaaaactgcagccatcactgtattttgatgcatcagactctgtgtcctctgagtgtgattcagctgttggatttcttgattatgaaagtatctagagtacctcatgttcagtgatgtgaactgctatgaaagttccctccgtgtattctgctggatttcttaagttatatcttcacagagagggcttgcctcttatacagtctgcatccagcacccataagtactttcctttgctgcaggagcaggaactgaacccaactgtggatggagtgggaatgtgtgttctgattcctgcttattagcggtaggatgtgataaatatgttccaaagcaatgcctggtagaagtgttcccctacctgcatgtgacaagaagcattttcctcccttcatttggatagaggaagggctttggataaggaaaaaaaataaagaagatcttggaccttaagctggagacaggaaggtcaagtgctttattttttctgtgatgagaaccagctcatttgagaactgaaggtgaatactgactgtcatatttaataagtagtgatggaatttgcatttcttccttgaggtcagtagtctgctttcatagatagaacaggagtttaaattctgagcaaaatatgcaatcttttctctttctttgattcttatcctgtcaattatctcgtcattctacagaggactaaaaggtaaagagttctaagatcttcgcattgtctgggaagaagtggaaatgttaatattagtctttaataagttattaatgacacatattataattgttaggataactcctaaaaggatagtgaagagcatataacttccatattaatggttaaagatgtgccaaacaatagcaacaaaggaggaggaaaatttgaacattgggataaaagcactgcacacagtggtagatgtaaacacaaatatttcagcaattacattacatataaatggactaaatgatgcaattaaaagataaagacatggatgaaaaaacttttcaggaggcatatttaaaagataaggaaataaaagtttgaaaaaataaaaggatagaaaaatattatgcaaatactaaaggaaagcagctgtaggttggctggtatcagtgttgatcatatcatggacatggttgattatggtatgagtttgtgccttatgttgtaagtattcacaatcagagtttcttatagttagaaaaaattagatgatcaaattataaattactagaaagatttcataattgttaaggtgtaggctttttactgcacctggagaggcctttcagccatgatgtgaattatgtaccattatgtaagataagtggagcgtaaatgctttgttcaaacaattataatgtaattggaaacttcttgtgttaacaatatcattatcttaaaggtgaaaggggtgggaagaatgtggtagaaatcaagttccctggggaataggctttacagccaaaagtaaagtcattttttcctgaccagtgacttagcttaaaacaggtcaatgatattctttaaataaagcaatatttaattggattcatttgcagctgatatggattctggggcttgatagcacttacatattaagctggaaatctagaaataagaactttagcaacaatttttttttttttttttaggatttgagattagttattaataacacaggatgcaagactcttaggttgtagttgtgggtaagcataaatatatactgaatagattcagacattggccaagtagactcagtttttttcaggagatcatgttcattcaaagggataatttcttctttctgaaaaacttctattttgaaaatattaaatgatagaattccccctgaaattttttattgtgctgtttaaggaatggtattttacccattagtgataatccatgaatgcatgctatgaatggatacttaggaaacatttcctgcatgtccatggaaagataattatttttaatatttgtatggactgttaggcttttttctgtgagtaagatgtttttaatgtagaggtgtacttatagagtatacgatttttattgtattcttttaaatggactatttaatataattgacatatttcccatggagtaaaaacactatttagatgcttgtggtaacataactcctcaaatcttagtgacttaagacaacaaaggtttattacatggataatgtagatcaacaggaaactgctcattggaattgaagactccatgctgacactgatgggaggctccatccatgcacaggcactcacagtcaccaaagcagcataggaaaatatggtaatccttgcactggctgttaaagcctttctagaagagaaataacacttgcttatatttcattgaccaaagcaagtcatgtggccatgctaacttcaaagaaggtgggcaagcgcaatcctgtatgtccaggactggactattagggaacagcctaattgactactccagattgctactgacaacacttttttaaatgattgggataatactccaataaatgcctatgccatagtttacagagttagcccattttaatgtttgcagtgccaatagtttattaataatgctgaaatggacattttggtatagtcaccattcctccacactgctccttttctggggtacttaaactaatcctagattaagtctcctgttgtatagtttaatggactgctgtatgtctactttgtagcacttattttctaccaacacgctataaatttcatatagagaccacacctttttttcagtgctgtgtctgctaaccgttacataatagatattaaataaacattaatgaaggaatgaattaattggggaagtgggaagggtaaattggtaaaactactattaaggctttttctatatgtttccaaattgctttccaaaagaattatagcaaattcacatgtgagtcagcagtggtttatcagtttaccacccattgccaccactggttattttcctttgctaaatggaaagtcaaaataaataatatctcaatatttttagcactgtaattggcatatctttgattatcaataagactgggtatttttcatacatttggtttttgttattgtgataaaaacataacaaaagttaccatagtaaccattttttaagtgtacagtaaaatataactatgtgtacattgttgtgccacagatctctggaaacctcattttgcaaacctgaaactctttaaccattgaacagtaacttgtcttcaccctcctccaacacttggcacccaccattctactttttatttctaaaatttcgactacttaagtatacctcatataactagacttatgcagtatttgtttttttgtgactggttaatgttacttagcataatgttctcaaggttcatctatattgtagcttattgccagatttccttctttttaaggctgaataatattttattgcatatatatatgtatatcaaattttaaaatctgttaatccgttgacatttaggttacttctacgaacttggctattgtgaataatgctgtaatatacatggtgtgcacttatctcttcatgattctatttttgattcttttgaatatacagatgcttgacttacagttacgtcctgataaaacccatcatcagttgaaactatcataaggtgaaaatgcgttcaatacaactaaccaattaagcacaatagcttagcctagcctaccttaaacatgctaagaacacttacattagtctatggttgggcaaaatcttccaatacaaagtcaattttatagcaaagtgttaaaattgtcatataatttattaaatactgtaccaatagtaaaaaacaaaatggttgcattggtgggtttttgatgttggttatcatgacaaggtctctcactctgccacccaggctggaatgcagtggtgtgatcacagcttgctgcagcctcaatcccctgggctcaggtaatcctcctacctcaacctcccgagtagctgggactacaggcatgagccaccatgtctggctatttttttttattatttgtagagatggggtctcactatgttgccccagctggtctggaactcctgggctcaagtggtcctcttgccttagcctctcaaagtgctgggattacaggcatgagtcagtgtgctcggctgatgctttggttatttaccctcatgatcatgtggctgactggaaatggtggctctttgccactgccccgaatcataagcgagtatgttactgtatattgctagcctgggaaaagatcaaaatttaaagcatggtttctgctgaatacatatcacattcacaccatcgtaaagttgaaaatagtaagtcaaactgttgtatgttgaggactgtctgtatatctaagggcaggattgctggataatatggcaattctacttttactttttttcagaactgctgtcctgttttccacagcagctgcatggttttatattctccccagcagtgtacaagggttccagtttcttcacctcttcaccaacacttggtattttctgttttgttttttgtttttgtttggttttgatagtggccatcctaacaggcatgaagtgattatggtttttgattagcgttttcttgatgtttagtcatgttgaatatattttcatgatgctcgttagccatttatagtatatcttctttacatagatgtctctattcttcaagtcctttgcccaattttaagattggtttatttgttttgctgtgtgaagagagataattttactccaatttggatgccatttatttattgcctaattgcttgggttaggacttctagtactatgttgacgagaagtggcaggagtgggcctctgtcttgtttctgaacttaaaggaaaagctttcagtttttcaccattaagtttgatgttagctgtgggattttcatatatggtctctgttatcttgaggtaatttctttctattaatgaaattttttgtgtgtttttgtcatgaaagggtattgaattcttttcagtgcttttttttttttggcaccaattcagtcatgtggtttttagccccttattaatgtggtatatcacattgattgatttttgtatgttaagccatcctatcattccaggaatatatcccacttggtcatgatgtataattactttaatgtgctattgaatttggtttgctagtattttgttacgaatgtttgcatcagtatttatcagggatccttgtggttttcttgtagtatctttgtctgctttaggtatcagagtaatgctggcctcaaaaaaatgagtttgaaaattttccatctttttcaatttttttgtaagagtttgagaagaagtggtgccaattcttctttaaatgtttgatataattctccagtgaaaccatctggtccggggcttttctatattgggaggtttttgattacttacttagtttcctttccagttaccatattcccctattatctgagagttcactttctgcagtttcaggtactggcagtcaactgcaatctgaaaatattaaatggaaaattgcggaaataaacaataagctttaaattgcatgtcattctgagtagcatgataaaatctcccactgtcccatttcatcccacccagaacttaaatcatccctttgtccagcatttctacgtatacactactcccccattactgtataggaaaatacatggcatatagagggctcagtactattcagggtttcaggcattcactggcggccttggaatgtattccccatgtataagggggaactgctatattgctatgttcagattgtttattactttatgattcagtcttggtagatggtatgtttgtaggaatttattccttttagattatccaatttactggcatatgcttattcatagcaatatattataatcctttttatttggacatcaggtataatatctcctctttcattttgatttttgttatttgaatcctctatatttagtctgaggatttatcaattctattggtctttaaaaaaactcaatttttgttgtttttttctattatttttctattctctaatttgtttatttttactctagtctttattatttccctctttctcgcaactttgggtttagtttgtttttctagttccttgaggtgtaaagttaggttgttaatttctttcttccttgttaacgtaggtatttactgctataaaattccttcctagtattgcttttgctgcatcctatatgttttgcaatgtgaatctcaattgatagaggtttatttagccaaagtttgaggacatgcccaagaaaaacatgggtcacagtagcatttgtgccctgtgcttttccaaagagcattttgggaacttcagtatttaaaggggaaatagcaaaaatgaggctctgattagtgctcagcacatctacattttatttatttgttttaacttcttaaaattttactttttaaataaacatatggtaaaattgacgttgtatgtgagtacagttctatgaattttgacacatgtatacatttatgtaaccactgccataatgagaatacaaaacagttccgtcaccccagagaactccctcatgtcatccttttgtagtcaatatccctagtcccacccgtaacactaacctttagcaagcactaccctgttacccatcaccaaagttttgtcttttccacaaggtcacataaatgaaatcctaccgtatataatcttttgagactggcgtctttcactctgcataatgcctcgaagactcatccaagttgttgcatgtaaacatattattattattattattattattattatggctgagcagaattccactgtgtgaacataacccgttttgttttgttttgttttgttttgtttttcacccattgtagagcatttggctgtttccagtttttgataattaagaattaagcttctataatcattcttatacaggttttggggtacagatatgttttcatattgtaatgcttaggtaattcctagaagtaaggttgctgagtcaaccggtagatgtgcctgtaactttatgagaaactgccacactgtttgccagagtattttcaaatttcagccattctaatatgtgtatagggtattttatcatgattttaatctacatttttcaaatggccaatgatgctgaacatcttttcatgtgcttatttgccgaccctacgtcccctttggtgaagtgtctgttcaggtcttttgctcattttaaaaattggactgcttgttctctcaatattgagttttgagagtccttaatatattctgagtgcaagtattttgctggatatgtgatctgtaaatattttctcccagtctgtagtttgcctttttattcttttaacagtgtctttctaaaaacaaggttttaattatgatggtgtgatttattttttctgttatagatcatgatttacccctttagttataaaaattttataattttatattttacatttaaatgtgtaacttagtttgagttaattttggtataaggtattgagaggtgtagccagctgggcttctgggtcaggtggggacttggagaactttcctgtgtctagctgaaggattgtaaatacaccaatcagcactctgtaaaaacacaccaatcagcgctttgtgtctagctaaaagattgtaaatgcactaatcagcactctgtaaaaacgtaccaatcagtgctttatgtctagctaaaggattgtaaatgcaccaatcagcactctgtaaaatggaccaatcagcaggacatagatggggccaaataagggaataaaagctggccacccaagccagcagcagcaacctgctcgggtcccttccatccacactgtggaagctttgttctttcactcttcacaataaatcttgctgctgctcactctttgggtccgcaccacctttaagagctgtaacactcactgcgaaggtctgcggcttcattcttgaaatcagcgaggccgtgaactcaccagaaggaagaaactctggatacatctgaaggaacaaactccagacacaccatctttaagagctgtaacactcaccacgaaggtcccaattcttgaagtcagtgagaccaagaacctaccagaaggaaccaactccagacacagtatgagatttaggtcaaggttcattttcttgcatttagatgtttgaatgcttcaaacaccgtttattcagaagactgtcctttctctgatgaattgcctctgcaaatttatcaaaaactcagttggtaaaactgtagttgcccatgggtatatgcagcagagcagaactttctgaagtaatggaaatgggaatacacgttacagggtgtgttatgtgggcatatgcatttgtcaaaacatcaatttacacactttaagtcagtgaattttactgtatgtgagttatacttcaattaaaatatcagttggccatatttctgtaggtttatttctggaagtctattctatgctgttgatctacatgtttatctttttgccaataccatgctgtctttattttttattattttattttatttttgagattgaggctcgctctgttgcccaggctggagtgcaatggtgcaatctcagtcactgcaacctctgcctcccaggttcaagctattctcctgcttcagcctcccaagtagctgggactccaggcacatgccaccatgcctggctaatttttgtatttttaatagagacgaggtttcaccatgttggccagtcttgtcttgaactcctggcctcaatcaatccgcctgcctcagcctcccaaagtgctgggattacaggtctgagccactcccggccaaccatgctatcttgatctcaattactttagctttatagaaaccttgatgaagtggaaaagtgtgattcctccaactctgttctttttcaaaattgttttggctattcttgtttctttgcctttccatatacctttagaatcaccttagttctacctacaaaaatcttgttgggattttgattaggtttgtgctaaatttatagattaattaggggaagattcacatcttcacaatactatcttccaattttgaacatagtatgtttttttcatttatttaggtcctctttatttcattagcattttatagttttcagcataccctctaattgtttacataaatatttattagatttatatgtaagtatttcaattttttggaattgttttaaatatcatttttggagttattttaaacagcatttaaaaaatatttggtttccagctccttattgctaacacataaaaatatgatccatttttttacatgtactctacaactttgctaaatacattcattagttgtaggaggtttgtatgtatgctatttcttgggatttttcatgtaaacaataatttcatttgtgaacagggacagttttatttcttcttttccagtcaggatatctttatttcttttccttgcctgattgctctggcttggaattccagtatggtgtgaaataggaatggagatagaagtttgccttgttttcattcacaggaggaaagcattcagtcttcatcattagatgtgatccttgttggttttccaatgatatgtcctttattaggttgacaaaagtctctttttgtagcaaatctacattttacatgtcaaaagagggagtagatgaaaaaagtaaattacatattcatctcatactcagtgaatctacattttactaaataagttgaagtaaacataaaaagaggaagcagaggaaaagtcaattatgcattaatctcagggtaggtgaagagataatttctggtcttgtccttgtcctgtacccgcaaagataagctggtagttgacattgtgagggtgagagtcaacagagctcagttttagggctagtttataggagggatatagatcctgaacgatttagggcctcacgtttatacttattgtatcttccctatgaattggcccttttattgttgtataatgtccttttttgtttcttctgacagttttgacttaaaatctatttgtctaatattggtatagctacctctgttctcttttggttactatgtgcatggaatatctttttccattctttcatttcagcttatgtgtgccattatatctaaagggaatctcttgtatacatcagatagtgaggtcttgttttttaattccttcagccattctgtcttttgattgaggcatttaatccatttacattgaagcaattactgattgggagagactttctgttgtcattttgttaactgtattctgtatatgttgtatctatctattcctcttttcctttttcctttttatttgctgccttcttttgtgtttcattgatttttttttttttttttttggtgacatgctttaattcctttctcattttcttttgtatgtcttctataggtattttctttgcggttgctatggagattacaaaaaacatcttatagttgtaacaatctattttaaactgttaactacctaactttgatcacataaaattcctttacatcccccgtcctactttgttaccaatctttcaaattatacctttttatattgcatatccaatcaagctttcaaactatatccttttatattgcatatccatttatagagttttataattgtagttattttttaagcttttatcttttaaattctataccagaatttaaaatgacatacaacctaccagtacagtattacagaattctgtatttgtctatatattgacctttaccagggagcttacattttcatatgctttcatattgatatctaggatcctttcatttgaaggacttccattagcatttcctgtaaggcaggtctagtggggatgaactctcccagcctttgtttatttctccttcatttttgagtgacagcttttttggccatggtattttgtgttggcttttttttttcttttagcatgttgagtatattatctcacttccttctggcgtataaactttctgctgagaaatctgctgataatcctatggaagatttcatgtacatgatgacttacttttctcttgctgtttttcaagattctctctttgtttttgattttgacagtttgattataatgtgcctcagtttaggctcttcaggttcatcctagttggagtttattgactttcttgaatttagatgttctttttccccctagatttgggaagttttcagtcattattttctcctttctctcactgttctttctcagggactctcataatgtgtatattgatctgctcaatggtgtttctttctttgtttcttttttggctttgactagaaaatttcaaatgacctatcttcaaattcattgattctgttttgctcttgatcaagtgtgctgttaaactcctctggtaaatcttccaattcagttgttgtattcttcagctcaagaatttgttaggttcttttttaaaatagtttctatttatattctcattttattcattcttcattttttggatggtttattttttattgctggttgtctgtacacccagttaactctttaaacttctttaagatggttattttgaatcctttgtcaggtaatttatagatatctgtttttctgatctgcttttggagatttattttattcctttgattgggccatgttcccctgattcttcatatgcattgatttttgctgggatttgggcatttgaaaaacaactacaacaaccagctcttccagtcttaatggactggctttgtgtaggggaagacctttaccagtcagcctggctagagattctgagggtctctgcgaccttctctggagatgtgtcttgtctgggcttgcatgtaatttcccaattagagaagtttgctaatttctttttcaacagtttgtgttctcttgctttctctgtgacactccacagtactgtaggttctccggtacagcaagaaaacatcaagttcttttgttctctgcagccctagatgtccaaagtataccagtttcccgttagagtctgtgttaagcaaaacagaaactagtctcttaggcagccccctgaaaaactggaacactggatgtgcattcactcctcttttcctcccaaaggagaagctctgagtaggttgttttctcccaattcattgagctgtgccagcctggggaaaggctaagaatagcaaaataaaatgacttttcctacctgttttaattctgctgttcttcactttgtatttgcctaggggcactgtggtttcataactggtttctggaggtcttataaaggcattttgtacaatatattgttggtaagtctgtggggggtgggcagggaatgagatctggggcatcctattttgtaatcttacttatatcacctcccaggaagatcaaattttatacttatcagtgtatgagagtagaaatgtcattgtattggggggtcagtagataagattccatatctgtttctatcactaatgatagaactactgctaaattataaaaatgtaaaatggtgctagaatagagattagagtaacatatttttgaaactttaaaatctgaaggaatttactgcttaacttctgcctactttcagggtattaatactagagaaatttcctctaatactttcctttttctttttctttttcttttttttttttttttgagatagagtcttattctgttgcccaggatagagggcagtggtgcagtctcagtttaccgcaacctctgcctcccaggttcaagcaattctcctgcctcagcctcccgagtagttgggattagaggtgcatgccaccatgcctggctaattttttgtatttttagtagagatggggtttcaccatgttggccaggctggtctcaaactcctgatctcagatgatcctcctgcttcggcctcacaaagtgctgggattatgggcatgagccaccgcacccagcctctaatacttttctaattatgaacctgatgaatgcttagtaggatatatatgtaaatcatctgcaattcattcaacatgagtaattactgttaacattttatagtattttctttacattttgtatgtatctgtataatgtattcaaaattatgtatatttaaatgttctctatacacagatctgtttgctctctgatcaccaggctttatataataaactttttttttcatgttaaacattcactggtttttcaatatctgcatattttcctaataatatattgctgtaatatacctcatttgaccatgtaaccatatctcatatttctattttgggaggttattataaatatggggccatgaaaatgtttgtagaaatattctatatgcttttaaaatatcctgttttcttcaagtagattgctggagatggaatttctaggtcaaagaataatgtggacataaatgattttagaactttttctacctttgccagttacctttgaaaaagtgtgagagtgttacattgcttttgtttctcatgaatactatcttttaaaaattttagctaacttgataggtaattttatttgtatttctttgaacattaattctgcttctgtggcttgtttattcttatcccctttgcccttttctttattgtgatattggaaatgtccctttcaattagtttttactctttatttattaagggtgttaatactttttttagatttgtggtaaatattttcccctgattcgtagtctgcatagcttttaattgtcttatgttattgtgggttgaaacttttatttagtcaaatttgtacaactttctttagtaacttttttcctttgctgttgtgcctgcagtcacacaccatccagatattaatcacctagattttaaattttctatatatatacaaatttctgactatactatattccttctctatgaataacctcttttaacatttttttgatgggcaaatttgctggcaatgaattccctcagtttttgtttgtatgaaaaagtctttattttttcttcacttttgaaggataactttgctgaatatagaaatctatgttggtggactccccccatttaacacattaaatatttttctccattctcttcttgcatggtttctaacaaaatgtctgctgcaactttcatcctctatagatgtttccctccttttggcttctttcaaaatttcttatttgactttggctttcagcagtataaatatgatagcccaggtgtaggtatttttgacatttattgtgcttagtggtggtctctaagcttcctagattggtattttggtgtctgtcatttattttggaaagttcttggtcattattccttcaacatttcttttgcttcattctttcttccccttctgttcagttacacacatgtcgcacctttgcaattattccacagttcttggaaggtcgctgctgctgtcactgctgctgctccttcctactcctcctcttccttgttccgcttctcctcctcctcctctctttttcttctctgcccacctcccactctgttttcttctctctttgcatttttatctgggaggtgtctattgagctatcttcaagttctctgattctttcttcagccatgactagtctcctcatgagcccatcaaaaacattcttcacttctgtttgtctgatttctagcaattcctttagattctctcttacagtttccatttccctgttgacattacctgtctgttcttgcatattgtctgcttttcccatcagtgttcttaacatactgtgatagttaattttaggtgtcaacttgactttagaagggatacccagatagctagaaaagcattatttttgggtatgtctatgagggtgtttctggaagaaattggcatttgaatcagcgtactgaataagaaagatctgccctgccccaatattgacaggcaccattcagtcagctgaggtcccagatacaacaaaaagggagaggagaaatgaattcatattctctttctctccccttctctctcttccttcctccctctccctctccttttccctctctccctcccttctagagctgagacattcatctgcttctgatcttgaacatcagaactccaggttcttggctgggtgcggtggctcatgcctgtaatcccagcactttgggaggccgaggcaggcggatcacttgaggtcaggagtttgaaaccagcctggccaacatggtgagactctgtctctactaaaaatacaaaaaaataagctgagtgtggtggtgggtgcctgtaatcccagctacttgggaggctgaggcaggagaatcacttgaacttgggaggtggaggttgcagtgagccgagatgatgccactgcactccagcctgggcaacatagtaagactccgtctcaaaaaacaaaaaaaaccaaactaacaaaaaaacccaaaaaactccaggttctccaccctagggattctgggtcttgtatctgcagtcccgcagtttcttaggccttcagccttggactgagagttacattgttggctcttctgattctcaggcttttgagcttggactgagccatgctaccagcttccctggttctccagcttgcagatggcgtactatgggacttcccagcctccataatcagatttaattcccctgatgaatcccctcttgtctatctatttatcctattggttctgtttctcaggagaaccctaatacacatattaatcatagttattttaaatttcctatccgataagtccagtatttatctggtttgattattactttgcctcttcaaattgttttttcttgccttttagcatgccttgtaattttcattgaaagctgaaaataatggattgggtaatagacctttagtataaggttttatgttaatctagactagattaatcacagactacagttggcctgtgtttagtatttgctgtagctgtaggtgccagaggcttcaaattcctctggcgtcattgtttcagtctcccctgttgtctttgggattccctaagaactcctcagatagagtttgcatcttgcagctcttttagacgtaatctaatgtaatctgttattttactggtgaggtatggtgctaaggtgtagggaaggggaaacattctgtaatcttaggactacataccagtttcttagtgggcttgcattcatggcctatgaccttcacaagtgtttcttagcttttattttcttaaagaaaaaaaaaaaagctcccataatgagataggaaggctagagggggccagagtaggaggaatgtccttccctcaggtggataaggctctggtaaagtctttttggattccactctggagagtaggcctttatttttgaaactcctctgggcatatttcacaatagttaccattagggatggaatatttgtgtccccccacgcccccgcaccccgccaagtttatatgtggaagtcctgacacccaatatgagtgtgtgtggtaggctgcgtgtggaggtattgggaaattcaggttcccaaaagtttggtcgtagtgaagtcctcagaggtcttcttgagtctttccttttcttcaccaaaggctcactgacgtcatccatcctcctgatggaggtcaaagcattaaagtcatttttctccctaggagcgtctcccccattgccaaattgccaggctagtattagggagaaatgtcctccctgaatttcattgttgggtttttttttttttttttttaaaccttattatggctttaatgttgaaatttctgttttggactttttagcatgacacatacacacacctctcattttattttcattgctttttaaactcccatgtccaatgtctattttaatcttatgtttggcagcctgaaacattttatttctaaaattaattctctaattatacaacatctacatggcttgtaatgacatcagtagagcagaatctagaatccaactcaaggttttcgttttgttttttaagagtaagtaacttattttgatcaatgtagtaagaggagattgaaaggtaccagtgtgtgtgaaagtgaatagttgcttcctctccccatctcctcttcttcctcccctgctcctctcctcttcttcctccccctcctttcctcttcctcctcccccaacccttcttccttctactcttcctcctcctctgcttattccttcatcttaactcatccttcactaaaaagagttatattagcattagaagtattccttaatggctatacttttcagatattataacttcagaattttctagccaataacaggattctagggcaaatgtcatgtaggatatggctcttcgagtaccaacatggcaagaaattgatttcctctattgaagacacattgattttcagctgtactgaaaaactcacagccttccagtatcgacaaatagtaaaaattgacttcacataataacacctttatttacctagccttgtgaccctctgattttgttagatgatcctatggtgaaagaatgcaccaggaccaatgcttggacaaatagtaagtctccattttctttatagtagatgcttctacataaaattccgctttgggcagtaacttgcgtagacagctgttcttgtgacacgacataatgcacactgagcacggtgacagctccagacgatggtctactctggagtttccaactggactggtaatctactggatactctcatctggaattgtctcctagctgagtggttaagctatagaagcccatgattaaacaatgttgtttctggaaagaataatagaaatggttattattagtgagtacttactgtctgccaggccctgcactaagggctttttatgtgttagttttgtttaatccccacaatatatctaagaggtattatcccccttttcccgtgaggacactgaaggtccaacagctaataagtgaagctggcgatatgtcctgttttagctactaacatttatcagcttcatcatacagacatactttgtcagattggttagccaggcaagtgaccgctgagagaatggggcacaggagaagtaagtgatgactgcgaacacaggctggacaaagatcactttcttatacgagtctgcagttcttgaaataatacctatcagatatggcattaacagtgattggtagccttatccaaatgcgatatttgacttttgccttcatatcatggtttgaatttacaaacttcatttctttttctttttttttgagatggaatctcgctcttgtcacccaggctggactgcaatggcgcgctcagttcactgcaacctctgcctcccgagttcaagtgattctcatgcctcagcctccagagtagctgggattacaggcatgtgccactatgcccagctaatttttgtttttttttttttttttttttttagtagagacagagtttcaccatgttggccaggctggtcttgaactcctgacaaacttcagatgggggcattgccttaagtgtatgatgcccaccattgaggtagactaccacatggtacctggatgagcatcttatgtttcaccaaaccagaaatttcccaggcaaagtgaacggaacaagagagactgcggattcagacgtttcctatgcagttatacttctgaatgggtagtcacagtgtgttcaagggtaaatgatagctaaattatcacccatctttaaatgttttcactttaacggggttaccaaatcgctctttaaacttgaatttctatcaagcttcagaaccataaatgttttcttagaatttttccaagattatctgaatcagtgagtcctttaactcacttctccaggtatcaaaagtcttttaagtcttttttctgccaaaggtgaatctatgctaacgccttctagtactgattctcctttccattttcccatgcaccctactgctttctgtctccctttgcaattcaacagaaagagaaatcatgaggcagtatgaaatgaaggacttttctgggctgattttccttttgaatcagaatggaaatttatggtcatagtgctttccatgaggtatttagaagtttccagtcaatcattgctcttatcaggggttcttaaaggctttgggagatactaggttagctttcttacaatataggctgccctttgttacagcgacactttctttttgcagattttttttttcttaacagagaaaattgagatatgaaattatttccttaatctctacaataatcaaatcataattatttctattctattttttaaacttttaaatttcactaacagtacatagccattgcagtaatttttttaaaaaatagagaggagcttaaaaataacaaaaacctctataatcccatcacccagagatgagttttggccccattcatctcacaagttctgtgcaactattgcatttcatgttgcctattcatattaagagaatagcattacttttattatgatgatgatttgtaaacaatttcccagagttaattcccagacatttaaaaattttggccataattgaaagtcaggattttatcttctcagttggaaagtagaagagaaaagtataacagtgaaaaaaatttttcttaggtgtgtatttgtgttggattgttctaatttcaaaacagagaaagttttgaactcctgctttcatggttcattcttagaaataaatagaattgttttcccaagaaaaccttggaaaactttctagtaatagcaggaggaatatgggagtaggaaatggcaagttgaaggattttaatttggaaactgccaccttttggaatacagaagagctggttatgggattggcccctggctttacttgtccttaacatgggctttgataaggggaaaacaaagtgagggcttcgagccacaagtcaaggtcttgggaaagcttagcaaaatggtgcaagtctctcgtgatatctacctttatgcttactgctttctattggcaaaaatctctcatcttttgcagatgcactgagatcccatcagtagacagagaaagaacgtgggtgagtcagaagcaatcagccagaagcacacaaatgggtgtggacatgtcactgccaacaacccacacagagtggctggctactgcattcacccttaggatctcctaatgagcacagttaacagtagttggagctttgtctctgacatcctcttgcagtcatctgccttatttgctgattgatttctgttcttgaaactctgaacaggaagccttctgttgactcatccctgcttttcagactggaaagcacttgtaattttatctgccatgtatagtctctaaaaatttattttgaagatatgctgtatcaaaagcaatttaagaaagtaggaaggtaggaaatataacaaccaaaaccaaacagtgacactaaatatatacatatatatagctgtacactagacttaacctaaactgaccagctagatgattttgatgcagtaaagacaagttaagaaaatttgtctttactgtcaacaagacagtaaacttgtctctatgtcaacaagaaaaaaggcaattagaaattcttggaaaaacagaaatttgcaaatgaagtcccaatttaatatgaggtaaactgaaatgtgacagaattctgcataattgatggtatataagaaaaaagaaaaaagaatacattggaacttgacgcttacagctagtatggtgacaacggactatatctcctttaactgatttagtttcaccatctggaactgcactgaataaaaatatttacctaattgtaatactgaatatattttattagttttcatttttcataattaacctgtatgcaaagcatggaagataaattatatttgctgaacaaaatggaaatattctaaaacttgatgttgtaaattaatgcttattataggtgataaaatgtaagggggggattgaggtggaatggagtacaagagcatatgttttcttctgtttcatagtggatggttgaaatggtactctttagtcttgatacatagagaagtagagatttaggaatatgattacatgattaaggtaacaaatgaaagattatatatctgaagaggacagaggggaaaggagatgctgtgtctcaaaattgtgttctcctctagcagggaatcaatataccgttgacccttgaacaacacgggtttgaattcaggagtcctcttatatcccagtcttttttaaaccaaacatgaattgaaaatacagtattcccaggatgcaaagcctgtgtatagggagggctgactttgcgcatatgcagattctgcaggtggactgcaggacttgagtatgcctggattttggtatatgcaacaggtcctggaaccaatcccccaagtgagtatactgaggggcgactggattgtttcacttttgtagaggcatatgggagttaggcagccttgtgcttttcatactatgttcttgtttaatttctggggttttttgtttgtatttttgttatccatgtacatcttttgaaactgaaaaaatggtgatcagatgatttacaagaaactttgattaacaattatactagcacaactttgttaaatttccctaggagaagacaacagcctcaaatgcagtgggaaaaaaaagcaaaatctgcctgcttccacattgttttcaaggagagcacttgaacaaaatggtactatttggacaataaatagatgggtaccaattctagacaagcacaagcaaaaagaaaacagggctggcagtattcgcatgggggcaatttcaagacagaaagcattaagtggacaaaaggtgatattttgtaatggtaggggttagaatccaccaagaatttatacagccatggttctttacgtatggaaaattagcgccgaaattggtaaaggaaaaactgttaggagataaaagaattaaagaataaggcaaaaaatattagtacttagaaaattataatagccaatggtataatttaaggtatgaaaataaaacaaacaaaagtctgcacctgcaaaggaaacttgaaaggcagggctgttggggatggggtgtgtgtggcggtgaaaggggtacagatagtttatcctaatcataggttttaatcactttcttgtagaaggaaggaaaagttttatttctgtgacaccatctcattgtaaaatccagtaaaattgaaaactttgagataaatgtattatcaggagttacagccataacttttagtatgtgagctataaattctgttcttatcactaagtcactgagaactaaggctgctgattttcccaacatagtaaaacagagcgacctgaccaaaaaatgaaaaacatttttatggacttttattctccttcctgcaaccctaatctccttccttcctctatagattctagtctatctaagaaattctaggtggatggtttgctttctctgagggaagctaagattgaggccaaaaggagatctgctaggtacctgtgcaaacgtcaggtgggacagtgaatagaaagtaggcatgcaggggaccgagaaagataggctctgggcatcacaaacagcttttccaactctagagacttgaaaaatgtatttggagttacatctaagtcagaagagtacatcttgtttatccccccaaaaagcctcctggtatataccttttagtcaaatagcattgtgatcttgtcacaatatatggacaacagatattttcagttcatttgatacttaacatagaacatattaatgtgccattttatcagaaacctgtaaaggagtttaataatggataactagaatgaacataagtggtagcaggtccttactctcatcccccctcccacttttcataatgtactgatttgaaatgttcgtgaaatcaatacagacaaattaactcagtgagcagcttctccccagtctcttgctgcagtgatgagaagcctctttctggatctacttgtttccagatggtagacaaggcttattctgacacatggactgaaaacagggcagaccagcagtcggaatcttccctgcttagtgtcttaatctatagtaagacctcaaagaattagattccctagcatgaggaatttttcttactgaattttttaatgccactatatggcagtgattaaatagcaagttcaagtgattaaatctggtccatctctatacttttcctttacaattgctatcaggttttgtaagtaaggaagtggaggcatttttgtaagtgtgttaactctcaaagcccacaaaagtatgtttttaaacttagggatcaagttgtgtggatccgatttcagacccccagaggttcttccaatgtgtctaatgtccaggacagtgcacatgttcagagtttcattgtatttttctttctttctttctttctttctttctttctttctttctttctttctttctttctttctctctctctctctctctctctttctttccttctttctttctttccccctccctccctccctccctccctccctccctccctccctccctccctcccttccttccttccttccttccttccttccttccttccttccttccttcctttctttttttgatggagtctcgctctgtcaccaggctggagtgcagtggcatgatcttggctcactgcaacctccacctcccaggttcgagcgattctcctgcctcaacctcccgagtagctggggctacagctgcccaccaccacgcctggctaattttcgtatttttagtagagacggagtttcaccatattggccaggctggtctcgatctcttgaccttgtgatctgcccgcctctgcctcccgaagtgctgggattacaggcatgagccaccgcacccagccagcagcatgttttctttgaagtgttgttcaggggtctcttgcatcagaatgtcctgaactgcttgttgggaatgcagtatcctgatcctaccctccagattctgattcagtaagcctggactgagccttggaaatctgcattttatttagcataatgtcctgggggcttgggggctccccaaagtttgaaaaccaccgctaagggctattatgtttctgtaggcaaacctatttttctgttttcattttatgtcatacaaagtaggagtttaagaatttatttttggtgaaactagaacactgtcttcaaattaataagagccttgttgtgtaggagaaatattctcttcaaaatctctccacgaaattgatctcaaaaagactggctgagtcaaatgctaaacagatctgtcctgtatctggctgccacctgtcaaaattgctgaccttacacttatgtattcaaatgcttcctggaagtcaaaacatattttcaaaagtttctagtggaaaagaactaagcctgtcgcttggttttaaaaggtggaaattgagataagaccgaatggttgagattaatttcacatcacaagaataggggtgagaagagaatagcaatttccataacttctatcatttatcttttaggttgaggatactgtgaaataatccttccctttccaaccaacatgaagatgactgatacacccatcatactgaaggattcctactgtgtcagagattacattatattaagtccttacagaaatataaagagtataaccttcaaaaaactgggaattgttaaattatacattggattttgggggctattgtttgggaggttttgttttgttttgttttgtttttccttctttcataacagttcgctcaattaactataccagaggcatctttggctgcaaaggtggaggaatcactgtgctcgaagatgacagttctacaccttggcctgacagttttgagattcttgcttctaaaataagatggaacctgaaagatgggatgattctagcatactaagtatttgactttaattggaatcattgaacgtcccttgaattttttttctcattggtattggattctgttgtctttactgatggaaatttcttttccttccattcttggttcatgacaaaccaccaactgtccacgcatgatctcctttcattttacttgtatttgaaatgaaaacctgtgagtgcaatgcctaatctaagaatcagaacattattcttttatacccctatctctgtaattctcctttatcttactccttcacctccccatccctctgccaccagaggtaaccaccattctgaacattgtttatcattctcttgcttcacccctacatatctacatgtagccttaagcaatacattgtttcattttgcctggctttgaactttatgaagaggtatcatccctggcttatatgatctcttgagacttgctgtttcactcagccttatattcctaagattcatccatgctgtcattgctgtgtagtatttttatttgtgcttatactgcagtttttctataaatgttagtataggttatactatgatttatcaatactcatgtcattgggcattcagggtgtttcctgtttttgtatctatgagcagagctgttagtaagcatttgcgtctcctggcatgcatgtgccgaggtttcccttgtgtctatgcttagaggaagtacagcaaccactgctgtgttgtggtgtatgaaatcattcaactttacaaaagaatgggaaagcgctttcagggtcgctatatccatttacacttccaccagaggtgcagaaaagatcctatcagttcacctcttcaccaactctttgtattttcagacatcaattttttttttgccaattttgtgtttataaatctactgatatacttcttaagtattttatctatcccttaggaaaaaaggtaggaaatagaatgtggttgccttcacatagagaggctagaaaacaaagtatcatgcctgcttagtttgatggcacccaaatttttctcccagttatctcactactagtagttgacattcttttctcaccctcgctagaaatatgaaaaccttgcctctgcacagtggaatcccttggaacatttaaaaaatgctaatgtctggaccccacctccagagactctgatttctttggagcccagcattgaacatagggatttttttttttaaataaaagcttcccaggtgattctaacgtgcagtcaaggttgagaatcactgctttaaaatacagaaatcttgacaagcaagcataagctcagggtagcctgatattgttaattgttctttttctcatttctaaagtacaaagtttgcataattttggagaatcctcttgcctctaatttctagctcagcagcctttgagagttttttggtttttgttttggtgtttgttgttggtagaagtaaatagtagaaattcaataaaagttagtatgggctagaaattgtgcttgacatttatttttttcttataactgtggatctcaaagtttagtgtgcataagaaacacctgggaagcattttgttttgttttacaatgcggattttgattcagtaagtcttggcgtgagcccccgggaatctgtgttctaacaaagtgattatgatgtaggtggttctagaatcacctttggataaaaactgcctcataataatcctacagtataagcagtattctcatttacagatggggggatgtgaagcccagagaagttaagaagcctgcgccgtgtcacagagctccctaggggactagcctttgctctgtaagctctcagccctgctcatagtatgcctccaacaaggctctcagaatttaggaaagtctgctttggaacatgtgttatcttctctatacttacattctttcttaatctgccatgactttctctcctcatcaaaaaacagcctttaatctcctacccaaatccacctcgtacctgtgagtcttcaggtgtgttacactctgaacatggtcccgtgagagaatttcttattaaaaattgagcttgcaaaaaatcaaatgtgttatatttttgttcttatttcaccctaaaacaatgactttagttgacaatcacttttatgcaaccttagtaattatttctaaactcatgtacaagtggatggaagtatttctgtgcacatttagaaaatttatattcattgcttgtttccctcccctgccaccccacagagtgaggactttaccatgaaatctgggcctttggcctatgtatttttaatcatgttcatattgtactgtatctgcaaccatctgtaatacagctgtatatgtttacatgaaacacaataaacttttaagtttaattccatttgtgagcagatggtagcttgtcaaggaaacatttgatcatgtttatgtctgtatttggccacaaaaacctcataattactctcattaattacatatccttttcatgttacctgtaataaatgctaaggtatcatatgtgttggccttgtgggatatatttttgtatgtagagacagtcctcttaagaatgtttgcggcctggagcagtggctccgacttgtaatccaagcactttggaaggccgaggcaggcggatcacttgaggtcaggagttcgagaccagcctaggcaacatggtgaaaccccatctctactaaaaatacaaaaattagctgggtgtggtggcaggtgcctgtaatcccagcttcttgggaggctgagggaggtgaattgcttgaacctgggaggcagaggtttcagtgagctaagatcgtgccattgcactctagcctgagtgacagagtgagactctatctgaaaaaaaaaaaaaaaaaaaaaaaaaaagaatgtttgcttctgtaggcacatttatgtctacctattatgatgtcaagggtgtattccagtttgtatctgtagctgctacaagaagggtgtcatgggatctgtggttacactcttactcttcccatctgggtatttctgagtgtatttgctccaggagagccactggttctgctggcctacatgcaaagtgtatctatctctctgttaatgcgtttcccatgatgatactcgctgctgagatacttcctaggaagttttgctttcctatcacctcctttaagtgctttcctttaagtgttctcattttaactcattattaaactagcagacttgattgcagtgaatttttcttaaataacttaattgtagggccttttgcgcgtcattttgtgctcctacttactgctcagaggtggtacaaagtcagcagctcaagagacagacctgccacccatgatctctcctccaagttctcaggatgttcagaaagttaaaatttcactctgtcgagtttccatctggcttggcaatcaatgccggattagctccaaatactctttccaagtctcttgaaggatgtgctagcctctgttttgaattctacttcaggatcacaccatctctgcatgcaagaatgacatatctgagtgactgccactaaacccacatggtggaagtgtttgcttatcctgctatgtgatgctggctatcatattgtcagtttatgaggtgtttttttttttttttgcttgtcttcttccatgtaagtatttccagagcagaggcattggcttgcagaaggtgtgcctgcaatcagtccagcttccccagatgtgctgaggcttcaacaggggtttttaaaacttgtgctagaatactcatcttccaaaaaatctttaagttgatgcaatataatagctgccaattgagcatacattttgaggtagttttctttaatgggagtatatgctcatccacactctctttccagtgttaaatattttaagacagctggttagagttgagggtgccttttttttggtcataaaacgatgacagaactctaaaatcacatggttatttatcaacattaaaaacattcttttatatccattaattaatttattctttataacagcttctgtggaataggtatataaagggtttttttttttgtctactgttatttaagagtatcataaaacctgagaaagaaaaacataattagttgtcatctagtctaatgctctcattttgcagataaataaattgaagttcagagagatgaagtcactcacttatggacctatagctagtgaatggccctgaaattgtttcccagtcatggctggaggcacaactttgtctgagacctgactgatacttttgactatgtgatgttgtgtcaattatctaacacttctggacctcagtttctttacccatattatggattattgtgaatattatattagactacatccaagaatgctattaacccagggcctaccatcaaataagtagttaatttatatcagccacttcacagctgcacttatttttatttttattttttctgagacagagtctcgctctgttgcccatgatggagtacagtggtgtgatcttggctcactgcaacctctacctcctgggctcaactgattcttgtgcctcagcctcccaagtagccgggactacaggtgccaccatgcctggctaatttttgtatttttagtagagacggggttttgccatgttagctaggctggtcttgaactcctgatctcaagtgatccgcctgcctcagcctcccacagtgctgggattacaggcgtgagccaccgcgccttcctgctgtgcttattttcaatactcttttctcagggatcttggtaaccagagcagaatggcagtttttcagctcttacaatgcctttgtttagaagtcttgtatgtgtatatctgctccatcacttaaaagttctcctaatgcaatttggaagggtttaatatggaacaagagcagggactttgggatggagtctaatgataacttgtcacatgttcttttagaagctgaattaggtagtttttgccttactggtgcgctctcatttaactgtgaggtatcctggcacttcaaacaggtaccatatggtaactgttttgtgttttaagcctggtactgtttagaacacatgcttcagagagtggtcattgtttcgctgccacccagttaaggcatgtgttacctcttgttatggatggaatgcctgtgagccctaggttcctatgttgaagccctaacccccagtgtgatggtatttggagatgaggcatttgggaggtgggtaaggttagattagctcatgatggtgggaccctcttgatgggattcatggccttataataagaggccatgtgaacacagagaaaaggtcatgtaaggactcggcagaaaggtggccatctgcaagccaggaagggaggcctccctagaagccagacactgcctgatcttgatcttggactttccaggcttgagaactgtgttgtttaagcccctcagtctgtgatattttgttatggtagctgggcttgaacagactgagagacctctgctggagtgtgcgttgttcaatgatttacttccttgtttgcctacattatacactttcactatgtctccacgatggaagaggcatgactgttcagatgcatcggggttcgtctctacctaccaaggtcctgtgccatgaggagatgtcgggccagggactcaaacaggagcagtcatccaactcctttctattaggtctttggtgatttaaaatctcatatgaatcaagagctggtagagtgctaatgttcacaggtttttatagaacattaaagctctgtaatagttattttgtatgttatataaataatttccctgcaagtatttattcatttactcttcatttacataattgcttataatcttttttaatatattcttgtcccctgcgccacccctcccaccttttttttttttttgctgtggttcatatgcttttatgtaacctgagctataaaagactagaatactgcagatattctatctgccatgtctgtcattttcttatgatgggtacttagtctaccgtatacaaatttctgtatagttaccaatgtctttttagctatttattaatcttatcttgtttctttggcttctgaatcactttgctgaagttgaaatcatctgaggtcagagccagtttttatttaaatagactgaatgcagctaaacctggattatagccaagaaagatcttacaccaagtgcctacaaaattagaagcattgccaaggacgcatcagcagagtgttttgcttactgaagtcttattctgaaataaatttgaggccctggcgatgggagcttttggttgttattggtagacctcctaaaaaatgtaatgtagtttaattttacttttaatttttttagcatgaactttctccttcatttcttctttccagagatttttgggtctatccattggttgccatctatgtgttcaaacatgtgactaggtagaagagaggtaaacaggagtgtattcacctgttatcatggagaagttattattcaagacctgtaaggggaatgtggcagtcctaaaggctgcaaatattctggcagcattgtaggattgcactttccctcctcctctgaaggtagatgggagccatgtgtcttgctgtggctaatgaaatgtgagcaaagtgttgcaagctttaagagccagtgcatgattcatcatgttcccatcccattgccacagtgtttgtgaaagcgagtgttgagatggaccctttgttttctgggtccttaattgactgtggtaagataaattattgacaacctgtactagacatatatcttcagcagtatcctttggttgggattttgttgagataagggtccgtgatttggcatactcagtgtaacctaacctattctgattcttatagggaatcagagaagtgtccttacactcagggagcttgtgatttaatatagttgagaagatgtgtttgcataatgaagaaggaaccagctgcttaactgtactctttatttagccacattactgaacaagagacaagctgattatagcataatattgagattttgagtatattcctgagaccctggtttcaactggaaaagtaactttttttttttccttgacactttcagatcacaattgatcaaaacacctatgcaaggaattaaacttgctacaaataagccactagatgcatgatacctttaaaaaagaccaattatgagttatcttttattgttctttttatattaaaaatctgcatgggaaatggaatgagaatatttataacagtacagatttgctatgatggtgtctattaatcaaagttctttattttttagtatgtggggacgacacatactcatggctaatattggtgaaattgctaattcattcattctttatttggtgattcactccacaaacatttattgggcatttggtataaaccaggcatagctctcaatgctgctggtacagcaagaaacaagacagagcctctgactttgtgtcttacattttagtgagagaattgggtaataagcaaacaaagaaaggtacagtgtggtatcaatgatgagagttataaagacaaagcagagaaatgagacagacagtgcaaggtgtgtgatctcacatagagtggtcaggaaaggctgctttcagaaggtgacatttgaacaagaaattgaagaaagcagggagaaaagccatgtgactgccctgaggaagaatccttcaagtggcataaatagccatttcaaagaccctgaggcagggatgtagtaggatgtttgaagaacagcaaagagaccagtgtggctggaagaagggtgagcaagtgaggagaggtgggtaggagatgaagccagagacgtggtcaagagccacagaaccagggcctgccctgcctctgatgaaaaggcactgggattttgaatgtgagagaaccatgacctgctttatgttggaaactgatgtagtctgtggagggcaagaaaacaaacagaccagcaaggagacttttgcatgagtccaaattggagatgatggagtttggacacagttggcaagtgtggtggttgtgagatgtgttgggttcaagatatcttttgaaaatattgctattaggactttgtgatttgttgtggactttggcctgagcatctgattgactgatgatgctattttctcagatgaggagaatgttcaagatgttgttacctatttaagagaaggtggccattgcatattgcatatgtgagcctggacttcaggggaaagtttaggactggagataggcggttggtcattcaatggataggtggatttgaatccatgagattggatgagattcttttttgtttgtttgtttctgagacatagtcttgctctgtcatccgggctagagtacagtagcacgatctcaactcactgcaccctctgccacccaggttcaagcattcgtgcctcagcctctgagtagctgagatttacagatgtgcaccaccacgcccaggtaatttctgtatttttagcagagacagggttttggcatgttggccaggctgatcccgaacttctggcctcaagtgatctgcccgcctcggcctccaaagtgctgagattacaatcatgcgccaccacgcctggcctggatgaaattcttgaggaaaggagggtaccgagaggagaaaagatgttgaagaactgaatctggggtgctcccaacagttagaggttgaagagctgaagaggaaccagtaaaggggaccgaaaaggagcagccattgaggagagaggacagccagacaagtgaagtgatccacagctacatgaagacagtgccaaggaggaaggagaaatgagaaatgaaaatactactgagaggttgagggcctgggctgagactggaacacaggatatagcagcatggagatcatggtgacattgacaatatcatgtcattgattgggtgggggcacaagcttgattgaagctggttcaagtgagaataagagatgaggaaataaagataggatatacgtttcttgagagatttttgctgtggggtgagaggtaagggaggatagctatttaggatgtgaagtcagaaaaatttaattttttaaagatgggggttatattacacttgaaagctgatcattatttagtagagataaagaaattgacagaagcatctccttaagtaggcaagaggggatgggacctagtgtaagtggtgggttggctgctgcattagctggagttaaggcattgcatgttctagatttgtacggagacatataggtgaatgcacacacttatgggaagatactgttattatcttctgcttgcctttgttttctaagaaatagaatcaagatcatcagatgggtgtgagtaaggggtcatttctaggagtaggagtgtaagttggccaagaaagtgtaataagattgctgagcagaactgaaagcacattgagattactatcatatctttaaagcaaaatcagccagtgtagttctttgtttttctctagattgtgtcatttgctgtggtgtagggagagagtctaaggattctctcgtaggtaatcatggtcatagttttgcaatctgaataatgtggaagtggagatgggcagccgtgcagtagggcacttgcaagggagcaatttttgggagtgccaaaggccaggctggaagaggtgaaggaggagggagtgatttttgggtggtgccctagaccaggctgaaggaggtgaaggaggagggtgaagacataaagtggggaacggaccatggagaggaggtcaagtcaatggatccagagggcactgatgccaaattgttgacaggcatgagagggaatgagctggaaattcctttgaaataaaaagttggcagctttcctcaagcttaatctcaaaagagacatttaaaaattacttacttttgctgcatggttggggaaaaatgtatttttcaagcatgagttcaactcattttgtaccagggtattcacactgatattcttgggtaagtcattaaaattagtcaactatttctgtgtcttcacccacaaaaggagacgtgtgagaagtgaatacttagtgattgttagattccactgaatctcactgctttgttgcagtttaacgagcaggctaggattgcagcgctgtcatttcagttgggccaccaagccttgaatgaggagataaaactggaagataaagtcttagtaggtacaacaaaagaagcttttgagagatcgttggatagatgtcatctatttggttgctaaataataacacacaaagaaatctctctactgtttatcatgtgtacttatcttgagaagcatcagtgattaaaaaaacaactttgaaaacataaaaatggtgaagtgtggcaatggtatcatgtggcaacggtaaaatgtgtttacccatgtaaatataatgtcacaaatgaatcttgtcattatattttgtagtatcttggaggttactggccagaactattataatagtcagattcatttcatatttatttaaaatccgcggtgttttcacatacattgtgtttttaggggaaattttaccaatgattaacatatattgtctagaagcagagccatctgaattgaaactcaaatataattgccacttttattaaatatacaactggcagactttgaaaatgttatctcagcatctagcattggcttcattttggtttctcattttcctattttattttgttcagtttagcaggggacagtggggaacagggttacaaattgcattttttcctgcattattggtttttgtcaagtggtttacaggccaaagtttgtggatctgccagaggctttatcccaaaactataggcaacagctatttcttgaaataattttagatagatttctacattgatttatgttttggggtatatgatgcacaatcccttaagtcttaatatgactattggtttaatatggcagaattaggatcaggttcactcattgtttattataatttacccatgcttgactacccaataaaatgtcttccctttacaatgatctttttctattgccatattcttcttgtccttaaaacaacaataacagatcctcaaacgtcattggggttaataaaagatgtttctttattttcagatctttaacaaagcttctccttaacccagagggttttcagaggagtaaagagtggaagtcatttgtacatgaattggcttttgaaagtggccctcattattttattttattttattttatttttttattatactttaagttttagggtacatgtgcacaatgtgcaggttagttacatatgtatacatgtgccatgctggtgtgctgcacccactaactcatcatctagcattaggtatatctcccgatgctatccctccccccctccccccagcccacaacagtccccagagtgtgatgttccccttcatgtgcatcattttttatgaagtggccctcattattaagccatgtctctgcctgttgattgatgttaactatctgcttatggtctgagatcagtgtgtactgcaaatgtttgggaagatatcttctttctgtggaggtgaaacttaaatatcttctataaaatatgcctcgatttcagaagtagcaattgtagcaatgcctgatgtgaccactttattactgccttagaagtacttttgtggtttgactgtggggagggaacgggtcactggagattttgctatctctccaggtttcatgctttgggaatcaaaggtaggtaacagtttggaaaaactctgtaggggctaaagctttttctaaaggtttttacgtctatatatacctctgtatgttactgcttcaagcccagcaactagcaattttagtttcactgaaattgtgttttctttaaatacacaagataatagaattgtaactggaatttacatgttatatataaagatatattttatttaatcttgtcagaagggttttttttttttttttttggtgcttttaagctaatgtggcatctttctcttttcaaagagtggcatctccaaggaatagctctgcctggaaggtgtttgtggctgtccacttaaaagctgaaattaggtcagtgttattttgtcttgagataacaaaaataagaccccaagggagtagtgacttgggatttcatttaagtacttaatttacaggaaaaaaaatacagtttccgatactgaataattattacactactgaataattatatattttttcttctcccggtgttcttatactttagaggcaattttttttttttttttgtaaagatcacaaaaggtctgattagtcaaagaatgaaagaaatgcactgtggctccaaagtcccttatccaaaacctctgggacagatgtattttggaatttaagatttttgtgctgagaatgatggtttccagcttcatccatgtccctgcaaaggacatgaactcattcttttttatggctgcatagttttccatggtgtatatgtgccacattttctttatccagtctatcattcatgggcatttgggttggttccaagtctttgctattgtaaatagtgctgcaataaacatacgtgtgcatgtgtctttatagcagcatgatttataatccttggggtacatagccagtaatgcgtcattcccagcaaactaacacaggaacagaaaaccaaacactgcatgttctcattcataagtgggagtcgaacaatgagaacacgtggatgcagggaggggaacatcacacaccaaggcctgtcggggaggtggaggacaaggggagagagagcattaggaaatatacctaatgcatgcggggcttaaaacctagataataggttgatgggtgcagcaaaacgccctggcacatgtatacctatgtaacaaacctgcacgttctgcacatgtatcccagaacttaaagtaaaatttaaaaaaagattttttggagtttagaaaaataatacatttggatttagcagggtttagtgcggcactttttaatcacacacactaatatttctgtagtgaaactgaatattcacactgagataaagactatgaataacttcacatcagttcaggtaaggttttgcctcctattaagtcttgataacaaactttaaaaacttaaaaaaataaaataaaataaagtttattttcaaaacttttgaagtttgcgcgtacagctagcttgtaggtctggccttgcttttctttagattatatttcccttattagtcttctaaacacattaaatctgtgtttaccaacgctgtaatattttgccaccgtgaggatggtctagaggccagcaccatccacatcccttgggagctggctagacatgcagaatcacaggtgctaccacgaagctgctgaatcacaatctgcattttaatagaatccccaggtgattcatgtgtgcgttaaagatcaagaagcattgctgtagtattatattggctttaatttagattccaagtcttaaagggaaatgctgatggggggatactttagttgtttaaatcctgggaaagtgagcccagattacactaatatcatttatttaattatgtatgtatgtattttttttttttttgagacaagatctgacggtatcacccaggctggagtgcagtggtacaatcttgactcactgcaacctctgccttgtggggttcaagccatcctcccacctcagcctccagagtagctgggactacaggcatgcaccaccacacctagctaatttttgtattttttgcagagagggggttttgccatgttggccaggctggtcttgaacttgtgagctcaggccatctgtccacctcagccccccaaagtgctgagattacaggcgtgagccactgcatctggccgaatatcagttctttttaattttttattcaatatttcctccgtctctccctcccactcttcctatttttttttttttttttgagacagagtctcgctttgtcgcccaggctggagtgcagtggcgcaatcttggctagctgtaacctctgcgtcccaggttcaagcaattctctgcctcagcctcctgagtagctgggattacaggcgcctgccaccacacccggctaatttttgcatttttaccagagatgggatttcaccatcttggctaggctggtcttgaactccccacctgttgatatatgtgccttggcctcccaaagtgctgggattacaggtgtgagccactgcgcccggcccactcttcctttctctcctccttccttttctttttctttctttttaaaaataagtctcataatacttgactttaaatggatcatttagtctatttatttacatttattatattcttgatatatttggatttcttctcttttatactttctgtttattctacttttgtttctttctcttgttttatttatttttttgagatggagtcttggtctgtcactcaggctggagtgcagtggcgcaatcttggctcactgcaacctctggcctcctggcttcaagtgattctcccacctaagcctccgagtagctgggattacaggtgcatgccaccacgcctggctaatattttgtatttttagtagagatggggtttcaccacgttggccaggctggtcttgaactcctaatatcaaatgatccacctgcctcagcctcccaaagtgctaggattacaggcgtgagccactgcacctggctctttttcttttaggttgatattttttttctcatcctattccttcctctgctagtttgttatataccctatttctctcttttagcagtaatcctagaaattgtagcatgcatactttatttataaaagtctaaattcagtcagtatcttttcttcctcctaaacaatagctcagaatgttttaactcccgttttcctctcttgtgctgtatactattcttgttgtgtgtttattctatttttaaaaattattaatcatagatgattttttaaaacttatttttttcaagacagggtcacattccataagccaggctggagtgcagtggtgcagtcacaatgattgcagcctcgacctccctgggctcagatgatcctcctacctcagcctccagagtaactgggactacaggcacacaccaccatgcccagctaatttttgtatttttagtagagacggggtttcaccatgttggccaggctggtcttgaactcctgggctccagcaatctgcccgccttggcctcccaaagtgctgggattacaggtgtgggccactgcgcccagccaatcacatatgatttggttgtttaatagtggtgtttatctacatttattcacatatttgccacattagttgcttactacgtatttttgcattttagaccttctacttggaatcaccttcttcaacttggattctttagaccttccttaactgagagtctcttcatggcaaactgtcttggattttgtctaaaaatgtctttattttgcccttattctaaactgttactaaactatacattttgttttttgttagtgtatctgatttgctggctgtcattcattgtgctttatttctctctctctctctctgtctctctctgtgtgtgtgtgtaagggagagaatttgctaattagttgattaattttccactgtgagctgttcatttttcttacagctttgttatgaggattcttccaggtctgagttacagaaggattctcctagaaagtatttaaggttgcttctgctatgtgcctgggttattaccaactgtgactcttcacattaaatttttggcttcagggttttgggactctaagagctgtatgaactcgcactgcaaactcatatgagttttcacttattatagtaaattctcaggtttgatttttttcttcttccatccatggccaagatttgagacaggcaagtttccttgcactccaggaatgtagcttgacttactgttcctggtgttggtggtggtgctgctggagatgagatccttttagccatcctatctttggcaggccctgggctttgtttcaccctgaactctgaaccctgaatcctgtgggcagggcttctgctagcccatgtggctccactctaaattgatgcaggcactcagcttgttaaagggagcactggatggatttcagcaagcttcctgttccttatggttctgtctggtaggccttaaacctaggctcaagtactctggagttaaacaagtggcccaaggcaaaagccagcttcagtgcttaacttacttcgcagggattgtatgtatgtatgcatgtgtatgaatatatgttatgtatacatatgtatgttttgtgcgtgtgtatttcaccgttgagtgttaattactcccttgttacaactcattgatgcatttaaataaaacatttaaaatattttattcatctcctctcatggttttcagcaaaaatgtaggtcagggtaaattaccagatatattggaccagctggatgtagtcgcctttgatttttttttagttctaccacctatgtatgtatcaataaacaatgtattctttagtgcttccttatttttaaacattatgtgaattgaataacttatgtaatcttttgcaatttggtttcccgcaacatttctatatggagtatggttcgttcatatttactttataccaatatatgaatttctttagctattcaacacaatttaactattcagattccactgttgatggacttttggattctttccaatttttgctattggagttttccagttttgctgctaagaacactctcgtacatgtcttctggtgcattgtccaggattttctctagaatatattcctgggggtagaattgatgattcattgagtaagcatgtgttgtaccttactaggtaattacaaatggctttccaaagtagttgtaacaaattatgcttccattagcggtacacaagagtttctgtggctccatgtccttaccaattcttagtattgtcaggtttcttaattcttgcctattaggtgggtggacttaatacttcttagtttagttgttataacttgttttttaaaattaacatatctatgtgcatattcgtagtcatacatgtttgtctggtcatttaggtacttatgcaatactctagtagactcagaatagaaattagccatggcaacatatatattacattcttcatattgctacatttgaaaataatcataattatttgcagaaatatgaacagaacatatagaattaaatgttttcacgatgtcttgtattatctttcatgtttcatagcaatctctgtgttataggccacatcaactgcttttgcattgttctgacttacaggaattgcagatttattgttctcagtgccatatttaagttccttctctgtaacaatcaggtgtaatacttgtaaatttttttaaccttagtacaaatttaaaaagcagaaatttctcttgcagcttcctgtgtttcaggcccagtgctaagcacatggcaagcattgtcccatttagttctctccaccatgcttcgggcaggtgctgttgttaagcccctttcatggaggagtgaactaaagcatggagaggttaagggtcttgatcaaggtcccacaatcttattctcaatggaccttctccttctctaatctaaaaccctcattttattttgggaagtggatgtaggtctaggaagcttgtttgtgtgtgtgtagtttgtttgttttttttttttttgagatggagtctcgctctgtcgccaggctggagtgcggtggcgcaatctcggctcactgcaacctctgcctcttgggttcaagcaattctcctgcctcagccttctgagtgctgggactacaggtgtgtgccaccatgcccggctaattttttgtatttttagtacagacggggtatcaccgtgttagccaggatggtgtcgatctcctgacctcaggtgatccacctgccccggcctcccaaagtgctgggattacaggtgtgagccactgttcttggctgtttgtgttttatattaggaggcagagagcacttaggggaagcagaagctctggtctgaggaggcagtggtttacttattagttcacaggccttttaggtaatcactggtccttcacttaattaagcaacttaatatatgtcttacggattaagttaattttaaatcaatgctaatttttatgtcaaaatatattaagcagcatcacattaaagtcaaaggtagtcttgtaattattagagcaataggtatcgtgctgtcgttctccaatgtggctgcacattggacaacctgaggagctttaaaaaatactgctgcctggggatcactcccataagctctgatttatctcgtctggggcaccaggagttttaaaatttctccaggtgatctaatgtgtagccaagcttgaagattactcgatagtcattgattatgtgcgtgccacattcagattggtggggttcaaatcctccttctgccactcactagatgtgtggccttagttaagttttgttaacgtttctttatgtcttcatctgtaaaatggggatgaatgataaaaatactgtctgcatctcagagcattgttatgaggattaaaggggtacagtaagtccttatttaacgttgtctataggttattggaaactgcaacttttaagtgaaacgatgtataacaaaaccggtattaccatagattaattgacataaatgagagttaagttcctgcagcatatttttggtcctaaaagtattatcagacttctacataaagaccaaaacatttctaatattaaacactgagagaaatctaggttatacatacatttaagaaagattaattcaatcatttactcaattattcgactccagaatagtgggtggtccgagcctgtcctggcagctcagggtgcaaggtgggaccagccaaggacaggacaccatcccatcacagggcacactcacgctcatccacactcacactgggaccacttagacatgccagttcacctaatgggcacagctttgggaagtggagaatgtgaagaaaatccatgcagatgtggtgagaacatgcaacctccacacagacaatggccttggctggaataaatttttttttctcacaaattttataatgaaacaatgttactgtaggacctgctgtataatatatacatattaataaaatgcttggaatagtgactggcacaaaatagtcctttactgtgagctattttaagtagactaagaaaaaattattactattattggatattctctcaaaagtatcttgggggctaagattttaaattaaatcaaattttgcctagtactaagcccactttggtgttttcttggctttgtttaatttttttctccatggttttatttaaaagttatttctaatcaccctgtcaacttagcagatatctgttggaatcatttaaggtgtttgtttccaaaagactgcagaaattaaatcaagatatttgcagaggaatgactgacagcttgcaggtagactggagaaagtgcttcctaccataacagacagaaaaaatggtagtacaagagtcagcatttcttatttatttttctatgaggcagggtctcgctctgccgctcagactggaatgcagtggtgtgatcatagcgcactgcagcctcaaacttctagactcaagggatctcctgcctcagcttcctgagtagctgggactataggtgcttgccaccatacctagctgattttttgtaggggtgggtagagacagggtctagctctgttgctcaggctggtcttgaactcctggcctcaagcaattctcttgccttgacctcccaaaatgttgggattacagacatgagccaccatgcctggccaattgagcatttctttaaactggaaactagcacctttataataatttcacacataccattattgttgaaaatagtcagattttcagaggaaatctctattaacctaagttgtataaccttttgaggttgtaccagtgtagagcctgtttttccgagcatctacatgctcaatgctattttttcagttatccagcatccccccacttgtttctatcctatctcatatgcaagagggtgtaaatgtttttgtgcattgcttttacatttttatttatctctcaagtgggcaagtaagacagtcatcaacagaggttgcatttggagatcatattctgttttttctttaaactatttgatcatttcagagaaactttattctcagttctgttttgtcttcagctgtcaatatccctgactccaggccctttatttagcttccattcttactgatgtggaaacatacttttaaatgaactgcctttaaaaagaaatattttagtaaagtgaaggatctttttgtaatgcaaataatgttttgttcaggattttcttgagaaatctgccatgttctctaagcctttgcctccatactggatgtggctttgccttttttgttgtgttgaagggcatgcacagatatagtttctgattatttttctcagtctgatttctccaattaggcatattatcattagaaaactcgcccattttcccatggtgtttaaaagtaaaccaggacttgtgacactatgctactcggcatttatgaaatgtaatttaattactttgtttccattgtgaagactcggtttccttatttcctatattcatttatttattcattattggtatacccaacaagataagtaaatacgatacagccttgcatttgacaattttatggtgtgtatgtatttatcatgcctgaactgtgactagacttaagatgaagatggtacctaaatcaagctcttttatattttgtctttcccataatctagtctgtcttttctttcccacaaaatagaatgggatactttttattataaatatatgacatgttcactataaaagagaggcagtaaaggaccagagaaaatgacctgtgatgccaccacctagaagtaatcactcttgttaacatcttgttatttacttgtacagtttttttctgtgttcataggctgacatttttccttgcagatgttctctctctatattcatacaaagctgcagttgttcaagtcccaccccagcctctggaggtccaggatgaatgcctccctctttctgtcctggtaccttacgtgacctccggacggcagtgtcagtgttggaaatggcaggctgctgcaaatatgctaaaacctcatcagttgtctctattcgtctgaccaaagtccgtgggaagagcaagatgctggtgatatcctggagctcttctgacacaaggctctggctagccttgatacattcctcaaattcttccttccaattctgaaaccttttgttttccagacaataaaaccctcccaaactcctacctagacattctctctaagcagtcctgggagaccacatgtgacttgacttttaactatctttacagcgtttacattttgctccttctttttgtcatgccattactagagggaggatgggccatccagagcagcgtgcgccctccacaggcaccttagcctgttcttcactccgccatgattgaaagaggagaaaatattctatagctgttccttttctgttcttggctttttcactcttactgaccttacaagttttatttttccatttctgaatctcaattattttcatttctcctattcagtatagtttttaatagatagcattgcattacatggatgtcccttatttaatcaactgtttggtatttcttttctgtttttcaaaatctaatgaacactccagtgaatatccttttgttcgggatttatctctagaaggaagattactggctaaaaatatatgtacatttaacattcatatacatatctatacacacttttttttgagacagcgtttcactctgtcacccagactgaaatgcagtggcatgatcattgttcactgcagcctctacctcctgggctcaagcaatcctcccacctaaacctcctgagtagctgggactatagacacgtgccatcatgccagctgagtttaaaatctcgttttgtagagacatggtcttactatgttgcccaggctggtttcagactccttgggctcaagtaatcctcccacctcagcctcccaaagtattgggattataggtgtgaaccactgggcctggcctatgtatacataattaggctatactgtctataaaatttggctatctatagtcaaattattttatatgcatatatccaaatatacctataaatagccaaattatacatatacagccaaattttatatatatatatatataaatgttatatatatatagccaaattatataaagctgtatatatagtcacattatcctacaggaaatgatgtaaatgtaccaatttacattcctgtaacagggcattagaattccctttttccagagccttgccaacactggttatttataaccctttcaaactttgtatgaaagttgtatgtattttaagataaatgaaaacttatattgatttgtaattatttattggtataattgaacacctttccatatctttattgtactaatgtgtatgaattccatcttaatagttttgctaacttgtccattgaggggtttcctactgatttgtaatggctctctatataaaaaggatgttaatttttgcctattttacagtaatagtacaaatattctctcatgttttctattagtcttttaacctttgtttagttttttttcgttccttcataaatgctaaattttatgtcatcatatctttcagtccttttctatattatttctggctttgatggcatgcattgaaagcccttttccaccccagagttatcaactcgttggaaaatgatgttgaaatgtcacttttaatatttactaaacactcttgcctaatttgttctattttgaagccctttaattctgtttctttaatctgcctgtcttttttttgtgcctgttccttactgtcttgactactgcaggcaacatacttacatctaaagaacaagcacacctattctgcccttttgctaaacaaattttcagcctctttttcaatgattattttttcaaatcaatgttaaacatcacgtaaagtttcaagaaaacccctaggggtattagtatttagagtgcattaaatttttagctaattcatgggagaatttgaagtattatatcttctaatttaagttagagtacaggaattgtctgtctttatccctctaagtacattcagattctcaagaatagtaccaaaattctcagatccccctctaccagtatttttctcccactgatggctcttcaaccctaaaatgtcttagtggtatggtttggatctctgtccccaccaaatctcatgtccgatcgtggtccccactgctggcagtagggcctggtgggaggtgattagatcatggggaggcttcttatgaatggcttagcaccctccactttgtgctgttcttatgatagtgagttctcatgggatctggttgttaaaaagtgtgtggcacctccccaaaccccttgctcttgcaccggccatgtaaggtgaggatgcttcccctttgtcttttgccataattctaagtttcctgaggcctctccagaagcagaagccaccatacttcctgtacagcctgcagaaccatgagtcaattaaatcttcctttataaattacccagtctcaggtatttcttttcttttattcttttctttctttcttttttttttaagagatggagtcttgctctgtcgtccaggctagagtgcagtggcgccatctcagctcactgcaacctccgcctcccaggttcaagtgattctcccgcctcagcttcccaagtagctgggattacaggcgcccgtcaccacgcctagctaatttttgtatttttttagtagagacggggtttcactatacgttagccaggctggtctcgaattcctgacctcaggtgatccacctgccttggcctcccaaagtgctgggattacaggcgtgagccactgcgcccggccaggtatttctttatagcagtgtgagaatagcctaatacacctagcctgatgttacacttaggatcctcttcattattcttctgaatccaagcctccaactttatctacccatcacggttttagcttatattttgattttatttcttacatcttcccttatatttattattttaatattttgtttctcttttctccttctatacttgtactagatttatcagaatctgtaaatctcttttaaccctattaatttgttaactcagttaaatatatctattttgccaatgctcatcttcctatttttaacagtcatatatcaaactgtatttctcaactgatgtaccaaaattaaaggacacctagatgccctccctcagctaaagtgtttactactgcatccaaacccatgaattctccctaactgagagaggatatttagagggcctttgtgccttttttttttccccctatttcttccttgaaaattctggagctttttgaaataatttagaattttacttttaagatattattaaatttttttctacagcatgcctctgtttaaagaatcaaagctttttaaacatatcactagtcacatatattatctgtgtagacttagctatattatcatatatttatttttataaagatattgctcagcactattcttttacagttttatttatcttaactgacaaatgaaaattgtatatatttatgtatacaacatgatgctttgatatatgtaggcattgtgcactggctaaggtaagctaattaacacatgcctcacctcacagacttatcatttttttgtgagaacacctagtgagaacacctagaagtcacccacccagcaactttcaaatacattgttattaactgtagtcaccatggtgtataacggatcttttaactcattcttcatacctcactgaaattttttgtcctttacccaacatctcctcagtccccttacctcctctagactctggtaaccactgtttgaactctgttcctatgagttcaactttttttattctacatgagtgagatcatgtgatatttatctttctatgcctggttcctttttcacttaacattaatgtcctccaggttgaccatgttgtcataaatgacagatatccttcttttttaaggctgagtagtattctgttgtatacacataccacatttcctttacccatttgtttgtttttgaacacttaggtggatcccatactttgattattgtgactaatgctacaatgaacacgggagtgcaggcaactcttcagcacactgatttcaattcctttgggtatatactcagggattggattgctgtatcatatggtggttctgtttctcattttttgaaggaccttcagaccatttccataatagctgtactaatgtgcatttacatgagcagtgtacaaagattcccttttctctatatcctagccacacattatctttcgtctttttgataacagccattcgaacaggtgtgaagtgatatctcattgtggtcttaatttgcattttcctgattagtgttgttatttttttttcatatacctgttggccattcatatgtcttcttttgagaaatgtctattgaggtcctttgcccattttaaaaattgttatttactttcttgctattaagttgttcgcattccttatacattttgggtattaatccctatcagattatgatttgcaaatatattctcccattctatagattgtctactttgttgtttcctttgctgtgcagaagctttttagtttgatgtaatcccacttatctattttttgcttttgttgcctgtgcttttagaacctgatcaaaaaattattgcccagactagtgtcttggagcttttcccctgtgttttcttctagtaattttacagtttcgaatcttaggtttaagtctttaatccactttgagttagttcttgtatatggtatgagatgagggtccaattcatttttctgtatgtggatatccagttttcccaacaccatttatttaagagacagtcttttccccatgtgtgttcttggtacctttgtaaaaaaatctattgaccattgactatgtggatttatttctgggctttctaccttgttccattggcctaagtgtctgtttttatggcagtaccatgcattttgattactgtagctttgtagtagtttttgaaatcaggtagtgtgatgtctccacctttgttctttttgctcaagattgcttggctctttggggtcttttgtggttccatatgaattttaggattgctttttctatttctgtgaaaatatcattggaattttgataaagactttgaatctgtagattgctttaggtagtatggacattttaccaatgttaattattccagtccatgagtacaggatatctttccatacatgtgtgtcttcaagttcattcatcactgtcatatagttttcagtgtacagatttttcaattcctggttaaatttacccctaagtactttatttatttatttttttgctattgcgaatgggattgttttattaatttctttttcagatagtttgttgtatgtggaaatgctgcatcagcactaattcttacatattttatcttcttgagatcttttctgtttactttttatttgattgagatgctttcttagataccagtattggtatactttcttgagtttgtttctaaattatcttttcctcctcaaatatgtatttctgctgttctggtcttggattgcagttctctttattcagatgtgtgtgaacactgttctattgttatctgtggtcaagcattgcagacgagaagtctgatggtagactaattattttccctttttaacttacttctcttgtctgaatggaaggctgtagaatttttctctttgtctttgaagaaatttctctagaatatgtccagatgtcttttttatttagcctgactagaatgtctgagcctttttatgctaaaaatgcaagtctatcttcaactcagcaaaaacttcaaactgaaaaccgaagttttaaaaccagtgaagctttcttccacttttaaatattattaccacacctacttcttctcgtaattttttactttttttttcctaaaaaatgtagaaagtacagaaaataatgcggaaagttctcatttagcccaagcagagagttaaaaagataatcttttgtcatatttgttttagatctttttttaacagtatggttatattttaaaatgcctagaagactggagttaaagtcattcagttatttcttaatagtacttagagagttgctcatgaattggaggataatgaaatatgagacatgccagagcaggagaaggaaattctaggggctatttggggtcttttgtggttccatatgaattttaggatttaaaaaaaaatttctgtgaagcatgtcattggtattgtgataaagattaattgcatctttagatccctttgggtagtatggacattttgacaatattcttctaatttgtgaatatgggatatcttttcatttcttgtatcttcaattaatttcatccatgttttatagttttcattgtagagttcttttacctctttggttatattcattcttaggtattttttatttgtagctattgaaaaaagattgctttcttgatttctttttcaggtaattcattactggtgtatagaaacacctctgagttttgtatgttgattttgtatcctgcaactttactgaatttgtttattaaactattagatgatagtttaatgataaatgtttaaggtggcagatatactaattaccctaatttgataattacacaatttataaaagtattgaatcatcatgttgtaccccatacatatatatagttagttattatatgtcaattataaataaaaaattatatactacgttggttttcaaaattaaagtaataattaaaattcgcaaatgatgggaaaaaaaccggaagttcttgggggaaataagcatatttcacagtgtcatggaaattgagtcctgaatgtcaatattgtttcataaatacttgtaacatacaatgcaatagggatactacatcaggatgcttttggctccaagttacaaaaaaccccaactcaaattggcttaaagagggaagacatttgctcatctcacacaaaaggctactcagctttgcctcaatccaagccatcatgtaatcacatggtgggtatagaaatttgaggtgtacttacacctgtgtacatacctctagatgtaccagtgtcctcaagaataagaaatgccatttgccttttgtgtttcttatttagaagtgagaaagtcttttccagaatctccctagaaaacttgcctataaggtctcagccacaattcactcatacgctcattcttgtaccaactggtggaaagaaagaatagaattcacgggaattctattgaatctgacacagattgatctgacatagatcaacggttcccaaccaggtggagttttacctccagaagacatttagccaagtctggaaacatctttgtgctcgctggggtcccctactactggtatctagtgggtagaggccacagacactgctaagccttctacagtgcatgggatgcttcccacaatacagaatgatctgattcaaatgttaatagtgtcaaggttgagaagccttaacatagaccagttaggatctcacccttcagggccaaggaaagggctgtttttcactgaagcacagggctaaggaggggctatgtggatgttgtgtagcccactgggaatgcccactgccatgacgtccctcggatggagctggtcttctgagctgctcagaaagggaagctcggatttgtgggttttaggctactaaaaattaaccaaccacattgaatttcatgtttttctaattcattcctagtcttcttgcctgttaaactttctgctaaagataattctaatgaatttgagaaggtatttataaaagaatatctgtgaggctgtgtgttgcttgactggcagccaaaagaaatgttgcttggggaaaatggcacgaattaaacattgattgcccatcagtcttgtacttggggtctggggtagtctggaatacaggtagggagatcattcaagcttcacagagaggttcactagtacttataaatccaagcattgggagttgagaattgccagaaatagtcatgtaatgatattccatgttgtataggtgtttgcatttcttcctttctaaaaacacagtggttttggaaataataatatcctagaacagtggtcctcagctttttttggcactaaggacaagttttgtggaagacaatttttccctggatcttgaggggaggggaggatggtttcaggatgaaactgttcccctcggatcatcaggcattagattctcataaggagtgggcaacctagatcccttgcatgtgcagttcacaatatggtttgcgtttctatgagaatccaatgcccccactgatctgacaggaggtgaggctcaggtggtaatgctcactcacccaccgcccacctcctgctatgcagcccagttcctaacaggccacagactggtagcagtacatgacctggaggtttgggacacctgtcctagaacatcctggattaagcaattaaggatctctgcaaatcctagctccattgctcaactttgaaaagttgttggactgttttcagctttgggtacctcatttgtaaaataaagaaattgaattacaggcacttacaggtcctgcaattccccgtaactcagataaaaaatagatccctttctcccttcaggagaactcatgactttggtagcagctagagttagcatttgctcatgcttttattgtgtttagcaatcaatgggaagtgcatcaggtgaaatctctcaggcctgcatatgtctggtcaaagctcattcattgattttttttttttcctgctgaaacttgcacatatataaaaaacgaagacactaaatttaattttcaccagctcagtgtatagtattgtggctgctcatgttcctgaagagcgagttgttctcaaataataaactaagctgtataatctttaaaatatttgaccaggtgggaagcctttctgtgaggacaatgtgtttgtgcgtttggtgcttaagcttcaatcccctggccacagcttggatttatttgcaggggaaatctgctacgtaagaagacaaccactttgggcaacattatcttcatcatcagcatgcacgtgtggtaatgacctgttatgagcctgacttggaataactttcttcctcacagaatggtggatactccatatgtgtagaattactgagagtaattatctttgcaacagtaaggcgtgagggtaagaaatcaataaagcagaagggaaagatattaacatttatcgaccactttctgcatgacagcagaaggcggtcaataaatggcatactttattttaatcgtattaggtgattattgcagtattatcttaatttatgtgtgaagaaattgtggtccagcgaggttaagtcacttgctcagtgtccctcagtattaagtgataaagcagaggtatcaacctaggataccctacaaggtttggcttccatctggaagcactgagtacctgggcccagatatgagacagggtcccagcccagagatttgttggtttatcattccttcagcaaacacagcttacttccaagagtgtagaaattggggctgtgcttcatagcaagataataagcatcagaagggctgggtgtggtggcttatgcctgtaatcccagcactttgggaggccaaggcggttggatcatttgaggtcaggagttcaagaccagcctggccaacatggcgaaacctcatctctactaaaaatacaaaaattagctgggtgtggtggtgcacacttgtaatcccagctacttaggaggctgaggcaggagaatcgcttgaacccaggaggcggaggctgcagtgagcccagattgccccactgtactccagccagggagacagagtgagacaccatctcaaaaaaaaaaaaaaaaaaaaaaagccatcagaggagctacagtgatgctggtgaggcagacatttcctgactcatagcaggttacctttgtttcctcgttataatgagaaaaagttgccttccctggacttcctcctattcatcttttttttcctgtcctcttcttgcttaggatgccaaggctgtgacatttatttctgctctcttccctttgagatatgctgaagtcatttaaaaaaatgtcaggaataaaatgcactaaatgatgactgtcttagaaaagactccagttaagctgtgtgcatccagaaatgcaactgtgctgaccagtttctgcctcccttgccctactgataacatgatgggagatgaagtcgtttttcaaaagtgttctgggtccagagacgtttgctcgacacctgtgccctccattggtctaaaggcattagagtttttctcccacaatatttgtctttgttattttgaatttatgacaccctggttgttggtgtttttctttgcattcatacctgactcttgacctccaaaagaaccagtacatacattttactttaagctgggcatttttgtaatactatgcaaccttgaaaataatcgcagtgatattttgcttttttataaggccttctatccttctttgctcttgcatctctctttcccctttatgacagtatagcagaacatatttcattcttccctgagccctctgcagagcaattttgtaactgatttgagccatgtttttgatggagtatctgctctctggacctttccatctcctggttgcaactgtgaaccaccctgcctccaataatctacatccaaaatgctgagcaggagatttatggaatttgtttgaagatattccctgaactctctgaagctaactagttcctttgcaagtaagtggctggaaacctaaagatcttgtgaactgggttctagaagcatgggataacaaatgtaagatttcagactggaagttaaaagcgagttttcctcttgattcagtttctaaccagtcagctaaatggtctctgaatagttgtagctaatgagcaccatcccccaaacagtcaattgtcttgactattaaatacttaaatccatgtattttcgctggagtgtttattactatgtgttcttaggaccataattataaaatgttaagttaggacgacacagaatatttttctctgagtatttttgcctctttcatcagataagatgaaattcatttttattttattttacattattatgattattattttgagatggagtctcactctgttgctcaagctggagtgcagtgccacgatcttagctcactgcaacttctgcctcctgggttcaagtgattctcttgcctcagcctcccaagtagctaggattacaggtgcatgctaccatgcccggctaatttttgtatttttagtagagacagggttttgccatattggccaggctggttttgaactccttacctcaagtgatctgcccgccttggcctcccaaagtgctggaattacaggtatgagccaccgcacctggccgaaatgcatatatatatatacttttttaatggaatgcaatggaatattgtgaagtagtaaaacatgaataaactatagatacatacaacatgggtcagtcttactaatgactgtgagtgaaaaaggaagctccagagaaatacgcgtattatagcttggttataaaatttggaaacttgcaaacttcaacaatatactttttttttttttaaggaagaaaacagacaaaattcagaatagtggttatagttggggtgaggtgagcccatgagtaaatactggtaatgttgtaatttttggactaaatcatggattcgcaattcttcattatattattaaaactaagttttaaaagacccacaaatgggccagtgatgatagtttttccagaattgatagccatcaattctgatcatccaggatccttggaaataaattgcatggatgagctcattcatcacaaatctggggtctttaaagtttctgctgttcccagttctttggattcatagctatgatccttagagggcaacagatctctcccttctcatggcagaaataaaggtcagatgagaatgggagagccatcagatagagaccactgtggaggagtttgcgctttgggctgagcaaagagaagaccagaatcttttggtaccatctccttctgcatttgagatgaaacttagtcttttaaaatacatgcagccccagtcctctgtgttgccagtcacctgagctacctttgggggtagggttttgattaaatggcacgctttgctcatgagtaaccttcggggcacattttgttggtaagaaataaatgcatcactcatttgaatcagagctgcaagtgccatctgtgatgcactcctccttcccattatcacacaaatgtgtttctgtgtgactggttcctggattttgcaggctctcttgccttgcgccgattgctggctgagaggtctcagctcagcgttcaccacgtatcactatatttctattaatacttctgctcttcttggcaaaacagaagtggggcttcatttgaaatgatgggctggggagaggggaagggaaccatctcactcatagttattgacatcaagctaccatcatctcttgttcggataactatgagatttttctgctccctttatgcccccgccccaccccttcccagccactttctgtcctctgccagagtgatcttgtgaaggcttcaatcagaccagatcattctcctgcttaaaaatccccccgtcgtttcccgttgctcttagaacaacatccacactttttatcctgcagtagggggctctccatgctctagcccctgcctatgttcccctcctcatcatgcctttctgccctttgttcactatattctagtcaccctggccttctttctgctcctcagtcactccaagctcattccctctgcaagaccttggcatatgccatttcccctgtcaagaacgttcctgctctaggtcttcgcaaagcttacatgttctcattgttcaccgaacagtcttccctggccacccaatctaaagtagtccagccccacctcgaaggacactgtctcattgcaccttttattatcatcactgcatttaccattctctgaaattattctattcacttgtgtgtttatggctgtcctgattagaattaattttcataaagagaacaagaatcttgactggttcacccttcaattccttgtgcccacaacagtgactggcacatggaaagcattcagggaataaaagcacaatggaaaattaaaacatactcactgcatgcctgccacctatagaaccaaattaaatcactgccaatatgcatggggaaaaccttcccatttttctggaataatgttacaaaggatggaaaataagtgcacatcacctggatggcatttaataaacgctgtgacccagtagtgtacatttcagtgaatattgccaaaggaagtaggccaacatcaggtaatctgagttaactttcctgtacattgtgtattcgtttcctgatgatcaaaactggattaattagtctacaatgtatctttcctgttagatacgaagattatctgctctatccaatttgtgttttcttagctgagaaatcactgttgaattttaaaagcagcttgcctggtcctcatttcctggtcttctgatggaaatggtttatggaaaaaaaaatatttactagagtcagataattagaacattttatgtattttgcatatgctaatgcgtttgagttcctttgagggagagccgcatggcataaagcagaatgaaaaggatgattcaaatttcttcacccagcctcctcccctggccagatttagcacttcctatataccaccacctcacagcttagcttggctgggagctcctcaggtttccaaaggacggtccttccttctccctcccccaattgccatccctacaccagggtgccaactcccaagtgggctgacaggaagggagattggaaacagctttatagtagatttgatgctgttataagacacgttgtaagacatcaggtaaatatagcacatcagattttattaatcataagaattctttaaaagccttcagcagagccgagatcatgccactgcactccagcccgggtgacagagcaagactccatctcaaaaaaaaaaaaaaaaataaagccttcaacagtggctaaacacaaaaccagaatccctttagatttcttaaaatgcctttgtagttcttttgtaatatgggtccttgttggacaaagttagtaatttgttttttatatcctttacattaggggtttctaacccccaggccatggaccagtaccggtccctggcctgttagaagccgagtggcacagccggaggtgagcagcagttgagcgagcgttactgcctgagctccgtccacctcctgtcagatcagcagcagcattggagtctcacaggagcgtgaaccctattgtgaactgcacatgcgagggatctaggttacctgctccttatgagaatctaatgcctggtggtctgtccctgtctcccatcacccccagaaataaagtttctatgattacaataaatgtaacacacttgaattattcatcccaaaatggtctctcccgactccccactatccatggacaaatcgtattccataaaaccagtccctggtgccaaaaaggttggagactgcttcttttaatgatcatgttcacatacggacagtgaaaaggtgggtcttcttagaggttaaagggaaagtaggacagttgccacaaagctccctttttggagagtgcccagccagggagtgttactagggcccaccttggccttgctgatgtcttcagtggtgtccttgaagtcagcatgggattggcgcaggctcctgttggggcactcggtgaaggtcctccctcctccccagtagctctcatttccagggcccttattttcttttggccatctgggactgaagtcttgctcctggtgggctatctctgttgccctatcacctttagtgatttccactaaataaccctcttttaagcatttaggggaagagggagtagcatgaacgtttattgtgcagtggggtgagaaagtcagtaccagtttcaacacgccctccagctgccttcctccagggaggggacttcacactggctgtctccacagatctgcagtgcccttgccatagctccaactcctggccttctcccactccccgctgcctgctggcacatagagcccttgggccattctctgtgtggtattggcccctgcctttgcttatgctctctgctgtaagcagctaggcttagacttccctaagaggagtcccggacaccactgaggatgcattttcccttcctcacgtgaagagagcattaggtgcccttagctttggagggagtggagctttggagcctggagacaggggaccaggaccagattacccagcctccctagattctgctgaactcatctttcagtaaagaggccagatgagctgagctccacttctctctggctccatgttcctgtgacttttgactcatctgaggttgactttgagaaggcaatcccttttaaatatattggaatccatgtagtatgaccctatccactgtggaatcttactccattttactttaaagagaatgtaaatggtttggctgcacatcactatgaaaatggcctaagtaagcagaacggagaagctgccaggagagcagaggtggagagtggaaggggccaagccggttctaaatcgttttctgcaggctcctgtcctcagatgtactcacttcatgggaaccaaatcacatttaactgctctccagctcttaaaacaggataacttgagccatctgatatttgagaagaatacagcaacccagaagatgtattaatactctattctctaattttccagaataagtcagatcattgacaaatgacatacttgggctgtattaccttcctacagaaagactttcactaggtttagtaattagctatagcttcagccttttgttttgttttgttttgttttgttttgttttgtttttgagacagtctctctctctctgctgcccaggctggagtgtgaaggtgccatctcggctcactgtaacctccgcctcctgaattcaatcaattctcctgcctcagcctcccaggtagctgggattacaggtgcacgccaccacacccagctaagttttgtatttttagtaggtatggggtttcaccatgttggccagtctggtctcaactcctgacctcaagtgatccacccacttcggcctcccaaagtgagcttatgtctttttgaaggatggctatgggaaaagtccacttgaaggatgttttgtcatttatttacttactgattaattaagatgggaaagtcttgctatgttgcccaggctggtctctcgctctgtcatccaggctggagtgcaatggcacaatctcagctcactgcaacctccgcctcccgggttcaagtgatgctcatgcctcagcctcccaagtagctggaattacaggcacctgccaccacgcccagctaatttttgtatttttagtagaaatggggtttcaccaggttggccaggctggtctcgaactcctgacctcaggtgatccacctgcctcagccccccaaattgctgggattacaggcgtgaaccattgcgcctggcctcagctccctttagtttttaaagatagacttcctatcttataacagttttagatttacagagcagttgcaaagatagttcaaggagttcctgtattctctgcatccagtttcccctattattagcaccttaaaatagaatagtacattggttacaatgaacaaaccaatgttgataaagtatgtcaactgaagtccatacgtttttcatttttcctagtttttacctagtttcctttttctattccaagatcccataccatattacttatagttgttgggtctctggatcctccacagcaatttcttagacttgccttgtttccattatgaaacacttcagacataccaaaagtgtgtgtgtgtgtgtgtgtgtgtgtgtataaagaataccaatataaccagcattcagccctggaagcagaacatgaccaacatgattgaagcctcatgtatatccctcttgatctctttctccttccctcttcaaggacgaccaatatcttaaatttggtgcttttgtcccaggcatgttttgaaacgactatatgtagtgttgctttgcatattttattttatcgagacaggatctcactctgtcacccaggctggaatgcagtggtgtgatcatggctcactgcagcctctacctccccgggctcaagtgatcctcctacctcagcctcttgagtagctgggactaaaggtgcatgccaccacgcccacctaattttgaaaaaaattttctacatatgaggtttcacatgtcgaccagggtggtcttgaactcctgggttcaagtggtcctccctccttggcctcctaaagtgctggcactacagcagtgagccactgcccccagcctgctttgcacattttaaaacaatataagtattataagcattgctctacagtttgcttttttccccccacataacatgttttaatctgcattgctctaatgtatctagtttctaagtcagactctgttgtatgaatcccctctcttgttgatggatatctaggtgttttcctttctgttgctgtcatggtcattgcaaacagtgctgaacagacacctttacaagtcaccttatgcacgtgagcaagcattctacttggggagaggaattttggggtttcaaattttatccttaacaaagcagtttattcattcattcagtaaatattgattgactatgtaaaaactgagccaggttctagaggtaaacagaacagaaataatccttcatttatcatgagtttacaatctaattgggaaaatgaacattaaagaagtaattaaagatatgtatgtactatacagctgtatcataaaaataaagaacaatgtattgtgtgccatgaaaaaaatataaggcttattaagggatgtttcttaatgtttcttgtatcataaattacctaaagaatttctggacaggaaaatgctactctcctactgaatttatgtgctttctttatcgaacaatggaagcaatgtaaagcaaagtgtttcttttttgccttagctactaggagtagctctcatgtagatgctgtgcccagctgcagtgcctggaacagcccagctacatttagtatgtttatattttggctttttaaataaatggttttcatattgttctatgtcttgttttgcatgctgaatcattttgaatgtaaatgaggtatagctcttggagagaggacaagatatcattgataagtggttggtgacccccacttttcttttcagagacaaatgaccttgcttttacttggtcttgctgtatttatatagggatcttactgtatttgcatgcttgcttaatttcaatataaatttatgaaatttattatccatcaagagtcaatttgtcctctaaatatttcacttagatgatgattttttttaatcaccaccaacacatacacaaacagaactccttagcaattccatttggctgtactgctatctttaggaacatttatcttgctttaactcctctcttttttacagacatttagttttctgtgacattgtttactttcgttataccttaattatgggattctgataaccatggaggagtaggagagacaataaatggggttttgtgggtgattaaatgctaaagcaaagctgagatctttgataagcacaacagttgtttctgccagtatattccaaaggcaagactattcttgcaattacacaacaagcaaggggggagaaacacctcccacaaatcactctgatatgtttcttaaccactgtgcttttgaaagcctaatgctctttcttctgatgtttttttgactgtcagcctgagtagttggctcttccttggtacgaggctatttaaatgacaggtcctttctcagtgtgaatgtgtcagctatctaaatgagtggttgaaaatgtacctccgcatcagccatgtggaccacggcatggtctgaagaaaattatgtttgagcagctatgattgagctcaattttgcaaaagcttactgagttttaacaaataatttagccctatcaagcagaagtgcatttggctgcaggtaatagaaaactgaatcattggtggttttagcaagtaggttttctttttctcacatgacacagattggcaatactgtcagagacccagtttcttttgtgctttctgctctattttttgtagtctttcagcctttatcgttgggcttattgtctcagggttgcaaaatgactggtctgactgcagattttctaggagggaagtgcaaagtggtggtgctggccacagctttccttctttgtcaggacagcaaaagtttcatcggaactccccagtggacttgctctcttaattcaaaatggctgtaacagtgtcacgttggctgcacctgtttcaaagaaagttcagaaaattgggtatttcacagacacattaagatttcaaacaaagacgagagcattcacaaggaacagagagggaacgtatgtggatggggcaagtaactgccagtcatcagcctgttatgtactgtacacatagagttttgctgtgcagcagcaaatataaaaatgaatgtcatcaccatgaaagtggaaaaccgtatttcaatgtcatgcaaatgccataattgaaatgaaaagataggaaatgctggtgcattgtctacattaatgtatttggttgttgactttattgcataaaaagtatcagtggggacgagatagttttgctttgtttcagaagattttgcttttgtttttcccagctaagaagggaaccttaaaaataatgaggagggccgggtgcagtggctcacgcctgtaatcccagcacttttggaggccgaggcaggtggatcacttgagattaggagttcaagaccagcctggccaacatggtgaaaccccatctctactaaaaaatacaaaaaaaattagctgagtgcggtggcacgcacctgtaatcctagctacttgggaggctgagggagggagaattgcttgaacctgggaggtggaggttgcagtgagctgagattgcaccactgcactctgcactccagcctgggttacagagtgagactctgtcttaaaaaaaaaaaaagaaaagaaaaacacacagatgtatgaaatagagcttattaattctgtatatattcacagaaaacgcatacttttatgccttgattatctttaggtgatcatggggaacaggagcccaaagataattaacaactgtgctaaaacaacaaaacctcaattgggctacaaatgtcaatatcatgtacacaggtggaaaagactcttctttgatttcatatttttcttttatttccttggcatccctgttctggttatgtcttgctgtgtactctagacataggttttgtgggttgactgagctcagccgggtggttctcactggggtctcttatgccctggctcttaaatggcagctggggctcctacacatggcatctccatatggcttaggcttgtcacagtctggtggctgggttctgaggctgaagtttccaagagaccaggggggctgctgcaaagcttttaacctgagcttgcaagtcatgaagcatccactttccgttggttgtgctggacagcccagatgaaggggcaagttcccaaggacgtggatacctagaggcatggttcattagggaccaactttggagacaaacaaccacagtctccttccttctcttcccttggggattgaaagggttatcaaaagctggccagaaagagaagcaaagggtgaggataccgctgctgcagcacgtctgtagtagggaatgaacccagaatgtgaagagttgccattctagtaccctcgagtgtccttttcatgccattggaaacttgacaatagtaattgggagtgagttgaaatcttcagctttctacctttgtattgtcctttcagagcaaaaagaagtaaacattaacttaaaaaatgcttttgatattaatagttacaaacaaaaaacaaaacatgcaacaattccaagctcaaatcaaaaccaacactgagctttgaggtgcaatttctattctatgtgtgtggccatctcctcttgtgttagtggctgagcagagaatgctccattccaaaataaatagaattaattttcttaacagcatctttctttgtgccaagaacacagggttacaggaagcacatctgaatgtaccattggcaggttaaatcattctctttactttggtctttggtgggtttttatgtttgttgcttttcatctgaatgaatggcaatagagcaagttttaaaaatccttagggatctccagagattcctgtcttgctaagaaacaggaaggccgcaattagcagagaccaagaatgaagaggaggagaagggggcgggtgtctttgttgctgtaaactactagttttcaccattctgcaccttgggctgtgttgctgctgctacctggaacacccttcctccccctcctctgccgggaagactcccacttagcccagatgcagcccagctgctggcttctgcatgcagcccacctcttcttgctggacagggtggcgtcttgtcccccacacccacaattcctgtgcctatcactttgtctctgtattccttcctcagattgtagctccttagtggcagggaccagctcttagcctgatatcatcagccaagcaacgtgtaggatgcagaggtttggcaaaactttgaaagcgggaatgtatagtcaactatgtcgatgtctgggtcatttttccaatgtctggtagcaattgtgttaggtggcttatacctctcctggacccacacatagcaaattctaaaaataacaaactggaccatataagcttttccaaaagcctggggtgggggagatgttataatatcctgacatagctgtgctgttgttcatttcacctctgtcacctagagcaaccccctccatgttttccaaaaccgcccccatcctcggggtctggtttgggacccctgtcctcctggaggtcctctttgaaccctctggacccttctctcagagccctctggtaccttgatgtcacagcatttcctgtaatttcatttccctggcctcttggctaagataataggctcctgtccttgctttttctctgtcccctgaaaggggtgaagtcgtgtggacatgtggcaggtgccactattgtttatctgctgaacactagcactccccgtgccttcatgccatcaggcagggggcatttgttcttttgacggtgtggacaggggcagagtttagtggcattgttcttttttagcttaatgagcacgaactgtcagagcttggaccaaatttttcttgcagatatattttgattgacaggcacaggatttttggagataattgaaagagttgccaacatttatcaggagactgtacataaaaatacagagttccagtttccctcaaaaatttggaagttttggcaaaattgagtcccaattaccaaaaattgcttctaaccaagcagtaactattcccttcacacagaatgagcctcccttccctcatttcctgtaaaatggtactgcatgttctcctctttcatttgtgtcacctgcctcattggtgggtaagttgttctagaaaatgtctatcatatgtgctgctgtactgctaagtgcgtagagccctagtacccacagggcacacacaaacaaacctggtatacaaagaacttctgtgcggatttctttcttattgtgcacattttaaggggcatcagtctctgtccatgcatccttagaattgtatggctttttcatgatttgatttattcaacaaggatcgaacagtctgtttgtattgagtatttactatatattagttactgttctaagtataaactcattgatctcacaactctgagatgggtgcttttactatctccatcttacagatgagcagcagtttttttgttgttttttgaaatggagtctctctgtcacccaggctggagtgcagtggtgcgatctcggctccctgcaagctctgcctcctgggttcatgccattctcctgcctcagcctcccgagtagctgggactacaggtaccagcctccatgcccggctaattttttatatttttagtagagacggggtttcaccgtgttagccaggatggtctcgacctcctgacctggtgatctgcctgcctcggcctcccaaagtactgagatgacaggcatgagccaccgcaccctgcctagaagcagctttaataccaggtcacacagccaggaagtagactagctaatgtttcaccttaggcacaggtggagggagtcacacatctgtaagatttgttcccaggacaatatcattttctttaaatgtctgttttgggaggacttcaatgagctctcagatagaaacacccatttccagggagcattcttaccctagaaaaagcttgggacagttgtattcagacagctctgctgttgaccatgtaaggaactctctgccactcttcctcatagctttggcggggattatttgtctttagacttgttcctttttgtgaaagtgacagtagtgatagtcattagtagttagtagtcatggttacttttgttgagcacttacagtgccaaatgtagtaagcactttcaaactgtattactctccccgtttctacttgggaaactgagtattactgtgtgagtgatggggacttcttgaaagatcctaaacatgggaatgtcgtaatcaggttgctgtttcatggatttggttccgaaagccaagcagagagcgggtcaccagcacagtagtaagagtcaggaaaattggttgagactgttgtgtacaggggagagttgcttggggcttgaactaaagggacggtgaagagaggggtaggtttgagagagacttagaagatagtaatggcaaggcctggtaaaagacgggagtgatttccagttttacagtttggacggcagcatggataagaaagaatataaggggctgggtgtggtggctcaggcctgtaatcccagcacattgggaggcttaggtggccagatcacttgaggttaggagttcaagaccagcctggccaacatggtgaaacctcctctctcctaaattagctaggcgtggtggtgcacacctgtaatcccagctactcgggaggctgaggcaggagaatcgcttgaacctgggaggcagaggttacagtgagccaagattgcacgactgcactccagcctgggcaatagagcaagactctcaaaaacaaaaccaaaaaaaggtagaaagaaagactgtaagaaggctaagaaggcatcgtgcggacaggggagtgaagtgtcacaaactgtcagtttgatgtactctgtgactttcagttgaagatgtcacaagattacgacaaggagctcccagtgtcttcacgtagttttcccagcttactcagtaaatatttgttccctaaatgaattcatgatttccatagttactcagtaaatatttgttttctaaatgaatctatctgtaagcaactcaagtaatatcccctcctaccatttatcttaatgtttgaatttcatctccaaccacttaaatcatagtctctgggagatgggagctaggcattgacatttaaaaatgtatgttcggccaggcacagtgactcatgcctgtaatcccaatactttgggatgccaaggcaggtggattgtttgagttcaggagttcaagaccagcctgggcaacatgacaaaaccctgtctctaccaaaaatacaaacattagctgggcttagtggcatgcatctgtaatcccagctacttgggaggctgaggtgggaggatcacctgagcctgggaggatcatctgagcccaggaggttgaggctgcagtgagccgtgattatgctactgcactctaacttgggcagcagagtgagaccctgtctcaaaaacaaacaaacaaaaacctttgtgtccacagatattctaatttgtggccaggtctgacagccactgcttcagttttaatgaaacaacagatgaaacaggtctactgagatgttcttttactcatccatcaatttcatttttgagtgtctaccactgttttgagctccatgaaactcaaaagtaagcattgatgtgttcacctctgtgttcctagtaccagaactgtgcctggcacagaataggtgctcaatagatagttgtagaataaatgaatgttttatgattctgagcacttagagaatactgcgctctagtaacatacaaccatcagtgtctgtagctgtggcaggaggctttctgcttctgaggtctctctgtctggactgttgtgctattatcctctcatgtttcttcaaggcagaggggttgctgcctgggaaaggtgtacactttggagagtgaagtcagactttgctaagtgaacgcttggatacgtgttgtgcatctctgttcccaagtaccttctctgctatggactgaattgtgtatctccaaaacttgcatgttgaatctctacccccagtgtgatgttatttggaaatggggcctttggaagataatcaggcttagatgggtccacaaggctaaggccctcataggggaattactgcttttaaaagactaggacattctctgatcctttggaagtatatttcctttccatcctcttctctattacctgccttccacctgcatcattggagttggcttcttggtgttgacaaaccttacaatactcaggttgaagacaagagcagccgagaaggagcttttgtagggagtggttgtcagtgtctggtgctttaatatttccttccgttgggatttggaaaaggcagtcccacatagaaaattgttccagccgaggaacagcaagtctgtctgtcaatctctgggtatattgaagacatctctctgagtatattccaaatgtactcatcagtgacgtactgcttctccagaaggtccccttaggaagttgaaaaagattctaattcctaacacagtagctcctgctattttcctatgtatgtttttttctcgcttttatcttctgctttaccaaaatacatttacataaacaatattagtatgtgtacagaaaatatgaataaagaaataaagattaaaaaccttagaagaaatgaaaataaaaacttaagaattggaaaagaattctaaaatctcaaggttgaccaagctggagggtttttttgtgcatatttattgcagttctaccttgtgccaggttttagatactttcttttaatcacagaactttacaagatacgtattatctctattttatggattagaacatttaggctctgaaactcaagggcatgtagctgctacatggtagagtcaagattttaatttagcatgcctaactgtaaagcacctttccttggtctaaaggccagtgacagttcctaatgaaagttttcacacgtacacaatgaaacaagaaaatgaagacagtgtagaagatttttgataaagcaaaatacaattaactttaagaaacctgttcattattttaaaatacctatattggctaaagtttggcaatctaacgtcagacccctaatcattatatatatatttttttcttaaaagtctactcgttcgtgaaatcacaagttcacactcagggttcgtgatttaatggtggaacaaaacagaatatttaaagttgggaatgttccagaaaagctagatttacaagattgtcttaaggccccaaagaggaaacaaagatttggcttgctgatcagagttaaacattgtgtacaaaataccttaggaggaatttgagacctccgttatttcagacttaggaaatagccctttcttatctctcatataatggtacctgtctctcaggaagctaggcctcccttgcagtggtaatagctggcctgtggagccccttcacattgcattacggcaattccagtgcctccctttcccgttaggaatctaagcttgtactaccttttaaaatatcttcaagagtcaatatgtggatatctgagtgtcaaatctggcatgcactgtatttaagtatcacttaggaagaaaagcaaaaccctcagccccttgaaatgatttttaaattaactttttggtggaaaagtcccattttatctgtgcaacttaataccctttgtgcaattttagccaacttcttgaaaacacaggaggaaaacaacaactttcattatctcttttgctctgaatagcagcaatcatcaaaccaacatccaccaccttcttgttctcctgaacttacgtatttttgtatatgcaacaacttagggaaaaacataatggcaggaaagaaaaccttttcccctaagtaagaaaaatcacagaaaatcattagtgtgctaattaaggaacaaaaatcaaattgtgaaaggtttcttacccagattgaaatgaataggcctgggcttgttcccacagtggagacagggctcccggaagtatgctggaagcatgcaaggccacttgccgcctagactcagaaatgacacatcgtcacttccaccatgttccattgattaaagaaagccattcaggccagcccagattcaaagggtggaggaaacagaggttgcctataaaagaaggattttgaccatttttacaatttaccaaaggagtgacttggtcgaggatattaactaatttaaaggagttaatgtaggtgaagctcttagaatgcctagtgcatgacaattgttgttttgctattttttattattattactgtattctctctaggcgtttcccccaggagcttattgaacgtcctttaatcttttgttttgtttttaaaaatgatgttggaggaacaacggtgacttttcaggccctggaaatgctacatatgggatggtatcgtagaggtgtttctttgcctcccatgggcgcccccggttttgctctctccccctctaggtggcgctgtcggggatccccagctgtcccacgttgtcttgcttttcctttcctctctgtcaaaacgaattctcattcttgattcttaccactgcagtgtttaccaactttgagtgatatatttcccttttaaagaaaagcagtcttgtgaatttagttgttgttttatatttttattatgttacttaaatatgtacaaacataaagctatgtataaactaattatgcttgctcataacttttatgcatttataaaataaaggaaatgaaacttgaacagaacagatttaaaaattaaaacttcagaatttcaaaatagcagcattaacctaacatgacagatgatattatttttactaaaactacatccagacgcaaagccaccgtggcctttgatgcctcagttaccccacaccttctctgtttggactcctgcaagctcttcgaatacagtgtgctgtgaaattattatcaagttgattataaacacaaatatgagaactgaagttacctgacagtgcttggttataagatggctgtttaacttagtgctctcaaattttactgtgcaggtaactcaccagggatcttgttaaattgctcactttggtacagaggggcaggggtagggtacagaattctgtgttttaaataagctctcaggttatgcctgttggctgatctgggaatgacactttgagtacaaggatctgactatggttccatcatttgtttagattattaaacacacaaatatttaagaatcagtcgaaaacatgtttctggataggtccttggtctctagtctagtcactgcactaaaacatacaagcagttaggttgttagagcattatactagccctatgggaatcagatccagacaccaagcatgaagttgcatgtattgagtatcaggcatcagccagtaatatagggagggaatgatgattgtacaaagacctccctggacattccagatgcaactcacagatgatgactccttgaccagtgggacaggcctgatgtggttttgcctctaataaatcaaatctttccatttttacccaagtaaaattttatttgtactttccttatgatcaccactcacattttgcctggtcttacagtttaaaatgtggtacagctttctttttctatgttaatattctgagggcaaggatcatgttctattcctttttgtacttttcatacagcaggcatacagacatttgtggaattgaatgtattagctagataaatcttgagggtgccctctgctatttgcataaccaagtttttttctgaaaattccaggaattttgctctttctgttatatttcagactcgttattttatttactactgctgcttttttttcttcctaggaaagattcctaagatttaaatgactaaagcttagtctctgatatttgaacataaaccacatttttattgctcttggctctcaggtgcgctttgcttttaatttttatctgagaataaatgttgagaagattagaaacgcttatttagttgataatctgtgtgaccagaatttatcctttctaaatagttccatagcagtcttcgagagagaagttctggtagaagaggaggtagagtgagttgttctttaaaaaggaaatgcaagtttgtagagagatacccaggtgtgggctttatgcatgaaatatttttcctatgagaaaaaggaaaacagtgcctgaccttatcaataaaccattgtaagacgtcttcagcgtaggtcccaaggacattccaactgttcttttggactgagaaactctcaggtagtggttgggagaaaaagatccagaggtcgcagtgggatatttaacaaacatatgaatcagctgtatagcacatcagagaacagagagaccagacataaatgcataataaggcaatattctcatgatattgataagaactttttttctaagttctgttgatctgtctttctacccattcaatcattaatttaacattgtattgagaaattaaacacagactcaaactacacaaaataagcatagtttaatgcaaagattcccaaaatatggtctccagatcagcattgccttggaagttgtgaaaaaagcaaatgtttgcactccagtggagatttactaaatcagaaactatggaggtggggtgtttattttaacaggctcttccgaagcttcccatgcatgcttgagtttgagaaccagtggcttagcatgaactagtatgaggtggacactttgaaaccagcacctagctaaagaaatagacctgccagtcacttcagaagcccctccatgtgtcccttcccagccataattcctttctccttccaaattacccactctcttgagttttccagtaattactcccttgcctttttatagttgtgtcactgaattgcatatccctagccgcaatcatttagtcttttccatggatattaacttatctttcagtctatgcattcccccattgtcccctccttttccatacagtgtatctgatgaagaacttggactgttagacctgttggaggttctcagagtggattttgctggttgtgtactcatggtgcagtgtaacatgttcctctgaacttcctgagtatcagcagctggatataggggtttcatcaaatcttagtcctgtccttttgctaagactataggtgggactgcgttttttgtttttttcttttctttttttcatcaggaggcgcaggaagtctagttctcactgtattttgatgttaacagccatagatactcaatacttagatcgattgagagaagcataatggtgacagtctgtcatttcattttcatttattagctggaaagtcttagatggaataaatttagatcactatatggctaccttgtggtagatttcacacttgaaaagccggttgaatgctcagttttccttttatttacctaattttcaagatactgaattgcttccctgtcatgttcagaaggggaccaattaaagaaaaaaacaaaaaaaaaacatgaactactaggtttaaacgtagtggaagagtaatcaaaccgtagcaaatcatccctattgaagctcaaattgtcccatttttggccagtgggagcctcttcaacttggctcttgattccttttggtataactctagcactatttgattccttccttttttattacaggctcatcttgtgtatttcctgccccagaccaagagtcagccatttctctgagaatgcaccctgctcccccagttctttttgataggaaaaaaatgtcaaaaccacaaaccagattctcataactactgacttgattcttttttactgagtcttttcaatgggcaaaactgggaaatatccacttctatatctatatagctttttctatacctatacatagatgttatatgtatttaaatatatttaaagttaaaatacctcatgagtttatactgatatttccaattcaggactacagggttttaacgtcttctgtatggcatctatatcttctttttcctgcccaaacaatcttgattctcaaggacatagagtatgctagattagaatatgtcataattactcatttgcatgcttccacattacacacacaatattaatactaccaccaccaattatgattactaaaaagaattaaaacatttttgtgcatatgctattctcattttcctctattattttatagttatacctaatctgtttttatcaggtaatagttattaatgctatactctcttccatttaacccccatttaatgttcttagtttcatatatttgatggtcatcaccattttcacgtcaatgacatgacacttggttgtccaaagctcattctgtagtagtcgccttaggaagaagttatgggaacagaataccttgtgttcttacatgttgaaagaatgttttctctacttaatgttcatttttgcttggatataaaatccttggcttatattttctttcattgagtaccctagatacattagatcatatccttctggcataaaaccctgtcaaattctagtgataatccagtttttattttttcttacaagtcacattctctttttgcaagaagcccatagagattttttttctttaaagtcttgtcattttactagcatatgtcttgatgctgatagttatgggttgttattctcacataagtagtttctttttttgtatcttaggacagtttttcttgatttatagtttttaaaatttgttatgttttcttgttttactgtttctgccttctttagagactcctgttgtccttatgttgcatcttacttgtctgtcttcaaaatttatcaattcttgaaggcttcttatctttcttaagttcttttgatttttttaaaaaaatttaatttcccccttctacttttgaagttatttggttttattattcactcttaagtttcttctagttaagcctttttaagaacatttctaattcttttctaagctctgtcaccttatttctgaactttttctagttccaatttatattgttccttcatgtctagcgtgttttcttagtgtcttttggcaaatctggaaattgtatgttagaattgtgatctgattttggagccagttttcttggtgtgctttcattatctgtggaaatgttgttttattcgttttcctcttttatccttaagcaataatgtgtggaattttctctccatgcttttctgttgctcattttcctcacgttttagaaagagactttgttcagatggatttttctaacttcatagagctctgtcttctattgtttttatgtaattttttttaaaaaacttgctttgtaaatttttatgttgttttttccttttccactgttacctgaatcttctctttttttttctttctgttttgctcaattttatttttttcccagcagcttctctccagtgtggtaccttgttttgagagcaggtgctggctaattgtgtaacaatttgtgatttatccttacctatttgtatcttgatgtttgtgaggataccttgtctcccagttttgttgtaaatgtccattaatttttgaacattctgtttgatttcattgctctgtctttcgacatgtagggattctaggagttccaaaaactgtgtcactgctaccactgccatctcctcaggaattcctcagtttttcaaatgatgatttttgaaattttagagtctataacttgagagatatagcatttttggagctgggacaaaaaagtttttaacttaattatgggaagtaatgaaaagaattggcttctaaaatgcaatgcagagatgcataaatgtattctctttatcttgcccaattacagagcaaaatagatgacaatacagaaataaacatggtctggagtagaagtaggttaatccgcatgctttagattgacttacagtatatacactttatttcttcattcagtgaataaatttatatagtgccttacaatggacagatactgtacaacataaaaaatatgttgacccttgcctgtctggcctaccttgaaatgctgtgtataacaaaattacacacagaagacctcagatgtggcaaagtgaagtgagagggaagtgactttcccaataccacacagtactttgagaattagaccacaagcctggatatctgtaactcccaatccaagacttcttccaccccaatattcaatctcattactaagtgtcaagaaagtggatttgttaccaccaaaaaaagaaaactttctgacattgagtgtgtgctgttttttgaagaatgttgtgaattctctgttcttaaaaagtcagtagtgcagctttcaatgtagagttcttttgttcaggcttacacaactatcaccattcaccagataacttgctgtattccagacatcattggctgctttgtatacatattcttatttaaccctcaccacctggcaaagcattgtcctcatctctagtttacagaggaagagacttattttaactcagagtatgttgtccaaaattaccctgctaatagactggtgattctgtggaaacagacactttcttcttttatatgtaaagtgttctgggtaacaaataatacactctcttctcatcactgtgggcaccatggtctgggtgcctcattggcctctctatcccctcccaacacatacacagaagagaggagaggagagaagcatcctaaatgcttgactctctcggcagaaagtctactgtgtctaatggtcttgtaggagggaggcagcgacatctctctccctgccttcttcctttccattcccctctctactaaattagctccctgagcatcagagtgtaaatccagtttctcttacttgtgcaaacatggacattcttatgccactttgtgtgtaaaatttttacatgaagtctataacctgttgctttggtatgtaaggctgtagaatgagcaataacgaaaaccagaaatgtttgggggaaagaagtttttgtctgatcttctatattcattgacccagacaagtgtcacaaggaccatgagagtctggggagcctgggacattgcccacactctgctaatgaagaaactgaaccacacctacatctttgtctagtcacacctagcagcctctgaccttgctctccttgcctcactctgatccctctagaatccattgcacataccaaccaactcaggccctaaaactcttcttttgtgaggttactttccagtctttaacctattggctttttctcattgttcctcaaatcaaatctgaactccactgtctgcaagactctcccgttcttttcctgaccaccttggctgacagctcttggagaagagggcttagattgataataatctgtgatcctttccttccaccttgcctagctctgccagttcatggagtaacattttcttttccacagttactgtaaaaagaaatcgattctttttagctaaagtaaatgacatccaactctccttacatggaaaaaaggcactaaagtgctgacagataccatctcaggaatggatggatattcttgctgtttctcttccaggacaatcagaaacaaatttaactggtgaatggccattccatgtggaagggaagtggtaacatagggcactagattaacctagtgcacttctcagtaggattcatggtatttctatgtaatttccacttacaaattacacatctaatagaatcttaaatgggaagacaaggatgagtcatatgcccaatccacatttatgtcttcaaaatacgctttgaacaacaaagccacatatacatgttaaaaggcctagtaaacttctagaacactagaaaatcctgattgccaggatctgttagtcactccactccagacagggttttgacaaaatgccttttcccaacagaggttaccatcttcacaagaagaccacatttgtatatatgtggccagcagcattcgccagggtacgtacctcaaggaagcttcaaatggccattcagtgcgcactcaaaagggatcctcagaggagcattcagaccatttgcttaaatgattgtgtgctcattaaggtgggcagatctgcagtctcaactagagatctggtagttaatctgggtccaggatgtttcttaactaaacatgttaaaggagccggataggttgctctctactgccaatttatcggttttacttttctccttggctacagtgcaatttggctctttggtttaatccccttgagaagccagaatccattggcatgcggagctctgggtcttagagcaatatggctctaaaatgtacgaggtttattctgatggtccctgtcacattagcagatggtggcatttaccatgttgatgggagaggagtccttgtgctctcagccacagatggcccgggaggctgtcccagcagcagcacctcaccctctccaacacatgccatgtagttagttgttccctctctttgttcctataccacttacgtttgcatttctttcatgcagttcgttggtggtggttatagtcatctgttttgatgcgtgctccccatattaggctgctaaggttttaggggcaggtacctggcttctcctccagggattaagagatgcaacgctatgctcaaggtcacaaaggtgctgagtggcagcagggtaggattctaagcctcattcatcagtctccaaagttcaggcttttaattagaaggcctgtcatatcatagaaatcacaatggtcctcttagggcaaaataatgggtgtgaaatcgtggatggtccaacgataattacaataagaatcgtttatttgtttcttagaaactgaactaatcattttacaggcatcatttcagttagtcctcctaatagtcctatgcatgaggaatgtcatcaccattttcagatgagaaaattgagtgtcatagaggctaaatgacttgccaaccaggtcacacagctagtaagtagctccaagtctaacccagattgatgtgattccaaaaccctggtcttgggcatctgactgagaccccccaatgtatgggtgccttgctttatctaggctcagatcctggaggtcatttgttgttaccttgaatataagaaacacacagggggacaggcagactctgaaaatataaagttcattcccctgaatcaaatgcagaaaacagttctcttatgggttgtcccacttttcatttgaacttagtggggaccacgggaggggctgttgaaaatgaccagctctttcctctgccaggcttcctacacttacacacacacacacgcatgcacgcatgcatgcacacacatgcacacacacaccccacttcatgcttagacagtgataaagtgagtagctggggcaagccccccgacatgtggatgactatggtggtggtgatggtaggaatggtgccttatattagtgtaccttgtacgtttacacatatttatttgatctacctcaaggtaggtgaccaagtattatcagtccctttttcctcatgtaggaagaaactgagtgtcagagtaattgagatggagcagattcagactcaggactcctgtttcctgatggagtgcactttctgctaaagtaatagctttcaaactgtggtgggttgaggagccccagaagccatcataataagtgagggccaggggactcaaagacctacatcctgcttcaactggagcatctctgcttttatttgacgggtatagagggttctgcatgtggttttattttatagaagggtctgatgttctaacagtttgctactgctatgtaacaaaccactaccaaaagttagttaattattattgcccatgcctgtgtggcttggcagggctctgccagactgctctgctgcaggtggtggctgtggggcagctgggatggctctgttcctcaggcctgtcactctccttggacgggggatagatggtgcatgtcctgcacatctttcaggcttagacttggaactggtatactgtcacttccaaagcaagtcgcatggctgtgcccaaagtcaaggggtagggaagaacattgctcataatgaggctatggcaagggaatggacgcagagaggggtgaagaactggggacaataatgcaatctgcaagtccatgaaaaaattgtattatcactgctctgtttaaattaggctattaaagtccttcaagacttatttatccataaaatcaagaggaaatggctgttgtattgtaaaagacaaaggacttctacccagagataatcaggtctgaggactgttgcttctgaatggctgccagtttggattgtggtcagtgttctcatcttttcacagctttactcaggtagggtggatgtataagtgtgtgtgtcagacagagagagaggtgcaaaatagaagcacgcctctgtctatcagccttgtcagcttcgatccttgtttagtctgtgctttatcttctcccgtctgtcaatgatgtcccccaccatttactgcaggcgggtctatagatccagtctctcccctgccagtctctctttgtttgttgccctggtgtcactgcacctctgagctctaagtctttaccttctgaaagccattcctaggacaatcattaaaacctatggtagttgataatttctgaccctaggctggctaatttgccttcataaactgtcagattctgctaaggtcattgaatgctgtcatcttcataatgtggttcaagcaaaatggataagagaccaaacaaggagaaatctccctagaacacagtatgccagcattgctgtatctcaacaattaaaaaatggtgcgggagttacccagtagaatatttagtgaggtgtactctatgtggagttcataaatacaaatgcaaaatatttaatgcacagaatcagagttgcaaaataagatttaattctagaggattagggagacagaactgacttaaggctgtttttcccagtaagcttaattacttggatgacaatcattaaacattgcaagtcacctatcccaagtgatcgaagggcttttcaccaaatgtctgagtgagaaagtgattatcttatagaacaaacaagtatgataaagggaaacaatcagacaagtaattatgataaagaaaaacaagaaaaacggcacatccagcctgttttgtgggaagaatcacagaggcactatgtaagtacggctcctttatctaacagatcatttactaactatctggagtcaaagtcaagtttatctacatgctgaaatctatttccttctaataagattccatccacttggatctcagttatgtggcaatcttgacatggaacgtgtctcggaatatggaagggcatgagaaggcaccaaatcttcaaccctagcgctcgctcagggtttgattagagaagcagaatcacaggattattttacaggatttcttctctggatttgacttacgcagctgtgggctctaattaagcagacaatggaaagttgctgtgtctctctctgatgctgggacctgaggccagcagggtaggcagttgggaagggaaaatggacacgaagctggggaagcaaagacaaattagaacccatggggataagctggaatccatcaagatggactgaaacccacattggtctcttgctgcctttcaaggaacttccatgatggaggcgacttccaggagaagccgactgcccttctccatggaactcagcctgcatctgcccaggagtcagaggaggtgagggaggagatctgggaagggctggacaggcccatctgcttcctgccccctcagcctgctggtgagccagcagataacccacaaaagcctcaacagcccctggccccccatcaactttcaaaggcaccaatgcaaaagactatagctactgcttcagttccttcttccaaatgtcatatgaaatgcctcttaggggtctatactaacccagaactgtgcaggagagagaaatctgggaaacacagttccagcttagctaggttgacttgctataagtcaaccacacctagtctcactaagcccatttgtcatgtgtggcccactcagactgaaagaatctttgttggttcactgttttataagggccagcctttaccagtttgtccagctagggcactaagttcttagatgcagacatcagttctgtattccctgttaaggatctgcttccttaataggaatctttaaactcctgaatttgtaatgacacattcaaaagcattatttgagactaagcagtaatagtgtatggcaagctggacttacagtcctgtgtgatgtagagatacctaaacataaatgggcatggatattgtacacacatatgtgatgcaaataatatacaaatattgacataggatgatctagagttgataccagacagtcctcatcagtgcactgatgaaaccccagaagaaaagaggtttagccagcaagttaacccatgctgatgagcatctaccatgtggcaggtagcttctagaggtgcaggggatacaacagttaatggtacagtgtcagccgtgaggctcttacattgttttccaggttttctcaaccatgacatcattggcattttctgttgggtaattctctgttgtatgcatctgtcctgggcattttaggatgtttaacagtgttcctggcctttgcctactagatgctggtattcctccctctcttcatccccatccccgctgcagttgagatcataaaaaatgtcattaatcattgccaagtgtcacatggggcaaaatcatcctcagttgagaacctgtgtttcagaagagacagaaaaataccactgagatactttcagatgctaataggtgctcttaagaatataaagtaggctgggtgcagtggctcatgcctgtaaccctagcactttgggaggccgaggcaggcagatcacttgaggttaggagttcgaaaccagcctggccatcatggtgaaaccctgtctctactaaaaatacaaaaattaaccaggcttcatggtgggcacctgtcatcccagctacttgggaggctgaggcaggagaatcacttgaacctgggaggcggaggttgcagtgagctgagatcatgccactacactccagcctgggtgataaagcgagactccatctcaaaaaaaaaaaaaaaaaaaaaaaagagagtttaaagtagagtgatatggttacatgactaccaaggtggttgaggaagcccttgccgaggaagggcctttgatttgacatgcaggcagcccctcagagatctggggacaaaatgcatcaagcaaaatgaagagccagtgcccaggtcctggaggggaacaaatgtggcatgttgaaatagcaaaaaggctgggagacttgcagcatgggtgatatggtttgggtgtttgtcccctccaaatctcatattgaaatgtgattcccaacgttggaggtgggggctggtgggaggtgtttggatcatgagaggagatccctcatgaatgtcttggtgtcctccctgaggtcatgagttcacacagcatctggttgtttaaaagacctgggatctcccgttctctctcttgctccagctctccccatgtgatgcattggctcccccccacccttcacctttcaccatgattgtagcttcctgaggcctcaacagaagcagatattggcaccgtgctttgtgtacagcctgcagaactgtgagccaattaaacctcttttctttatagatgacccggtctcaggaattcctttataacaatgcaaaaggactaacacagcaggtgaggaagggaagagaggagggcatggggtagggaaggacagccacaacatgggggaccttgtgcatgggtcatggtgcacgatctacatttaactctggctactcagggcagtcatgggagagatgtgatcggggagtgatgcaatctgatttatgccttaaaaggaccacgctggctactatgtggtggatgcacaaacagctcttccccttctgcctcctttgccttgtgacccacaaggacccatgatacccacctgcagctggctgttgccatctattcggagttgtcaactaataacagacaatctcctctgccctgtgacccacagggacccatgatactcacctgcagctagctctttccatctatccaaagttatcaactaatagtagtctctgtgcctacaaatgattaaaattgggcttgaaaatatggcaccattatcatcagcatttcttgagcgctggccacttgtttctggtgctcgtgtgtgtacatgaacatccttgctgtgagtgctgggccccaccctcactgccatttaaaaaaaaaaacaacaaaaaacaggtgtctgcagcctctggtgaacatcagcttctccgtaaggctataatgggagacaccttcatagattttgagttcggctaaaataccctcctgtccagttactacctataatgctcttttcccttggatcagaaagccttttctctgtggattatttccctccatctataccccacattactaccccatgccttcataaggttttactctttactggcgttatgtccatttatatttgaattacacaagcatgaccattcatgctctttactcatagaagggcaccctgcccttcctggaaaaatgatttactttcatattggataccatttgaatatacccagctgtctgcgtggaaatagagaagtagacagaaagaagcctcctgctacagcctaggagcagaacagtaaacccaggtttccaaaatatctttctgaggtcattacagggtcatagccctggacagcactattcctaagtcatcctgaggcattctttgtgtgacaggcccaatggcatggcaatggatttcataatgaaaataatgaaacattgagataaaaagttaatttcttcctggaagagtctatttaataatgcaggaaaatgttacactttttagttatacttaattataaaatgctagaaaaataggagtggttttggtgttgaaagagttatttatctgagagaactatgaattatccagaatgcttctctaaagtttcctttttcccaaaattttattatttggcataatttcagtggaatcttccaaaagacattagtccattcttttgcttcagtgcatgtttttttggatagatattatctatttttgtgtagtgttgtaaggtttccaggatacgtaaaagttggaggatatatggttggtgcaaaataattccgtagagtaatgagattgaattgggggaggtggtttaaggaatacaaattcagtttgcctaaatagatgtaaaaaggaagggaaggaataacatctgaagctaaggaaggaaacttttgggctggagcatgactagataggagtcgggtagagctttttaacacagttgaagatagctgtggacgtagatcatgggcaaaactggtaatgtgaggatttaggaagcacgtttttaagctactgttgagtttcataggaaaccataccccactggtcataagagacattcaccaatagttttccatgggccttttgtgctagtggtagttttgttgggggcaggatttacaaaaatgaccatgcatttgaaaggtcaatgatgaaggtaagtttgagaatgaattttccatgaatgtcctgcaagttttattctttctgtgaacagcttgaattttcatttggtttgaagattaggaaaataacagtcatatatactcacagatcaaattcaagtactgattttagccatctatgagcaaaggccattcttggtgttagacatgaaacaaacgagagagaaagaaggaaagagagagagaaagatgtgatggactgccttggttctcataatttagaagtgagactataggtatatgcacaaggagctctgatgtgaaacatggatatcatatatgtcctaatggaaatgcacaaatatcctaatgggcttaggaagatttctagaaggatagggattccaatctggtttaaaagaaaagcctgaaaccttggcaaatgaagtcagcaaggatattccggtagcagaatgagcctgggcaaaggtgaggagtggagtgttgcctattttgttttgtgaggatgatagattcctgtaactggagctgcggaggaagtagatgtattggagattgtccttgaaagtatccagactgactcagacagcaattgtgaagttcttgctgatagatttgtactgtattttccatgcaatgcaagatccattagagggatttgagtaggagattgtcatggaatatttagaggatataattcagatttaaaccatggaatattttccttgatactattaaggaatgatagattctttgagctaaaaggagcactagagattatctattgaggtagtttccaaatattgttttagcacagtggaaaccttctttcaaatgacatcttacacaaatgccccagctacaaaacagatagaagagcagttcttgtggaatcatgatgggaagagtcttgatttgctgctttctgtttcttcattcctgtagcaatccctgaggtacctctgtagaaagcacaaaatcatggaacaacctgccgttttaaagatgagtaactcaaaagaaatgaaaacatattatgaaaccacacataccataacatcaccagcagccttattcataataactgaaaagcaggataccacccaaatgtttaacaggagaacggataaactgcgttgtgttcatacagtggaatagttctcagatgtgcaaagaacaacttactgattcatgcaatggcatacatgaatctcagaaatattaagtaaaagaagcatgacccttggatttcatttatatgatacacaagaacatgtaaaacgaatctagggggaaagaaattaggaagtgatggcctgggtggcagggaggagaactgattcaaaaggagcacaagagaactttctgggatgttggaaatcttctctatcttattttgcgggatggttacatttgtgtattccgttgtcaaaactcatcacgtggaacacctaaggtgtgtattttattgtatgttaattgtatcttaatgaataaaagttgagtttgaagattcttggagggagatttgctcagttcccatagctaggcatgagaaagactagcagctagaacttaggtttacaggattcctggtccagctcttttaaccgcatctctctccctcagagtcatcctcctcttcaccaacacagcatcaaggctggcttctccctccctggacatcctcttccctgctcaaaccccaccgtggctgtgaagtattaacttgacgacactgtgctctttgactcagcttttaaactttcctccagtgaaaccagaactggcaaacacagctacacttttcttgtaccatgctttacctgtattgccaacctgctgataaatggctccattccatagccttgagggtcttgaatagcttaaacattttatagttccatgggaatgagacaggggagaagacaccagtggcttccattgtaggcctgtctacactgaaggaatgccaactgcccacacacacttgttgttagatggcctggaggctcatctgcacagacgtgcagtttaactccattagggatcacagagtgatcacacactgtgctgtgctctttggtatatatatgaaaagcatcgctaagagaatgggagaggtggtgagagtttattgctgccttctttctcatggaagcattggacagcagggcagccctagtgaattgttgactgctccataagaatatcttgctcatttaacctcttctgtactaggtcttctgcctggagagtcctgggctacactgcccatccccagtatcccatgtattcatgtcagattcttgcagtctcctgaggatctttcaaggactggaactgcatcttcaccatctttgtgttcccagtgtctgcaacggtgccttattctagaaaagaacatcttaactgggagctgttttgccaggaccatcatcaaaaatgtctgaagatgtttttggttgtcaaaactggggacagggtgctactggcatctggtggataggggccagggatattgcttatcttcctacagtgtacaagacagttccccataacaaaaaattaccccacccaaaatgtcagtagtgccaagatcgagaagcccttctctagattatactttattgtatagaagataatagatcaaccacatcctcaaggctgggaccaatgctttgcattatgatgggtgtcttggtttcttttatttccactcttgattctctaagcatcatattcaagctctgagatgaggtgtatctgactgggtcaggtagccactgagcaaactggaataggcctttctgcagagtttgaacccaagtcaatgttgcctcgactcaagctcagatacctcatctaatcatcagtagccatagtaatagtagcccttagcacagaccactgatatctactgcttagaaggggtttgtgggggtagaaaatgaggttatattaagtttacttgcccaaagtcacacagccagtatgttttggagccagattcaaacccaggttgtctgaaggctccaaaagtcatcatttatcactgtatattttcttcttagctttcttgcatttcctttaatgttcccatctctccctagtgaaactgatttccctcaccaggaggttctctaggaattttggtccagggcttagattcttaaataagagcagggacatcaccatgtttgttatacgctgtcatttcacctcctctgttctgaatcagaatgaggccagcactctgggttctaagttatcgttttttttttttttttccattctatatactccctaagaatcttttttatgcttaaggtacaagtttaaatatggaaaaaaaaatctagattgaaatgaaaagccagacatttcctagttatatcactaattaactgtgttactagtgataagctgcttataaatctttcatcattaagataagattaccttctagatcttaacatttatgatcacagggataagttttttgttttgttttgtttgagacagagtctcactctaccacccaggctggagtgcagtgtcacaatctcagctcacttcaacctctgcctcctgggtttgagcgattctcatgcctcagcctcccaggtagctgggattataggtatgcaccaccacacctggctaattttgtattttttagtagagacacggttttgccatgctggccaggctggtctcgaattcctcctgcatcacctcccaaagtgctgggattacaggtgtgagtcacagtgtccagccaggatagttcctttttattgtaacatatccattttttcttcatttatacctccagtatccaacaagttaggatgcaggaattaagaaagaatcgtcctaaagtaggaaaggcaagatttgatgaagttggtagaaatcaagaagcacagttttgtaagctttgcttgggtgtggattgggaagctatttcttatttctccaagagtgtttagcttctcagacaatttctgcctcagtttccccatattttaatggggggaccaaacacagcatggtcatgcatgacatgtgaccgtaatgaaagtgtgactagcacattggaaacctggtgtggcagaaatcacacttagaatcaggtcaattaggagtcaccttagttttcttattgaaaattatgtgtaatgctgaaaaattaataagagagttccttaaaataacagactgaatttcgaagtttaggtgataattattttccgaagtctgacctgcccaagaccttatataagcacgttatggaaagcaagagtggtatatctttactaataaataagtatttctccaaactttgaaaaacattctgaagcttcaggttaaaaatatgtaaatggaaatgccctccacttgactgtatcacagctgttccctgtccctcatttgctgaaggactgagtacaccccaaactggtcagagcatgatgactttcagtaatgacctaaatgaccttaaaatatcagtaagtgacagagtattcgaagtcacagtctataacattcgcttagaatttccccttaagctgctggctgaagcactaattaagatctgaaatggaaggtaggtgacagatgctttgtgtcctgcagcagaggcacagaatgctgttctttcacttactgtttaataataataataacagccatttaatctgtttgctgatacagtctcctttgctttattatgttgtttattttgtgtgagctttcgatattagttataaaaatgtcactgtgtctgcagctgcatttttcattttagaaactcccagagatctcatcaatttaacctgccttgtacagttcgcaggaaaccactacaggcaaagataggcttaatcaaggttttttcttaataacgaacacaatacacaggaaagcagggcaacgaatgagcctttgattctaggtaaagacttattatgtgaaaatctatatttaaattaggggctttttgctaggattcttaactgcacaagacaaattactgtaggatgtctctaaacagcaagtgtgtcttaggcatttgaaatataatttaatctattaacagtttaccctagattttaagccattcattgttggcgaacacaatctagattctttaaaataaaaatagaaaagcatttgcagtaactggccattattatagctatagaaatcaaaggtatttcttgtataaattttgaattatatattgtttatctctccttaataactttcactatagaaagagctctctttcttgctcaatttacataaaagtatctggaacagttcagtgacaacagtgttggaaattaaggactgacttgagactgaagctccctccataactcccatgcccttctccagtactaagtagtataaaggccaaaagtcagataaacaacataagagaaggtggcagtgctagagatggggatgaggctgtttcatataatggaaggacaccagttgacattttccaaagattttccattataatcttttgcaaaggttctctttcactagttaacaaatataaaagatgccaactcccaccagactccagatgcttgtaatagaattagaaggccctccaacctttctttccaggggtcctgagggggacgtctttgttggcaccccaagcctgagtcactcctagcacctcaggaaagcatgtgttgtgtggcttcaaggataggcatcctaggagattttaccacctatccaggtgccctggctgggtgaaaactgtgcatcttatgcttcctcaatagtgctgtgagaatgctccactgccagtttgaggtatcaggtttgggttttcaggattgcaagactgctgtgctgtgcgtgtactggtgagttggctccctgcctttcccagcacccccatgcctccttcttcacatcccctttcaagtagaatagggaactgataacccaaccaggccccttattcccatcagatagcaagctaatcactgagacaacaagctttgcagtagagaaaagattttattcaccaggcagccaagcaaggagacaggagaatagatctcaaatctgcctcctcaaagatgaggtttaggaatatttatggaataaagaagcagtgtggtctattgtggggggaaaggtgattggaggtgggggaaaggtgattggaggtaagaaaaagggaggtaattggtgatctgcacagacatagtcaaaattcatggctcttcataggatgtatgttcatgaaatggcattgttagcatgatctgagggtggagtttttgtcctctgatgtcaaaagtcaaccaacagacattcatacaggcctagttgatgggttggtggtctcagccagtttgaactgggtaagaactgacctcaagttcctataaaacaatgtaagcaactgttaccatgatgacctatacattagagatgttacctatgaggaagctagtgagagtttagatacttttaggtatataggttttaagatcaactagaagtaagcaactaaaagcaagtgaggcaggttaagtttgtcaggcctaatcaggttagccctcgctttcagagtcatctgcccaagtacagtaaacagatccagctactacttagatactttgagaagtttagggttgggctctttcttcttagctttccccttcatagaggaaagtccacatttacttcacatgctaacttgtttgctgttagtagaaatctgcgggaagtttgccagagaagggtagcctttggggattggccaaccagctagcagggacctctgctgtgagtggcccatgctgtctgggcagctctgttaggtaaaggagaaagccatttggcttgtgtagactgcagctctgcaggaacctctccccaccatctctagccaccacctccagagtacagtaaattgtagacttagatttgctgtttccagcatagatgtcttacactttctagagggttccctctgctcacatagagccgttggttaagtggtggtgctcattttccatgccctgctggctagtccttggacattgtgagcatttttgtctccaatgccactgaattccttaaggccttttgggtgggtgctaaatatttaggcaactcttactaagaaaatagaaaacacttgagttctctgttttgcatgtggctatctttacatcagagccttggaagtggtcaactgtatgtagccaatttcatgaggctgttttaactgggaggacattgtcacctggctgggcttatacagctgagtcaataaggaaaacgcagcttttgttggcttgcttaccttttaaatcagtaagtaatgcacaaaatgggtccctcaccaccactacttcctttaaacctcatccccaactccacatcccatcatcatctctcatctcatctcgcagctttagctgatcccatggtggggaactggggaggcatgaggttgggggtatatgtgtgtatcatatattacttgggagaaaaaaaattgttttaggttttattacaaagcacccaagttaaaagagcagtgttaaaattgtcttatcaaaatatcccgtaccattgcattttcctgtttaaagagactgccataaactctaggggctacccaagtgaggagacgagattatgattaacaatcaaagtgatggggaaagttataaaaataggaaaaaaatatttagatataaagtcactgacctatgaaaccaccttgcaaatggtaggcaaaagaagtagtattactgaaaaagtatgaattgttacctttactctgaaattagtatgtaaaggagcactttgtttactgcactaaatctttgtctccagtttttaaattatgagatttatattgcctaagtatagactgaatacattttaatatttaattgttttttctcaaactatggtttgaaaaacaagataattcttaagctgggtttcattactttgaaaactaacagtgttttctaagagaacacgttactgatttaaaaatgtaaagtaataaaaatagtattcacataaagtttcagtagagttttagcacagaacacaattaaccagggcttaaaaaaaaccatttaattttgaggcaattgtagttatttcttgcagttgcaagaaataacacagagttctagcgttagcatttaccctgttccctcaatggtactatcttgtaaagctatagtacaatatcccaaccagaatattgacattttatagttaagatacaggacagttccattaacacaaagatcctctgttacccctttataactacaacccctcattcccatccctgacccctggcaactcctaatttgttctctgtttctataacttatcacttaaagaatgccacataaatgggatcatataatatgtaacctttgagatttttttttccctcagcataattgcccaagattcatccaagttgttgcacgtatcaagggcttgttcctttttattactgagtagcgttctgtggtatggatagaccacagtttaaacatttgaatgacatctgtgctgtttccaaatttttgcttattataaaaaagcaagcaggacttttaaaaaacacacttatagaaatgcttatggctgtgtcttattacagaatatttataaggagagtaagattaaagagttagagtcacttaggattaaaacaaatgttataaactatgacagtccagctcaaagtagcttgatttcataaatatattctctttatggtatttcataaatgccataaatcaaagtagcttgatttcataaatgtattctcttttgattaaataatcaaacttaagtaaattattggccagtgtccacaatagaatttgtaaatagttacattgtgttcatgtttgcatttctgttctcaacctgaatgactgctcaatatagtacactatattcacttttattaagcactgctctcacatctcattgtgtttgttgaacctggaaatgtgatagcatttgattgtgttgattttttttttttagctgccaagacgaattgttagatgtttttaaaacattatatacccttatgcccttggtgtctctgatgaagcagattcattaaataaacactcacttatgaatagcagagccagcacagtcatagtggatgaagtttataggttattgacggacggtaggaaatcagttgaaagatgcccggaaacatgtggttatgttggtaggaagtagaaaacgcctgcctggagtccttcagatcccacaacgtatgcgtgtgcatcttctcaggctccgtattagccctggtacgcacagagacacacagcgaccagcctattagttgcctggcagatgccgtcagtactggtcattttgtgaatgcttttaatatgattcacagaatgtctgtagtcagtcacgttttagcactgacagtaaaatgtcacctcttcagcagttttcttttaaaaaaggtgtaaagcctcttaaaaatttttgctttaaactcctatcgatcgtttagaaatcttattagcttgctttgggctttcttttagagttggagaaattaaaatttagagaccaggttgggctgagaaaactgcgtggagaaggggaacttgagttgaatcttacttacaccagacagtagggacactaaagaaggcaatactgctggaagataaaagttgacagctttatgaaagaaggaaacaagtgaatgagataattcggctgagagctcccggaaagcaagaattctttttcatctgtgccctcagtccctagttggagtacagcccaaagtaaggttcaataaatatttgtttaatgaataaacaaatggatgaacaaactgaaataagtgttgatatttgttatgaaatatgcctttctcagactgttccacacacctcaccctggctgtgccaagtttctatggctgcacaacaaactactccaacacttagtggcttataacagcagatggaggttcacaggcttccactggacagttctccttgacatctgttctgcagtcagaaggcaactggaactgaggtttccggtggctccgcttgactacagggatgttgggctgtctccttctcagggcctctgctctttgtgtggcttttccagcagagccgctgaacttctaacatagtgtggctcagggcttccaaaaagcacaaagggagaagcttccaggcctcccaaaggctaagacctggaactgtcactgtgttgctccctcttttagttaagcagacaagggggccagaccagattcaaagggagggaaaagaaaccccacctcatgatgaggcaccactgttttcccatcgataactggtatcaacccagcatcctacagctcaattcagttctgacactcaccatcccgacttagtacagaccctacaggttaagggctcagtccccttagactgcccccacttcagatgccagctgaaagtggaatatgcccaagttacccacacttcttcctggctgactacaaatgtgggggttgggagaacccccaggtttggcaattcactagaatgactcacagaactaaggaaagtgctatacttacaattacagtttattataaatgatacaattgaacaaccagctgagaatttatgtagggtgagggccagaagggtcttgagtgcaggaacttctgtccccatgaatgggacatatcactgtcctggtacatcatattttcaccaaccagaaagttcctgaaccccattgttcaagagtgaacaatgcaggcttcattgcacaggcatgattgaggaaataattggccattgatggttaactcaatctccagtccctgtcatttccccagaggtcagggacaaggttgaaagttcctctaattatgtatccatgtggctggcaccttcctggaaactatctaagggcacaccttgagtcaccttgatagcataaagatacagctcaaaggggttcattatgaacaacaaaagatgttcctgtcactcaggaatttcaaatggtttttgaagctctgtgcctcgggaactagggacaaagacaaaatagattttgctgttctatcacagggttgatgacaaagaatgtgtggccatctttaatctgtgacactggtcctctgcagactcaagcaaaatagatgaaattttacaaaggactgttttcctatcatttgcttagaaaattaccctacatgtttatcccactttcccctagagcaggtttctggaaagctaatgctatgtcttacgtatacataaacggatgaatgagacaaagtttgttgcattggtatgtgtgttggggggataggagggtgatgggagagcctcctggaatagtcttagagttggacactgtttccccttgtgactccttttgcagctactgccttgatcccctcttgtgcctgctaggctctgccttggggaaagctcaactcttctgtttccctacacttgaccgactgtctccatcgttgccttgcccatcttgtgttgtgtccacccaaacctgactcagatctactagttttcatctttcgctcacggactattctcttgagccagattcctagtcccctaactcaatcatcttattctggcttctccagtgttctttcaacccaatcttgctaaaaagctattttaatgcccgactgtggatttttggcatcgttatctcagcaggcctagcttggaggttcctctgggatttcctgctggagtcttctttttaggatttcccagtctacttgggatacttaaggaaaattatcaccttgtcttaggaagaatcttattatctcaaatcaaatatttaaaattgcaatgctcccttatctggaattttattttgtaagggacattttctgataagctgccaatgacagcctatgatatgaaattctgtatgtccctttgggttcaacagtaaccttaatgggatagttttgtctccctgtctcacctcaggtaacagaaattgtcaagtgcaaagaaacttttgtatccttcccacatccagagctagcttggagtttgaccttaggcaacaaccaactaactgtgccttgaagataactctctggggagttaattaggatagactgaataattcaaggggcagttttggtgaattaaattgggaaaagattttcgagtgttaaaggttgaagcattcccttcctattatttcagctcttacctctactttctcaatatacattaaagaaaagcaaatctgttcaatagatttgagataatctattaatttagaatgcttactagaagcccaccatggggctaggctccacaaagtttgaattgtggttatactgtcggttgttttttaaaaatgtacagcaaaatcctaggcgatcttcatgaactactccagaggccaccatcctagaaatctaaactcagctctcctttaagattagtcattttcttatccaaacaccacagagctttttacatagctttattacagtgcttcagatattgtcttgtaattatttgtttctcaacctgtcttacctattggacctgattaatttagaggtgggaggctgctggcttcatttccttatccaatcatttaaattaagcatctgacaggtaccaggcactatatttggttctagtgttccaaaggaagtagacaatcctcattttgtatgtattcttcttcttcttcttttttttttttttttaggtggagtctcactctgttgcccaggctggagcgcagtgacatgatctcggctcactgaaacctccacctcctgggttcaggtgattctccttgaactcggcctcccacgtagctgggactacaggcatacgccaccatgcccggctagcttttctatttttagtagagacagggtttcaccatgttggccaggccagtctcaaactcctgacctcaagtgatccacccaccttggcctcccaaagtgctgggattacacacatgagccaccacgcctggccccattttatatacatgctgtatgtttgttgcatgtgtcaatcattttgaagttgcatttccacttcacacactctttttttttaaacggataattaggaaattcagccattttgaagttacttgactctggttatggttgttttctaagctctgttaacacacctggtcaaaagtttggaagtcagacatgttttgtttgtcgtttttttttttttttctctgtcagacatggcctgcaccataagcttctgaaaaactctttgaggccagagacttggcttcattgatcttagtatctttggcaatgttttgttcgtagggaagattcagtaaaaggacatttggcatcagactaaaggaaatgtgttccattagatgtttaaatcacggtggtttattttcaaagccatagttttgtagtgtttctttacaacgtgattgaatttaaatgcactgggatgacttcctccaagaagaaggaaactggggggccgagaagatgtggcaaaagcagaaacatgtccatctctcattgggtagggacatcattcatttatttgttcccgtatcattttgcagattccttttcaacctgtacactggctgtctttctctcatccccaagtttcaagatctctggtggtatttcttttccatatcctttacctaccttgccttgctcctccacattcccaattccttcaatttttttttcctctctaatctgctgttttatggatgtcaagatatactctagttactcagctcttaccttagaattgagacttcagagtttcccactaagttccctttgcgatacacaggaaagggaacattaagaggagcacactgagactttaagcaggaaaatcggtaaacgctgaccatactgaacaattaagtctactattacttactggttttcttcttcagagcataaaccgggcttccctttccccagacttggctactgtcccctggcttgcaataacccctggctcctcaaaactctatgccttatacatatgcctttccaagtactcttgccatttggaggatgggaagatactatgtcagagaatcccaggatctgattggatggatataattgtgactgcctcttcctccactgtcaggtaagtctctgaatgtgcctggctgctctgctttctctgagtgccttctgccatgagccaagcttttctgtcaccataagcaatccactcatctcttcaagcagggacacgcatctacgtgattggtggccagatcaaatttctgccttctagaaggcatctttcatatccagtctttcacccttaccagtaatgttatggtctagacttcattgacatggttcctccatggaagatcataatactgtttcccaacccagacatagcatctttctcaacacagaactctaggcaactgctttcattgattggagttgtcattcaaattcaaaatgaagcctacttggcatccctagcagctagtcttctcttgcctagatcattcctcttcatttatttctagccacttgcctcaaccccctcgagtttaaccattgccagttttgattggaaaacctatttattgaacatctctggtgatttttctgctgtacccagttacctctgaatgtgttgcccatctctggaagaagaggtattcctatatacacaccccacattcactgagggcttctctgtggttagttcataactctctttcatatgtggtagccaatgctccattaattaggaatgatgttgaccattctttcttctaaagtctgcacatattccttctggagttgtctgtcatgatagtgtcacacttcaacaatgttgaggctcctggtaaattctacagaaacatttccattttcctttgttttatgtacagaaatatagttattaattaggtccttgggcacaaaaatggaggcaggcatgtgccatttaacatgtgtgttagggttctccagagaaacagagctaataggagagagaaagagagatagacagataagaggagacttattatgggaattggctcatgtgatgatgaaagctgagaaactccataatctgcagtctgcaagctggagaaccagaagagctggtggtttaactcagtctgaaggcctgagaaccaggggagttgatggtgtaactaactcccaagaaccaggagctccaatatcccaggggaggaggaggtggatgtccttgctcaagaagagagagagtgaattccccctttccccatctttttgtcatattcaccttttcattgtattcaggcaggccctcaacagattgggtggtgtccgcccacattggtgagggcagatgtacttgactcagtctaccaattcaaatgccagtttcttctgaatacaccctgaaagactcatccagaaataaagttttaatagacatttgggtatcccttaacccagttcaactgacacataaaattaaccatcacaatatgcttcacatatgtttttaaaatagcttaattttttgtctataagtcttgtacatgggtagtggttgagttagtatcttatcccttgagtttgccaaccccttggatagggtcagtgtcttgggttctctgaatggcatttaacacatggtcacaaaaaccttggtctgaagaactttataatgataaagttcaaggtactttggtgtcttgaggaactccctggactgtgaggcagagactcgcttggctctagtcctggtgctggatctaactggctgccattgtggggctcccctaaagataaaggaactcagtttcctcatctgtgaaatgtgaggatggaattcatcaccatgtcccctcccagctctaaacttctctgagtcttgtttttccctgctctgtatcctccactttctggcatgttttttatatttactattataaatgtgtccctattttataagttgttacagcacgagagagaggtaaggaatagttaacaaaattgtattctgagtagcctaatattcttttttttttcctgctaaacttctttttcctcaccttctcctaacatttttgtgggggtgggtggactggtgggtgactgtagtgatattgatattcagagaggagtgaaaaatgcaaaattgcaaggttaacaacagatggttatatggtgccattttaggagtgttattaaaagaacaaatctattttcctgaatagtaggatgtcttaagtgtttaggcttaaatctactgttgaaatagaaaaagaggaggaagaggaggaggagaggaggaggggaaggaggaggagggggaggaaaagtcaaggaaacacttagaacatttttgcatgatctcaattttcttcttgttccaaggtttttaatttggacagtggtatgtgcttcagattgaatgcaaggaaatttgttgcaccatttgcctgacagttatcattttccttgacgaaaagtttttctgaatcttgctttgctggagctacctcttcccttgccctgaataacctcacttgcttaagtcatcgatgcagtggactgacaccacctttctcttaaggaattaccctgttctctgggtaggtctaatttacactcccactatcacccaaagaagagacactctctatattgataactagaaagaaggaactgagactgttgtccaaggacatcttatctttagcatagagcgaatatgtggtttatggtaggtgttcaacaaacttaaaaaaaaaaacttgtattagtctgctctcatgctgctgaataaagacatatcgaagactgggtaatttaaaaggaaagaggtttaatggattcacagttccacatggctggggaggcctcacagtcatgacagaaggcaaaagtcacgtcttatatggcagcaggcaagagagaatgagagccaagtaaaaggagaaaccccttataaaaccgtaagatttcacgagacttactcatttccatgagaacagtattggggaaatcactccccatgactcagttacctcccactgggtccctcccacaagacgtgggaattatgagagctacaattcaagatgagatttgggtagggacacagccaaaccatatcaaaacttaatcaaaaataattgaaatgtcaggaaatagagaaacttattgagcttttttagggaagtggtctttgaacctgttttgctctgcccactggagtatgctgtccatcaaattgttagttcagtgaattatggtacaaacactcagttacattaatatgactattttcttgtatgctaatttgagaacctactccctggagatatgttatcccatgtaatttccaagtgaaatggagagaggatgccttagactgttacttctcatgtttttcattccaatcttcctcagtgcccctctctataatcccaatcctatacatttttaaacaaaggaaagccactcagatcacagtagctcatggacattggtgagaaacgtgaggaaatgtagaggatccccaaattctcacacataaactaaggtgcagccactgggtatcaagcaaggtttcctcactggtttaatgactccagttttccacattgacatttgtgctgggagccttacatatatgattttgtaaaaccctttctgcagcccttcatggtaggtagcagaatatttaaccctattgtaagagacaggagaaaccaaactgctttttctattctcacccgccattctacacagttctccagcagaatcccactggatgtcctatagtttggcccggttctaacactgtctacctggagatagcctcagatctcacaggtaaagggctcagccccacaagactgcccttcacttaaaatgccaatcgcaagtcccagattgtggtctgtacttctgagcaactggccataaattgggggttcccccaggccctttgtcatgtttgattaatttgctagagtggctcacagaactcagggaaatgctttacttgctactgcccatttatcacaaaggattttttaaagatacaagtggacagccagatgaagagatagatgcatagaacatggtttggaagcatcctgagtgcaggagcttctgtccccatggaattggggaacactaccctttgggcacatggatgacatgcatgtgtttttgttcacaaactgagaagctctctgaacccagtccttttgggtttttatggaggcttcatcacataggcacaattgtttaaatcatttacataaatatgattgatcaactcttccctctcagatgttgaaggtgggactgagagtcccagccctctaatcatatggttggttcccctggcaaccaacccccatcctgaggctatccaggagcccccagccacaagtcaccctaatactatacaaaaggacgcttattttggagattccaagggttttaggagttgtgtgccagggatgaagaccaaatatatcttattataaatcacaatatcacacctattataaagcactacatataaagtttacactccaagaataaaagatacaaatatggaatcttcaaatgccaagggcctactggatactgtgaatgacaatataagctacatcacctgttattgaaaaccagaatgcaagtgtaaacttgaccagggaacctgcggagatggagaagtttgacacctctccagcagcatcatagaaatgaacatcatgagcgcattgagggggagggttaatgtcttcatcgttcttcctctggtagaattatatttgcatccttcctggtggaaacttgatacttcactgtagtgcacctgtacctgtttttttttttttttttttttttttactttcttggagggagagttcttctatctcagaagatagaagaaatagctggaaactctatattcctgtgccctagcacaggagaccaggggtctccaactggtctgtggccttttaggaactggaccacacagcaggaggtgagcagtgggcgagtaagcaaagcttcatctgtatttacagtgactccccatcactcatatttccacctgagttctgcgtcctatcagatcagcagcagcattagattctcattggagcacaagccctgttgtgaactgcatatgtgaggaatctaggatgtgtgctccttatgagaatctaatgcctgatgatctgtcactgtctcccatcacccccagatgggactgtctacagatgggactgtctagttgcagaaaaacaagctcagggctaccaccgatttgatactatggtgagtatgtaatgataataaagcgtacaataaatgtaatgtatttgaatcagcccaaagtcacccccaccgacccacccagtccatggaaaaattgtcttccatgaaaccagtccctgctgccaaaaaagttggggactgttgccctagcaggtagagcaagggtatttcacttaggcttgaccaatcgaatgccttcattctggattttggatctgggagaagtcttgcagagacgaagcaacatttgagaagggttttaaggctagtttgagtttagtgtgctggtcctggctgccatgcattgagcagatagttcctgtggtaagacctgctgcccaagccacccttggtttctgcctagttttctaacacttctgtcaattctccattcttgaatagtcttctaatataggccttttctgctttaggtagccagacagaactgttccttgcaaccagtgactgtctaattcagtcacttaatgttttgtagctttgttcagttactgggcacaacccactttctgctcaggcggcttggagacagccatgggccatatgaatcgctattattttaactttcatagtaagaacttgctccatgtgggaaagcataattattttggtttctgagtttaataagcagaaagcaaagaagaaaaaaaatactgtttgcactgagcattaaaatataaggaagtaaagttgtttatagatagagtttcagctaagcaccaaaggtttatttatattttttgccatttatattttctgcctagttctgcctaggaaccagggaaatccatggcaaggagaaaataaagcatcaaagaggatgaaaatgttgaataaagtattagaacccagaacacttaaatctttaacatccatagtaagagtccttcacattactcaggcagactttttttttttccacctcttggtattctgtgcctacacttgcatgtttaaataacgatttaaaaatcacatgagaaatgatcaggctttctttttcccacttgactctcagttatttcaattctttgagacttgttaaagaaaccgtttagtgttgtaaatgccaccaagtctctacctagtagagattagaaatcctctcaccaattccaagttaaaaaggtcctgacatattttgatggaattggcccatgttctcatttaccagtgaccagctcatctccatgctatgatgctccccaggaaatgtgcatggtttttgtagaaggtggcgagaagcttcatgggcaccagcatccacaacccacttcttgaaaaacaaaatcagatttatatttagctgaccacctggcaagatctcctgtaggaagagaaggaactatacccctattactatttcagcttttattcacaaagtctttatatttgaaaaatgctttataatcattttaattagtggtttctcaccaaagccctggatgtggtattattggcaccattttctgagaagaccgtgtgccattgagatggaattgacacaagatgttaatgggttagaagctggtactagaatcagaatgataggccataggactcagcaagccatgctatttactgtcatcttagagggctaggtagggtggagggaaggagttgatgactgattgttataagtgaaaagggcagcagtgacccaaaacaccattgcaaatgttaacagaggcctgttacagagttaaagctgggttttccaaaacaacacatctgagtaaaagcgcccttggtacattagccagtatggagccagcacctgagatcacactgtgtttgcccctttctgcaatggctattggtgctggttgcttgtcttggcctaagagttttcagctgggcttttgagcaagctgcatcttgaatctgaggatgcgggcaagccaggcacagaactgtgagggtccttgcaatgggctgctggtgttcctgtcattcataagcttggacttggtccccactgtgtttgatttgggagaggttctttgaccatacaactcttaccgtgtaaatgtgctacaatccttgtcaagacatagcaaactatatttgaacattgttttaccatttactgttgtgtgcatgtgggccatattttcctagtcagatggtgagttctgtgagggcaaaggctgagtcattctctatttacattttaagtaggcatccagagacttggttatattctgagtctgtattattgatcaaagccctcacctggagtttctggggccattcactgacccagaatctggtgacattgacacagggagggaataacatccagctacagatggttaacacaggtctttagtgccccaatccccattttgctgactcatctatgcctcaagaactccaatcttcatgcagattctgttgcccttgagtactcagttctgtctcttctgcatacctctgtggagccttggatcctgtcagactcttcgtgttgctgaagttctcagtcctctctctcagccgagtgtaatagtgccccagtgggcactgtagggacagaactgagtttcttcttttcttttaggagttgattctctccgggtaatatctggagctctctaaagtttcagagagaaatacgttccttataaaccttgtggttgtcatgctggtgactccttgagcctgtcctgtgctggaccgtgaggaaggacacaaggccatccagactcctggactcacagtgatttcttgtcctccccaaagatgcctttgcctggtgcactctttaatagcccatcacttcttgctggctgtgtccccagctgagttcctccaggatatggcatcaactctgaacacatctctgtatattccctcttaggaccataagattcatgttaaacttagtgccagaaataaccttgggtagccatgttccttatggttccttagattacattcctagattacacattttacattaaaaaaaaaaaaacaaaacccaaagcacctagaaccgtgctggattcttgataaatgcttgtatccattaaatacatattgaagtaacttctactccagtgacccctctcttgaggcttactgtttacctcctcactttggggagctacccagccaggaccttctgagagagaaaagtggtatatttagtagtcaccagatagttactgttaacggtgctgagttcttaaaaaaacctgttaattgtactagcttaagactaaagtatatgttcctctcctcgtagagtgatgatgatggttttataaatactggttggatagcactgtaattaatgggcacaccagcttttattttggtaacaatgtattcttataccacatttaagaggtttctctttcctgtggtcataaagtgattaaaaaaaaaaaagagaggagagagatgacatcctttttaataaggcatcccaagcagtctaagtacctatgaattataaatgaaaacttttcagtgattaaaataaatataccaatgcagtccccttctctgcgtcattgcttcgccaggcctgcatgaaaatcactcagaggaagtcccaaggggccctgagatcatttgcatctgttccatgtgtttctctgatttatatcagagtgcatcaagggcagtggccttccagctggtttgggaagagggattcttttatccagaggaggcatcagctgatggtcagttagggctctggagtgcagctccatgtaaacaactagcctttgtagtaatggccatataatataacctagtccatgttttgttccctcaagaaccaatttacaacatttaatgttcaaggatggttccattcctttctttgtttacacaggtgaggctttatttagtagtgggaagtgaagggcagatggtttaaggggttcttaatgctgcaggagaggcccataaactgaagtatccaagaaaatccattctaaataagaggcaaacagagtctcagatggatataaattagtattattcttaggaatccttccttcccatttctcagacttatagcaaagctcttactgatatcagtggccattgtgcaagtgggtagcagggaaatcaccctcaatgaccaaatggaagtacatgaggaaaaagatggagaatcctggataaagaagacaactggctgggctccatggctcacatctataatcccagcgctttgggaggctgatgcgggtggatcacttgatgttaggtgtttgagaccagcctgaccaacatgacaaaaccccatctctactaaaaataaaatacgtaaattagtcaggcgtggtggtgggcgtctgtaatcccagctgctcgggaggctgatgcaggagaatcgcttgaacccaagaggcagaggttgcagtgagccaagattgcaccactgcactccagcctgggcaacagagtgagactccatctcaaaaaaaaacacaaaaaactgtctttttctagccctatttatttcaccctacactccatttaccttttatttgttgttaattaaataacattaatttttgttgtaggattatacgtaagaaactattggccttttgctgattgtgctggaatttaaaagttgtagggattgtgggccattgttctaaaatggctcattttgccaaacatgattaatggcttttggggtgcagtttatgtcaaggcaaaattagtggacacttcagcaaactggaatgtggttctgagctaaggggatattcacttagccattcctagacctttcttctatcagaacacgtctttaaggttgaatatccaacattttcaaacattttagtcttaaattctacctttagagtattattgatggtctgattagataatgaaataaattttctctcagcaatgtctgtaataaaacataatgcaggaaagatagcatttaataaaatatttgtttaatgttaataatatttattaccatcagattagaatcaagttaacatcaaattagtaagagatatgtcagtcacaggacttgtagggatgcgagaaaaagaccaccagagaaactgaagaaacaactggaatcatctttgaagaatttcaaactcatcattgagacattggcgagactgggaaaattatttctgaatcttgaaagaatgatgccccaagaccagatcatttaaccattatgtgtctggagagccatcatgcttcctggtatatttactgtggaaaaccctgactctcaaaaattaaaggaaaattacaactgtaataaattggcctgaattgcatggattcataagaccactctctttccatttcttcctacttaatgttgttttcacatagtgatcacttagcagagtttgggaataataactggcaaaaaagctaaaattcttagtccctaaaggaaaagtttgcaaacttattatttaatgttttaaaacccctttcccccgatgaatgttaccctgtccctaggagaagcttctctttcatgagttcatagatcaacagtggaaagatgattgtatttttgagccttgaggttcaactttttctcttctaagtcttttattctgcaagagcccttttgaatgatttaaaatggcattctccatttattcgtatttatcgaaaatctatttggagcaaggtattacatttaaagacagagaagaaatggttcatccactcagctaatatttattgtgtgtacactatgtagctacaagctgggaacagagtggagagcaaaagaagacaccattcctgctcttctacagttgagtctggtagaggagacattcatgattcattttttttttttttttgaagcggtataaccacccagtgggttcacattgcctgctgccttcacagagccaatgtatcgagacaggggaattgcagtgaagaaagagtaattcacacagagccagctgtgcaggaatgagagttttattattactgaaatcagtctcctgaagcattcagggatcagagtttttaaagataatttggcaggtaggggctcaggaagcgaggagtgatgattggtcaggttggagatggaatcatagaggggtcgaagtgagtttttcttgctgtctatgttcctgggtggaatggcagaattggttgagccacattactggtctgggtggtgtcagctgatccatggagtgcagagtctgcaaaatatctcaagaactgatgttaggttttacaatagtgatgttatccccaggagcaatttggggaggttcagactcttggagccagaggctgcatgacccctaaactgtaatttctaatcttgtagctaatttgttagtactgcaaaggcagactggtccctaggcaagaagggggtctacgtgggaaagggctgctagcaattttgcttcagagtcaaaccatggacagaattccttcccaaagttagttcagcctacgcccaagaatgaacaaggacagcttaaaggatagaaacaagatggagtaggttaggtctgatttctttcaccatcataatttcctcagttaaaattttgtaaaggtggtttcaatggagcctcactctgttgcccaggttggagcgtactggttccatctcagcttactgcaacctctacctcctgggttcaagcgattcttgtgtctcagcctcccaagtaggtaggattacaggcatctgccaccacactgggctaatttttttgtggatttttagtagagatggggtttcaccatgttggccaggctgatctcaaacttctgacctcaagtgatccacctgccttggcctcccaaaatgctgggattacaggtgtgaaccaccacgcccagccatgaatctttagattactcaagtaaatgtaaaattataagtgtggtaaatgacaggagatgtatagtagaggaatctcatctgtctagggataaagggctcccctgtggaagtgatatttaagggaagattaaaggattaagaacaattaatttgggaagggatggtgtcttagtctgttctctgttacctgagactgagtaatttattttaaaaactcagaaatttattttttacggttccagaggctaagaagtccaaagttaatgggctgtcatttggcaagaaccttcttgctctatcatctcatggtggagggcaggaaagcaagagagcacacatgccacagagagcaacagagggccaaactcacttttataacaagcccagtcttatgatacaaacctactctcacaataatgacatcaatccattcatgagggctctgccctcatgacctaaccacctctaagttctacctctcaacactcttgcattgggggttaagtttccaactcatgaacttcagaggacacattcaaatcatagcattctgcctctggtattcaaaattcacattcttctcacatgtaaaatatatttatttcataccaattgctctaaaaatcttaactcattccaacatcagcttaaaagtccaaagtccatagtctcatctaaatcagatatgtgtgagactcaaggcatgattcaccctgaggcaaattcccctccagctgtgagcctgtgaaattaaacaatttatctatttttgatacaatggtgagacaggcataggatagccattcttattccaaaatggagaaataggcaagaaaaaaagagtaactagtcccaagtgagttcaaaacccaacaggaaaaacaacataaagtcgtaaatctggagaataatctccacacccttaatattgtctcccaaacatgcttttttcattctttacatggccaggctgaaaattttcaaaacttttactttcttcttcccttttagttacaaatttgtctttaaatcatttccttcttattttactgtaagtggctgaaagaagccatgcagcaccttcaactttgctacttaggcatttgctacttagcctagttcatcactcttaagttctgccttccataaagtcctaggacatagacacaattccaccaagtttgtaactgtatcacaaggatggcctttactccagtttccaatacactgttcctcagatccatctgagacttcatcaggatggccattactgtccatgtttctaccaacatactgatcatgacgtcttaagtaacctctaggaaatcccagtttctctgcagttcttttcttcctctgagttctcaccagaatcacccttaatgccccattcatgacaatctatgcttcttaaaatcttgctcctccaaattcttccagcctctacctattactaaattccaaagcttcttccgtgttttcaggtatttgttactgtaataaaccctcttctcgataccaattttttgtcttagtttattttgtgctgtttataacagaataccagagactgggtaatttataaagaaaagaaagccagcgtctggcaagaaccttcttgctgcatgatcctgtggcagaaggcagaagggcaagagaacatgtgcacaagagagaacaaaagagggccgaactcacttttataacaaaccactcttgcaataatgacattaatctattcatgagccctcatgacctaattgcctgttaaaggtcccacttcccaacactgttgcatggggattaggtttccagcacataaactttggagaacacattcaaatcgtagcacatggggtacagaattatattgcagatacagacagcagctcatgccaatgctgtgtggtaagagaaagcacagggctattgaaagaatgaacaagggtaagggcactggcacccagagggcaaggaagagtacaggtgggatgaatccagagtgggaggtggagactaccaccaggctatgcaggaccttataaccactttaaaaatttgagaagtctgggtgcagtggctcatgcctgtaatcccagcactttgggaggccaaggcgggcagatcacgaagtcaggagattgagaccatcctggctaacatggtgaaaccccatctctactaaaaatacaaaaaattagctgggcatggtggcaggcgtctgtagtcccagctattcaggagactaaggcaggagaatggcatgaacctgggaggcagagcttgcagtgagccgagattgcaccactgcactccagcctgggtgacagagcaagactccatctaaaaaaaaaaaaaaaaaaaaaaaaaattgagagataggagggtcacttgaggccaggagttcaagaccagcctgggcaacatagcaagaacccatctctacaaaaaaatagaaaaaaattatttgggtatggtgatgcaaacctgtagtctcagctactcaggaggctgagggtgggaagatcacttgtgtccatgagttcgaggctgcagtaagctggtattgtgccactgcactccagcctgggcaacagagtgagaccctgtcttttaaaaaaatgagggttttattcaaagaacaatggaaaatcattgatgggttttaagcagtaaacatgaagggaacacatttgtggtttgcaaagattgctttagtgcctttggagaggagtggtagtaagatcatccagggtgctattgttcccaggtgaaagatgcaataattcaggtggaccccttaaagaaagagatatggatgagttctagagatgtggaagaggcagaatcaatagaacttggtattgattgaatatggtgtgggggcagggttattagcatggcccctagatttctagcctgctgagtaggatgaatggtcacaccattcactgagatagaaagctgagataaaacaagatttaggaggaaagttgacttttactttggacaggttgaattcaaagtatagtatggtgtcataaagtaagctgttgttacatagcctaaaaatgagtggatttttaaaaggtcaagatgggcagaagtagagcattccagttatctaacattgcatgataaagtcccaacagttatggcttaaaacaacatttactgtgctcattaatctgaattttggcaaggcttggtggatagcttatctccgcaccacttggtgtcagctgggggagcctgaggctggggttggaatcataagacagcttgctcactcaaatgtatggcagttgatgctggctgttggccgaacttgagcaggggttgtggctggagcacctactcgtgtcctttacatgtggctgcttagcttcttcagagcttggtctgctgggtttcaaggtgagtgtcacaagaataaagtgagagccagacagagactatcacctttcatgacctcgcctcagaagtcatctagcatcacttccatggcattctgttcattagacatggcccagccatattcagggtaaggggaattagagttcactcttcaatggggggagtgttgaagaatttgacaacatgttttaaaaccaccacatggcggggcagagaagaaatcagttatcattccagctggaaggaacaggttgaaacgggaaggtagaaattatattcaatagaagtggagtggttgctgttggctggcctggagcatgtatgaagggttatgaacagtgtgaaatataggttaaaggaacgtttgggaccaaattatggtggagcccaaatttcctgaaacccattattttgaatctggaaacaaattgtcagagaggaatacaaatcagatttattaaataaagataaaaagtagaagcaaacagtgactggcatgggataggaataattctacttgctgataaaataattcatgccaattttggggtgtctagtctacagatttggggtcatatatctccaaatttaaattgtagacatattcaaatgtctttagttgggctttgtaccttatgccagtcaaaaacatgagtcaaaaaaatcatgcctgtatggttcccttcggaggtatctctcctttatcctttagcagattaagataagaatcttggtctttttgatcctggctgtggcttcaaatttttcccatcttactattgggctacccaaaaggactgcatcagacaagactggtgagttgaatagtgttcctcccaaattcacgtctacctggaacctcagaatgttactttatatggaaataggaactttgtagatgtaattagttaaggttcttgagatgaaatcatcctggatttagggtgggccctgaatccaattattgttgtcattaagaaattgagaaggcacagagacaaagcaaagaagcccatggggagatgcagaagctgaccttggagttatgcatctagaaccaaggaatgccaggagcaccagaagctggaagaggcaagaaaggattcttccctagagccttcagagggagcgtgaccctgtcaacaccttgattccagacttcgggcctctaaaactcagagagaataaatttctgttttaagccacgtagtttgtggcaacttcttatggcagtcctaggaaattatacacgaagttagagccaggcatgatgtattagtccattctcacactgctataaaaaattacctgagactgggtaatttgtaaagaaaagaggatccccaggctctatggaaagcatgcctggggagacttcaggaaacttacaatcatggcagaaggttaaggggaagcaggcacgtcttacatagcccaagcagaaggaagagaaattgctgcgaggtgctacatacttctaaacaaccagatctcgtaagaactcactcactgccaagagaacagcaagggggaaatccacccctaccacccagtcacctcccaccaggccctcctccacattgatccaatcacctcctaccaggcccctctttcaaccttggggattacaatttgacatgagatttgggtagggacgcaaatccaatccatgtcacgtggaaaatatgggtgttggtttgccagatgccaaacagaaacaacatttgatctgttgataattgtgtatcctctttatcaggtctatcttaaggaaatcagagagtagagcatattttcttcatggaatggtgagacacatattagcctgagacaggagctaaggagagtgagtggtgggctccaccaaagtgccttcatacaactacactggtaggtgatcagaacaaagggacacgtagaacgaagacccgggtgtgtaacccaaatgcctaacaaagtccattcaatgtatgaggtgttgctgctgtgtgctgaaggaggaaacctgggtcttagtctctgttatggtaaatagagaagaaatcaagccttcctacgacaataggggatttttaatgaagtaaaggagacagaagaaatgtcccaaaggagaatgaagtatgtcaaaaacagattgcgcatgtaattactttctcaggccttcctgacattatcagcaggacttgtgttttgatgaaaaaacttaattaaaacttaatttttttaagtggaaaatattcagcatggttacaggaagactgaaatcagggcactgtgtaattttaattgccttcgagagatgcacttcacgtgaagactagcatgggggaaaaaagctagaggcacaaagtctgaggggagtggccacgctgaatctctagctgtgtgcttgggcgccattttccccactcttacagttgacgggatggcatctcaggtttcacgtgtaggggaggagagtgggtctgttctggagtgtgccggtcaggccatacttggcatacacattgtagaaagtgtcttgatttttattctcctaaaaagggtaaaaagagattgaggagattacatatcccatgaggcagcagtttttaaatgccactctctggatcagttctatcagaaccatctggttctgattcatttaatctgttttaggacctgtgcacagtgtttctattttaaaaataaacctgtcctactcattcttggagtcaggtgtgggaactacaggtttttaatggaagaaacatgaacttgaaaatgagtaaatatgggctacgtcctttacttcccaaggagatttgggttgactgcttagtttcctccatcaaatggggataatatgcttatttgatggggttttgtgaaaataaaagataacacaggtaaagtgactgacacatacagttaagtggtctaaaaatgataaaactgtagaagaagagttggatcaggctgcttgctaaattgggaagggataaggtagtgttcttcagatatttcaagggcagctgcatgagagagagagagagagagagagagtgtgtgtgtgtgtgtgtgtgtgtgtgcgcatgcagcctttagaggtcagactcaagtccagcaggtagaagttatagggagataaatttcaacgcaacagaaagtggaactgtctagtgaatggtccagggatgtcatcagtttgctccagagggtagtacgttccaaatcactggagcaattaaagcagctgccatattttgaggatgtacagggctgtggggcagcaattgaatgagaccacttggttcagctctgtaatagggtttctggcttcctgtggggctgtggctgacatacagttgttttgtaaactaacaacacttgaagaaggttttagcagaaaacgtttaccagtaagatatgtcaggtcaagtacactgttttaggtattctttactggggacattcttgtgaccttcatcccaggcctttcagaaaagggatggggcatatttagaagttattaatgactgagaagctcctctggcacttcaggggagggaactagagctataaaatgtcctgtgattgttctaggactttctccttagtttagctaacatctgggtccttgtcacacggctatgaaatattaggcttacagacactttgaagggtgagaaaaatggaatttattgggtaaaaaggaaaaaaagggaaacagggatgctctgcagagccagattcctgctagtgtgcttcctgcctcacagactgaatcccaggtaccacccaggaagaggaggggccaggctcctccccactgcaaatggcatgaacttcccaagacccctcccccagtgtgcaggccacttggaggttctctggtgacccctttatatttggctgtctcattatgaatgggacaggagtgcgaaattatcccacttcaaatgtcacttgctctctgttgggaaaccctatacctcactgaagcccagatgatctccctgaaccagcctttgagggtcctttttggagccctttggaaacctggtattggatgggttgggttacagggctgctcagcctgacagcctcgcattatctggtgaccacagagtttaaagcagaacattgggaagaaggtagactgggccagttgcacaaagcagagtgtgaagagtgatgggagatgaaggctgtttgcctgcttttcactggggaccagatttggatggatgctggtccaatatgagtgacacagttaacttatcagtgagatccctcattcttctcatcagtgagatagctgggtattgggggaacctgcccccagtatttcaatgtaggttctttctattttccataatatcagctggctgagaaataaagagaaagagtacaaagagaggaattttacacctgggccgccgggggtgacatcacatatcggtaggaccttgatgcctgcccaagccttgaaaccagcaagtttttattaaggatttcaaaaggggagggggtgtacgaccagggagtaggtacaaagatcacatgcttcaaagggcaaaaggtagaacaaagatcatatgcttctggggaaacagaacaaagggcaaaaggcagaactcctgataagggtctatgttcagtggtgcacgtattatcttgataaacatcttaaacaacagaaaacagagttcgagagcagagaactggtctgaccaaaaatttaccagggtggagtttcccaatcctagtaagcctgaagttactgcaggagaccagggcgtatctcagtccttatctcaaccgcataggacagacattcccagagcggccgtttatagacctcgccccaggaatgcattcgtttcctagcgtattaatattaatattccttgctaggaaaataatttagtgatatctctcctacttgcacaaccgtttataggctctcggcaagaagaaaaatatgtctctttttgcctgaccccgcaggcagtcagaccttatggttgtcttcccttgttccctaaaagtcgctgttattctgttctttttcaaggtacactgatttcatattgttcaaacacacgttttacaatcaatttgtgcagttaacacaattatcacagtgatcctgaggtgatgtacctcctcagcttatgaagataacggtattaagagattaaagtaaagacaggtatgaattataaaagtattaatttgggaactgatacatgtccatattaaaatgaaatcttcacaatttatgttcctctgctgtggctccagccagtccctctgtttggggggggtccctgacttccaacagctggggaccacttaatcagggtaagggcagtagtttgtgttcacagtttgatctccctgcatggtgctaaccaggctgcatggggatctaatgtctgactttggccacggcatcaggctccagccaactgacgtgaaagcaagtttccaaatcgtctctttctaaatagataaatgatactcagtgttcctttagccttccttattttttgcaaatgcctgtccccagtggttctgttgtttgctctgattgccgttttccccagtaagtgggaaaaccccacatcttttccccatcagtattccctaatgaggcttgttccctcaaggggaccttgatgagttacaacagcatgaccatgttcccaagcagcatgctaagaaaaacaatccccagtgatgccctgcaggcaccatttaggagcgggcggtaatgaatccctgagagaattcagtcctccgtatgaaggtgatccagagtgaagtaaacaatttcaccgttaggtggttcaccctgcatgcctcattgctggctttctggaaagccagtaaataaggcagaaaaaatgtatcattccctccagagtgcagggtcccctgtcacccacacaggactcctgcctgtcactttgagtcacagctgggctttctggaacccggattcttgtctctggttagctcaggtcttgcagccatgccaaatccaaactgtgacattgtctgaacagtagggcatcctgttccctggtttggctgagctctgcggagcagaacagtggccgaggttaacatcagataatttcctccaccattcctgagtaccctgagggcttgttacctggaatcaaagacttgtcagaactcaagatgaccttaaaggccagcttattcaacctcccacccaggatatgacttccagaactaaccacccacaatgcagattagtaatatcatacgtggttactcaatgcaattgtgtcatttcaggagaaatgacctgttaccaaagtgtcatgaaacccacattaatgagctgggctgtagtggaggtttactttgatttctgaccttaattattagtggtttggattctttacgtttatgatggattttctgattaccaattatgattcactgtaagccatttttaaaaatatgacatgaagctctgacccacttttaacaacacagtggcaaatgccaaacaattggcaatttccccttctaatatcagctgtttgaatcatcacatctactgtggtggctggggaccactttatcttcattctctggcttcagtattcttttctggtattgtcattactgacctaggtgcatatctgtactaggctgggacctcagctctatgccagtgagaaaatgaggttcaactgggaaaacggcctggagcagttgctctcaggcttgtctgcagattagaatcacctgtagacttttaaaaaatactgacacttgggttccgctcttggaaattctaatggatctggggtgcagcctgggcatctggaattttacagtctacctgagtaattccaatgagcaggtgggtggccttgcaaaccggggtctgaaggggctggtcagcaaggagtatgggcaaaatagtgctggctggctgggcgcagtggcttacgcctgtgatcccagcatttgggaggctgaggcaggaggatcatgaggtcaagagttcgagaacagcctggccaacatggtgaaaccttgtctctactaaagatacaaaaaattagctgggcgtggtggcacgggcctgtaatcccagctacttgggaagctgaggcaggagaatcacttgaacccaggaggcagaggttgcagtgagccaagatcccacttggctgccactgcactccagcctgggtgacagggtgagactccatctcaaaaaaaaaaaaaaaaaaaaaaaaatagtggtggccaaggggtgtttataaaacagagttgtgatacatgttcatacattcacctttgaggtctgatttggtggtagcaggagtttcaggggaaatgtttactgatcaggttgatgagtgtccagggacaagatgtgtctgctaagagttagattgatggcaaagattgggcagattgatagttctctagcaaataagatgagatctgctatttcagcaggaaacaagtaaggaagttgaacaaaaagctagtggtatgggccatgtccacaagctgtggttaaaggcaaaggctgaagcctgattggcgtgcccacactgggctgggcactgtcagggacagccaggctgactccagagcctgccttctggttggcttctcccggcttaagtctggccctgcaggaaaaccgacaggagttttcatgccaaccaagactgagacaatcagagactggcaggtttggaaccaggaggtctggatggggaggttggctctgaatctgttgtcattatcaggtgagtcattaggaccacctggaaaagtgaagctgttcttcaccttctcttcttgtgaaagtgattcaatctcccaaacccaggttgatcataccctttaggtctaatataggaagtgttgaattaggtgatgtctctaaagaactctctctgggttccttagagaaaaatagcatttgaacattgtgcctcagcaggaaagaagatgcaatttaagtcctgcaccaaggcattcagggctcacctcaaagtggactcctaggaacaagaagcaaatgattccgtggagagggttagatgtctggccaatggaaacggggatgtagttcaggttttctagccccagaagttcagaacctttgggttcctcggtggacatgtctgttactcgcttgaaactagggaaagtctcttgtgtagaaaacctgttgcatgtcccttgactaccagtagcagcagaggtgctatgtgtggctgaagaattttcctcctttttctgagagatgatttcccaggtttccttctccacaattctgtgggcgtgtactgctgtgataagatgtttgttctctggcttataaattacaagatattttcaggaccacttggaagaaattggaacattttcctggaggcagtgggggagctgctggaggttttcggacaggcgggccacatgctgagagaggtattttgggaaaatgcacttggcagtcatgtgtgggtgaggataataatattaatacttaaccactggcttgttgggaagagtaaggggaacaatgtaagtgagtgtaaagatgcaggaccaccattcctttgttcattctttttttttctttttctttttttatactttacattctgggatacatgtgcagaacgtgcaggtttgttacataggtatacatgtgccatggtggtttgctgcacccatcaacctgccatctacattaggtatttctcctaatgctatccctcccttagccccgcactttgtccattcttttagtttctctgagacctggtgccccaaggataccatcttctcctgaccagtgtatcagtttgcgagagttgccataaaaaaatagcacagactgggtggcttcaacaacagaaatatattttctcatagttctgtaggtgggaagcctgagaatgaaaggcatcggtagggctggtccctcctcagggccgcgagggcagggtctattccaggccttcctccttggcttgtagatggtcaccctcttccctgtctcttcatgtcatcatctctctttgtgtccgaatttcttcttctcgtgaggacaccagtcatattggattagggcccaccctaatgactgcattttaacttaattacctctgaaaagatcctgtctccaaagatggtcatatgtgagatactggggttaggacttccacatataattttttgaggggatacaattcagtccataacagccagtctttttgaagactttctcttttgggggctttacacttaggtaattacaggatattttaaggggtatttcaagacccagcaacccccttctccacccaccatctcccccaaattatgttcgtcacctcctggtacctgttatatcatcactagaattgcttggttgaatcaagtaatgtttcaagataatttccgtaaacatgcactctttttatgtaagaggggtaataatagagccagtgaaatactggatgaattcatttaccaaactacgtaaaagtactgatatatgacaactacttagggaacctaagatttgggacatagagcagcctatttagaatatccggtataacattgcagggaatagcaagggctctagagctttccgcctgggttgaaatctcagctccacccttttctttctgtgtggcattcagcaagttacttaacccacctgtgattcttccttcatctgaacaagcagcataacaatagcatttacctcatgattctttagaaggtgaatgagctaatacctaatatagtgcttagagtagtgtcttgtctgtggttggctttcaataaatgttagctgctattgttgttgttaaactatttaacaaactacgaagcacattcctatctgctttcttctttgcccttgtaacagccctgtggagtagaaggagttagttacattttacagatgaagagactgaggctctaagacattatgcgaaccatctcagggcatatggcagtgttattcagaacatctatcggtaaagaacaagaattccaaaaatataggattttccccaggaaggagggccagagtgtgggctactgtgggatggcctccgggcagagtgtgagggtaggcgctccaaagagtaaggcatctggagaagagaaacaatgaaagaggcaaacgctggatgagaaggacctcaaagcagaactttgcctctcggcctctcagtcaattgtgatctgactgacatccagattgtgatcttgttcaggtggctgaactttgaacccttcttggccatttgatgctaaaggcagtctttgaatgtgatgttttcctagatcgtactggtggaatttagttgcctcagatttcccagtcatgtgccagcactgccaagtgatctccatgtgtgggttttatgatgtgtttccagtgctccacatatggcctgtgatttttttttcctatggctcctaatgaaacactcagaacactgcactgaatagaagtttctccctattctccagagtggggatccttattgcatcgtcaagcatggacaccaaaaataaatggggagaaatctctattctcttagtgatgaggcactcttggaggaagatattattaacatgactacgtcttgccaatttgaaactttgcaaatatctgtaaggttgaccagtttttataatttcaagattttaagttcaacttaaggtactttacaaaattatttttatcataataaattacagttctttacacctgtgtcttttaccgattagattgtgagctactttatgggtgagcaccagtatctacttaactttgtactaaatggctcaatattgcctggaaaatagtaggtgcccaataaatagtaaatgttgttcgatcaaatcataaatgtagatataagctaaacctcttccctgggcaactggaaatgcccatgttatgtcttaaaacacattgaattcaggtgggagaataaaaatgattttaacaaatccagtgtgctttttgaaggcagaactacaattacttcttttttccctcataatcaaatcaacctgtgaaattggaagccaataaatatgtaaaaaagtcatcaaatgtcataggagaggactactatttgattcacacgtgatctttgtcgtttaattgcgtgtggcaagaatgaatggaagtgatattaagtggagaaaaactcagtcccattggtgagttatttaccttgaccactgtgatgggctgaattgtgttcccctaaaattcctatgttgaagtcctaacccccagtatctcagaatgtgactgtatttggagatacagtctttcaaaaggtgattaagttaaagtgaaaatgaggcctttgggatgggtcctaatccaatatggttgttgtctttacaagaagaaaacatttggccacatggagagatacaagggatgcacatgcatggaggaaagaacatgtgaagacatttacaagccataaaaagagccctttcagagactaaccgtgctgacaccttgactttgaacttccagccctccaggactgtgagaaaataaatttctgttgcttaagtcacacagtctgtggtattttattatgatagccctaccaaactaatacaaccacctactttttagaatttgtagaatccaagcacttaagattacaaaaatgcatgtttattgtggcactattcacaatagtgaagacttggaaccaatccaaatgcacatcaatgatagactggataaagaaaatgtggcacatatacaccatggaatgctatgcagccataaaagaggatgagttcgtgtcctttgcagagacttggatgaagctggaaaccatcattctcagcaaactaacacgagaacagaaaaccaaacaccgcatgttctcactcataagttgaacaatgagaacacatgagcacaaggaggggaacatcacataccagggcctgttgggggctggggagctacaggagggatagcattagaagaaatacctaatgtagatgacgggttgatgggtgcaccaaaccaccatggcacgtgtatacctatgtaagaaacctgcatgttctgcacatgtatcccagaactttaaagtataataataaaaaaaagcaataaagaggaggtgatggtaataggcacagacttttgcttgcgttgaggaaatattctaagtttcacaatggggtgtggaagaatctgtgcgaatctccttctgacctctcgtggtaccatttcctcattactcagtgatgaccccagagccagtcttggatgaggcggggtggaattttccacacaggtgccatgagctagggggctcaaaacagacactgtggtgaggttattactgaaatattctgtttctatgaagtttctaacgtaattctgggccctctttctacaaccttagcaagttgctgaactacaggagtgcggagtaacaatgcctttcatgtcaattctgtttacagccaggcttgcttgcattaaactggacacatccatcaactagagtgctggataacagatgagaaaaagctaagtttgagttgtcttttatattgtataatggtgcttctattttctttgttttcttcttgttcttaagttctgtgggaaacccacgggaagaggagtctatccagggtatttgacttcaaatcatttcatctcttctgttcttcctctcatctagtcctctgtgttcttgtaatatacgcaagggcaagattaatagtagaacagaattctgctatgaaatttaagtgatgtgaattctttctcaaaattccaagaatgaaaactttgactatgatatagccaataatttgcacttgtttgcatttgacattgctcatttacattaactagcgtaaaatacctaattagtacagcagaaaaaaaaaaactatatgaggaaaaaaagaaatgattgctcttttactcactggagggaaaggttggatttatttcagctctgtgtttagaaaaatacctttgctgggcttcttggagtgtgaaaagagtggaccctgacccacctctattccctgctgggccatctggaaggattttcacaacaaagataaggctaaaccactctgcaaaatgaaaccagaggaatttcatgagttctggggagtagaaagaagtagggtgagctctgacaaggatgatggggttgggcatgtgatgtctggagttggggctaaggaggccagtccaggagatggtccctgaggtaggatgggagtggggccaggcaactgtaagacagcgatgtctcatgttattgagctttgctatttcgtaacctctatctgccacactttctaaaacctttgcataactactgggtatctaccgagaggaaaagaagtcattatacgaaaaagatacttgtatatgcatatttatggcagcacaattcgcaattgcaaaaatatgtaaccagtccaaatgcccatcaatcaatgagtggataaagacactgtgagatacacatatatatatacacacacacacatatatatacatatacatatgtgtgtatatatatatgatggaacaccacacagccataaaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaataaaaaattaaaaaataataaaaataaaataaaatctttataagactactgtacctgttagagcctcctttctgggaaattaaaactctaattgtttccacattagcttatgaggtggttggtaaaagagaatgactacaggaaatgaaatgccaatgaggttgataattcagtgggaccaacaagtcacagtcaaccagtgatggagatggtaaacctactaggaatccacagaaattttgaggcaggtaccggactctcaagagtgtgtgagattggtgaggctttggcctgagccattgaaaataaatgcataaatagcaacacttagcagaccggaaaacatgggggaaaacccagacaagagacacttgggatttgtcagtaaaaaatggagttgtgaggctgggtgcagtggctcacgcctgtaatcccagtactttgggaggctgaggtgggcggatcacgaggtcaggcgttcgagaccagcctggccaacgtggtgaaaccccatctccactaaaaatacaaaaattagccaggtgtggtggcactcacctgtaatcgcaactactcaggaggctgaggtaggagaatcacttgaatctgggaggcaatggttgcagtgagccaagattgcaccactgcactccagcctgggcaacagagtgagactccatctcaaaaaaaaaaaaaaaaatgcagttgtggaagctttgaaatccctgctgtgaggttatggaaggagaatgtttctgttcaagtatgaatcttttttgggaggggtggcaagaggaaggtatgcaaagggaatggtgaataaaatgaaaaggttcgactttttggtggttagtcacctaagaaggttttgtgggggaaataatgtgttttagccagcaaggggattgtttaacctgccctctaccagtctgccgtgcctcacccacttgtctacagctgtcctgttagttgtagcattttgttttcttttatgcaaagggattttcttatgacactcaaggagaacccaggagagggaaggcatctctgccttccagggacaaagtttcagaactgtactgctctacagtggtaaaaagacaacaaagtctttgatttgcaggttgcttgtttcacttaccctgtgaagtggagctcagttggaatatttcatctggccactctttagatgttcacggcagccctgcctggccagccatgaggtcgggcggagaaaggaagcaaggatgagtgaggagggagagaaatggccctggagtttgttgttggagatcttctctgtgtcaaacatcttaagggaatcacctcatggaatcttcgccacaacccattgatatggggattattttccattttataatgaggaaatgaaaccttagaataacagcaagaagctcagacaactatgaagtggcagggtgcagttatgtgactcaaaaccagtgttattttcagaagtgggaaatgtcatgactttgccctcccctccccttctctctcttccttcctttttgttggctatcttgagctgaatggtgataacgcttaactagtggaggtacattttgaataaacagcgactgacttaaatttataatcataattttattctagagttttaacaaatggtaaaacatttagagttatttttccgcagacttgacaaaggtgatgcctgactgtgcctgccgtcatttttttctatttataaaatcagggtaaatttgcaaacttctaaagaagcagacatggcttcagcaaccagtcagggtggaggtgagaccaggaaggttggagctcatgaaaggtcctcctcttctgtctaaggggcacttacttcattggtagctcagctgatactttgggaattccaagaaagagccaggaaccctgctaggaatagagaagcaaagaatccagggctctcactttgaattgctcaccacgtctagaacatgagtcaggcacagacacagaaaagtcagcataatgcgtatgtgcagtgattatgagatgcccatgcagcgtctttacaccagccagggatgcaaggaagaatctccggagaacatctacccaacaggtggatttgcttgtggggaacagaatctgtcaaggagaaacaaagcagtgcagtagttgcatcatcatgaggaaggatgatgtgcagagttagtttcctaagtggcatcgcctataatgagcagcgtgttctcctaccaccttagctgcaagcagttatgctgtatagccaacatctttctcctagctcacaattcaaaagcacattgctgggattccttgggggctttgcgtttatttgttgtggtctagtggtttattctggcaaaatacactgcatggatttttacagtttgctttgtgcttggacatctttccacccaagcaaaatgtttacaaatgccagcacgtcgttttctgaaaatattgctgaaaagaacaaatgtgttgtgatgtgccatgtgtttgaagagaccaggcaaccaaacactaagattgcctcttcctgtcagtgtttttgctcggaatcattctttattgtgcctgtttctccagaactctgtaatccaaaatggtcctgttctctgtggacatgtgtttattctgcaagttaaaaccctttcaagcaattcttgctgtgttaaatataacaatgcactgataaaattctgtcatacattctagaaaatacctttgtataaagtactcatattactgaatttaccaaaacagcataggtaacagattctaagatatcttagagttaattgataatatgtatctgaatgttgtaaaatttatctttcctatgcaaatcccttcaaaccatcccttctagtcccatttttgagacacacacacacacacacacacacacacacacacacacacacacagactgactttgttattccttactggtttttactgatggtcatagacgtctttcttctctgctacttccattatcttcctgccttcaaaatctccactttagttgcagttttgttttactatatttcttatttttaaaaatatataggtaaatagaaattgaaaagctcccattttttgttagattcatgaattcctttatgtaattatttttccaaaattaatcctgaatacagactagtaaatttatatgacaaagaaaatttctatgacaaagcaaaattaatgctgaatacagactagaacatttatatgacaaagaaaatagggaactgtgttgtttcacatactcaggagcttctgaattcaggaattttctagatggagaagatctcattatatggtgacaccagctagccaggtgtactactgaggtctgtctgtgttagactttagaaatagaccaaggatggagggaggtttgagaaatctaagtaaggaagcataggagaccttcttgtttgaggtcaaagaataattggaaggagtggttccatctcacaatttgaaaatgttctaaggaacaaaacgtacttttttatagacctattgatctcagaagatataacacagctggtggagggtaatgatcaatcgccagactaccaccattctattttcttctctgtcaaacgtactcactatattgtgagtgttttcactgcctaatttttcatggcaatttttgaggactggtagctgaactaatttaattctcattctctcacttgttcaccaaatcatttcatgtgtgtttttgccaggtattgttttaaatattgggcactattttcggttcagtaattcaacctattttaatcccttactagcccagttgtaaatttcaaataagtcattttttttcataccagttccctgctttcgagtctctgatgaggctacgctcaagtattacccaggattaggtcctatctgaaagctcaactggggaaggatccacatttgagcttgtttatgcagttgttggtagaattcagttcccttaggacggttggactggggggcctcagctcctagctgactgtgggccagagatcacccttggttccttgacagatgggcctgcccattagggcaaattgaagcatctaagtcagtgagggagagactctactggcaagacagaagtcacaattatatataatggaatcactgaagtgacatctcattatctttgtcatattccattggttagaagcaagttacagcacccacccacatacattcaggagggtgtgtattacacaagcacgtaaacaccaagagatgggatctttggagaccatcatagactctttcctccataccatctgaacatttaatattaatgtagtctgtatttctacataacagttctctgaaaggaaactttgctgtgtgccagataatactttttgatcttcttattttacctttccttaccccacccatgattattactatcaaagctttagggcataacatagtgctaaaatagaacacttactccaaaaatttaattaacaagcaacatgaaataaaaggccatttgcatattgtaggcaaataaaaacattatcaccaggagaagtgagtcagaatatatcaaatataatagctaatattaaatagctgggggtgagagttggaataatgagcagcctctgtacagagggcatgtcaatcaattactctggccctattggagcacctgcctagaagtccttgctgtgcctggttaacccatcagttgctgaatagtggggaggtctctggtggggattctgggaagaggggctgagcagtaattgcggagaaccctaggggatcccagcagtcactatttactaagacatttttattacctaatactctatggctaaatagttaaaagaattaaaaattctcaaatgctttcaaggttggagccagttcatggggtcaggagagctatctccaggcctgcattctactccccttctttttccatccctgccccatccctttcaggcagcacctggtgcacactcaggtgacccagcctacatgtcgaggatccacgtaaacacccctcaaacagatggtcccccgcaggcctcggaatgtggcaaggtctaccattaggaatgtaggctcaggaaaggctccttcaggccctgagagtggacgtggaatcctgatggcggggaatcccagggtcctgtgacccagagcatggtctagaactgtgctgggcagcacagcagccgcacattggctccagagcactggtcgagatgttccttaaatgtaaagtacacaaccaatttcgaagacttaatacaaaaaataaagggcgtaagatatctcatcaataatttttatgttgattatgtgctgacacggtagtgttttggatatactattgggttaaataaaatatataattaaattagttctaactgtttttttctaatatagctactaacaagtttaaagttctatgtgtagcttccatttgtggctcccataacatttctgtggaacagcactgctctagaagggagaagtacggctctgctaggacacatctcctgctaccttggaccccttgccctgtgaggaggaggagctagagcagagccctctaaagcgtggagtcccaggcaggagcctttcttgccccagggtggttttgctttaaggtgatatttatagtctatttggtctcactctgtcatggctaaatgactccaaatctctctcctttgcctacttctgggttttgcccaaggcaagaaaatagtcttcctcaccttccacctgcccacccccactgccactgccaccaccaccgcttttgaatcaatataaccaggcacagaaagtaaaattgttctgtattgacatgtatctttcaagaagctgttattctttgggtgaaacagaatctaatcactaagcaatttttctacagagagagggagacttttcactccccttccccttggtttgtagagtacattcatctttgataattgattcttcgggtggagtaatgatgtaggctcaggaatacgttttttgattcaaagggtataaaaagtgctatgtgtgttaggggttaatgtaagctctgtggaattacaatacggatgtcttctaaagaaaattcactaatctaatctctagagaaggaaacttttagagagtcccttatgactcccttaagaaattattgtggatagtatgttgctgtatgatggctttaagaatttatggtgaatgcttcagaccatggctttagtgtttcaacagaaacagtggcttacttagggtggtggtgcatcttgctcttgaataaatctgatctgagcttacaagtaggaaggagtaatgatttagatgtctgaaatctctttagtttattgtttcttttcttatcgtggcagagagtgactgttaaaactttttcctcctgggcacgtagctggcctacatttcccagcatcccttacagatggctgtggccatgtgactgagactggccaatgggatgctagtggaggtgatatattcttgtccaatcatctactctttctccttttcttctgcctatgagatgcagagtataggggcacatgggcaccacctgagaactctttaggaatgcagaatctttaaccttctcctaggtgtagggaatcagaatctgcattttaccaagattcccaggtaatacctatgctcattaacatttgagaaatattgccctttgagatgacagagccagtagatggaaagatcttgggtccctgccttgtggcttagaggagagccacccaggagtgtggcttcttgaagcagcctgtttagattggtacataaacaggaagtccaattttatcatgatgaggtcactgagattttggagttgtttgttatagcagttagtcttccctggataatatactcacaaagtatttaaacaatgccatgtacctacaatgtatccccttcttaccaataaattctgccaaccaaaatgatcatattgtacctacaatgtccaaaatgtttaatacagactgaggtagaccttataaatggtattggtgaagcctagtggacaattttaagaaatcaccaacattacaaaacgttgactggcaaacttgcgttcaccctatatatgctctgtaaatgttcctagctccctcacttttttgtctttttcttcttcaacggcctccttcacttttcagtagcagcaagattaagaggtgaaaactgccattactccagtgaatgggtgaggtcactgatttgcacaattcctatgagagcccaattaaaagaagatacagagataagcatgtacgttttcatctctcttaactccattatcttattgtcatttggctatgatttatttaggtcaacattgatttctgtagcttatttagatagctagaatgataaaaatatctttttgttatcacaaggagtacaattatttacatatttacctattcatccattcattcttagtatacagaacagtccaatcaggaacaatctgtagtacctatgacaggtacagaaaagcccttaaagattagcctctaaggtgttaatgggagagatttactgatttatatttttccctatggatctggagatacagggtattaacaagatggatgagttattgggggtgcatttgtatgtctcagggtgcatgctgtctctgataattgctgtctgtgtttgattgggcagagccagtatcttaaaaccttcactagaatttcctatattgagacatctaaagttaagaaatctaggtaatttttgcttatcggtttaaattgtgcatagaactaaattattaaataaccagcatgtctaagccttacccttttctttaattacacacatatccatgcatgcacacacatacatgcacacacatacatgcacacgtgctgaggaggaaaaaaaagctgaagggattttgtctgtgcatacatgcgtacatatgcacagacacacacaagaggcacatgtacacatgtatggacctgtgcatgaacacacaaatcccatcaacttctttttttcagccagtcattatagagaggaatgacagcttttatttgctgcaaaaattcaagtggaagaacgtcatatacaagaactaccagcctagtggtagagaaaagaggattctttgaagctctttttagtcagtctgtactagcaatagtccagtgtttcccaacttgagggtgccctcaaggcgttgaaaacataaggtaccactgtgatcgaggttttaccaaattttaactttccttcacttctcacctaaaatatcttgagggtgatctgtgctcagatttgttttaagggttggggggagtattcaccttctgaagtaaaagaaggaacaatttgtcctctgtctggcttctatcatgaaacttcataacccaagagcacatcttgacttcagctttgttatttttagtggtagaggagaggaaacagtaatctgcaaagtgtgagttcaattaccctgacctttcatattgaaatctgaattcttaataagtgttttatgtgcattttatcatttaacccttacaacaaccctatgagataggtagtgttattataccactttgctgaggaggcaactgagacacagaaattaagtaacttgcccagcatttcttgggattctaacctaggccatctggctccagaagctgaactcttaaccacactgctctcctgcagggtcgatgagcttgccatgcctcttggtcattccctaaggtgtggcattttgtgattcgggatctggctaactcatttaaatatggaagtttcacaaagattcaggctgctcagggatacaaaatggctcattggcagggtggggcttccaaggaaatcgatttcattcctttcctaatgggctgcgctagtttgcaaaaatcaagaactgtgacgatttaagatgcatctgaactcttttagatttccatagaacctcactcagcagtcctttcgagatgatgtcatagttcttttgtgtaatctagtaatgccttttaggggaggaagccggtgtattttacaaatgttatcttatccttacaacacccttgaagcttagtaagtgatattagttactgtttgggggattacaaaaattaggttgtggtttttaatgtttatttttatagcaatgagaagtggtacacacacacccatacttatatgcatatttgtaaacatgtgttatgtatattattatatacacgtatgcatcctccccccagcattgatgtgtgtaattcaggtggtatttggttgactccctcctaatattttgcaactgccactaattgtgatggttgttgcactttaaaatgttaaacttttagaatatgtgagaagtgagcaatttggcattggatctagcactgtgtcctcaagtccctttcatgtgctcagtggatttttattgagtgccaattgtgtgccaggcagtggcattacaacagtgaccgaaacaaagtcactccacttgaggacctgaatgtctagtcaaggagctagagagaaaacaaatatatcctctgtcaggtgggggtaaagcgcttctgatgacaaataatgttggctgagctatggtgacatttcagcagaggactgcacgagctctcccaggcttttcttgctctaaagcagtagttctgaaccaggggtgagtttgcagtaactggagatatttttctgccctacctggggcagggctgctgccaggatttcccattcagagtgatttgagaggatctcagtccacctgtaaagaggaaaataccctcttagatttgtagggccacagcctcttttgctgtgcctggaacatactggcagacacctttcctgctggggattttgcaaaatctggggacgtttttggtggttatgcttcggggaagggtgctgctagcatctagtgtgtgaggctggaagtgctgctaacatcctgcagtgtacagggcagctgcccacaacagaatgatctggctcagaatgtcagtagtgccaaagtggataaacctctagaaccacactccccaggggttcagtagactttcccgagtgggcatggaaaggtaaactcaactccctttctgcacgacccctttttctggcccatgagagcctatgctgtggccagtcgctgtgacagaatggttttctgcagggcatccatgctcacagcaggatcagatgccatcttcatgctttgacttgccaaggacattcaccaataaaatgcgcgttcagggagacagctgtcatgacacaacacgtttttcccatgacacacatttcttccgtccctctccaataacctcgactcttgaatgggtgagggacatttcctcaagagctgtttatctgggctttggggctgtcttgtgaattctatttaaaaatactcaaagtccctgagatctttggatctaaataacatactggaaccttcccgtcccctcctctccttggggctatggtaccaacagaagatgaaagctttatttcattttcaaaagtattttatatttctttattttgtaccctcttgataattgatcctcagctgccaggatttcccattcagagtgattcgagaggatgcccaggccacctgtaaagaggataatacactcttagatgtgtagggacacagcctcttatgctgtgcctggaacacactggcagacccctttcctgctccgagtatgcggtaagggggcaagaagctgtatggtggcttctccctggagaagcagcttcagccccttgtgctcctgcactcctgtgctttaagggcgagaacacattggattctttttttttgaggtggggtttcactcttgttgcccaggctcaagtgcaaggcacgatctcagctcactgcgacctctgcctcccaggttcaagcaattctcctgcctcagcctcctgagtagctgggattacaggcataggccaccatgcccagctaattttgtagagatggggtttctccatgttggtcaggctggtctcgaactcctgacctcaggtgatctgcccgccttggccacccaaagtgctgggattacagttatgagccactgcgcccggtgaccacatctgatgctgaaccaaaggcagctcttgggaggtggctctgagcctcccagccgcaaggtaggggagctcaaagatgttttaggagtaagcttgacaagagggtatcaggaaaaattgtttttctttgaatctccccggaatatatcatgtaattcacctcttgaggggtcctagaaagaccacttgccatcccaatatctagccagtcctggagtggacccagtcagagtgcatgaactgtgatacaaggcctatgtcttggtttttttcacctcctgcaagctaggagcctcccaactacccacagattggaagggacttggtgcagggatatggcttcgggtgacaacccacctatcagagctattcaaccattgaacagcatggctgtcagtctgaggtcgcagtgatgtcaggaggtggcagttttggcagctgacagccctcacagatgcccttgtgcagaatgaacctatcaagcattttctctactggctatgaaatggaaagtgaggcaagacattcagttgctgcacaggaaggaaagcagtcagggtggttgcctgagcgtccaggtcccagacaggtctgttctccatggaatacattaagggattgatttacctgtcttggagctgcttcacattgcagtagagggactgtgccgagtgtcatgcaatggccagttatcttgcagaacttgtttgtttctgcaattattaaaagttttcctggcagtttttttgttttgaccgagagtctttcctccaaaaatcattctctccatcctctcagaaccctggataattctctcctgtttgtcgtttgcataccatgtacctggaactcttatgttctggttaagtattctagcataagagagaggaagcaaaataagtcagcagaggatactttcagcatactgtgacttttagaatgttcagttagtgatactaacgtttcatagcctgtaccaataatcaacttttctttcccctgaagacaaagtagcatggttgtgacctatctatactgacttgttttcttcatgcatgcattcaacaaatcttaattgagtgcatgttatgttctaggcgtggggctgggctgaccctctgggaaatgacaagatgaaatgagacacattcctcctttcaagaaagtttgtgtggaatgtagaagatcattcattggttgaggagattgtaaactatcctggaacacagtggtttaggatgaaacaaagcagtgcacaaatgaacgctctagtcagtgaggctccattagaggttcctcaagggtggggactgcgttgagtgtcacgagactcctagggtcagcacagtgcccagcggctggtacgtgctttctaagtatcagctgaaatgctacagcagcacggcctagtggggagggagagagaaagggaggaagagaggggaagggattgaggaaactgacctagattatgggcagtgctggtcccccactctcagcccatgtggcttgggagaatgagcctgtctcttgatgctgtgaactatcaccaagagatcccctaccttgctccccaagttcaccaccaggcttctctccatctcagagcttattgaaaggacatggaatcctctggagggagttctccattgaaaacaaagacaataaattccaagtggcaaatctcataggtggccctgagtccctgtgatttttccagtccaccccttagttgaagtaaggcaaaatttgttttggggtttcataacagtgatgtaagtgcattgctttgaagcagtttttgagggagaggggaaaagcctgagttttggagaactacatttgtggaacccaagaaagtgatacatcttccctcctcccacccctcattgggggagatgacatggggcatacttccctatgtgctttagggggtctctacagaaagggggaaatgggattttgctccttgagtttgctgagggtaggacctgcagacttgctgtggtgccttcagagcaagagggaaagaacacagaaatagataccaccaaaagggatgaggatttcagatggcacacagagcctgctgagcgcatagccatgcaccgctgtgctgtgccttttcctctgacatccctttgcccacatataggagacaatccccttacaaagagccaagagcaagcctgaaggcttctgggagtccagtcggcttggaagtgagggaggaagctgggaaagagtgagcttaggtccgtgaacagtgatgagttcatgaaaatatttgaatctacctgaatagaaagattattttaaactagggaaaatttattttaaactggaagaggctgaaaatataaagtccactaatcttgtctgtctccatgagcttttacacatacgcacatgtgcacacacacgctcgcccatgtaatgttcacttaggtcaagatacagaccaacccaccaccccagaaggagctcttgtgcccctttccaatctctccccaagataaccattattctgacttccatcaattaatcaattttgcctattctttaacttaacataaatgaaatgatatgtgtacttttttgtgtctgactttcttctcctcaatataacgtttatgaaatttatccaagattttgcatgtatcatttttttaatgctgtgtataattccacagcatgaataaaccacaatttgtttatccattcacctgttgatggaaatttgagttatttctaatttttgtttttttcaaatgaaactgccgtgaacatcttgtgcatatcttttggtggacataggcacccatgtctctcagatggataagattcgaattataggttccataggccacatataggtaggcctatttgtatctttatatttgatttgttctattcttctgcccatgacaaaggtagtaaacagggtgtctttgagcagggaggctgaaaatgctctcttgtgagcagggtaagtagatggcttgtgctggtgcagaaaggcaggatgctggagaaatcccaggggaagcatggcaccagtccaaccagagactagggaagactcattaagaataactttttactacatgtaggtccagggaaagctgacatgggaataatgattaaaaggaatcaagtaaaggggcagagaggtagatttaagtaatggaaagatttttggtctgctttctagttttgtcctctagcacaatacgaaataattggctgtgggtatattacaggatcccttagatcttattgtctcatttataaaatataaaggctgtacagggtagttcctaaatggcctttgagctttcatcttctcataattgcatcaataatggcttagttgtaaatgaccaattctagtaataggagaaaatcgcatggaaattactgagaaaagcccagtttacttcatgctgttatcttaacatccacaactacatgtcgagagaatacgaaaatgtgttcttaggcttttccttgttcaaccagtctagccatgtgccattggtccttcaagggcagtggctgagcctcttttcttcctcccccactttttgctccctaccagacaaccttctcccataggtgctagtctgtttcctccctgactcgcattcctgcagccaatgcacctgctggtctgctggctgttgtttctcactcactgaaaaccagatctcaggatggacataggttggtggaccattttcttccagtcattcattcattcacttacagattaactccagttacagtcactgtagctagcatcacatacactaagctatctctcatactcttccagacattgcctaaggctgtggccacccagcccctgccctactgggtggagcccacacttgtgatatctcagagtgcttcctccaaccaaagaacccagccttctgcaggagggacacccctttccccctcagacagtcctgattctggcatattaccagaggccagtctttcctgatctcctcctatcctgagacgttctaggcctccttgagttccagttcgctctttcaagagctgcaccaaaacatctttacaacttgtgtttattatttgctgaagtttagctatcttaataaagaattatacttgtgatgaagtcagggccaggtcagtttgtctttctattcttggttcttagcttgttatctggtatatacaaaatgtttcatgaaaattcttcgtattgaagaaagggaagggttttgccaaaagccctactcaaggctgggaggtactgacgcattactgacacctagggataggctacctaaattgcagggtcatggactatgacaaaacagagtgttagtagtgaacatctcaggtaataccacataactttttaaaggggaaaggtcttcctaatttctataaatagttcaaactttcagacttagaatagtcctgcacttgtggcagtgccctcatagatccagaaagaactgatgttatctgatcttggggaaagtccccgccttgggtttgtaaatatccttactgacggtttctagacatttatgcacgacgttttgtcatgtgggatccagcacatatttctgacctggcgaaaactaagaatatctcaatcataaaaataaccagaaaatcataaaacagaaatctggcccaagattttctctggaaaagtaagaagctgctttgaaaggtgaaaatagaccagtgagcccccgcattggaacagattattccaaaaattgtgagcaaaggtctttttctgtattgtgcaagttaatctcctttgcccctttttgtggctgaaatgcatgcctaatctgcatatgagtgcctgccccaggtgggatggggcatgctgggattcctaaaattcagctggcttgcttgaagagggctatcaggctagatttcatgtctcaacaatttctagccggtctccctgagctggcaagcaccgctcagtttataatagtgcctggcacatggtaggtccagtgtttattaaactaacagatattcccaacaggtgtgggcagcagtgctgctaattagcagtaacatagccgcatggcagggacaggaaaggggagccttctgtgtgtccctactatatgcaatgtatgactccaatctcaaaagaagcagagaatactcagccaaatatttgcattgattcctgccaacaccatttttttgtgatttgtatgttcccttccccaccccccaccccctgtactgttaacttcatatttgaagggggttatacttttaggttatttgtgaattgagtcagctcatgtaacagtgattctcaaagtgtggtcccaaaaccagtgggatgggcatcacctgggaacttgttacaaatgcagattattgggtcccaccccagacctactgaatcaaaaatcctggaggtgggtccagcaatcagtgttataatgagcctaccagatgattctaatgcacattgaagtttgaaaaccaccattgtttaaggatcacaacaaatccaacagcactgtcagaagaacaactccttattctaatgggtcaggtgctttctgtgttggctgtcctgcagagcatctctagtgatagttgtattttcaggattagaggtgcaaaactaatgggagtttaagaaggaagtttgagcctttactgctgggagaatcacaagccaagtttatttctcttccattatttgtatggtagctaaaactgccaaggactactgtgatccattgaaacatcagtgtatcacatctcttcttacatctgagctggcattttgggtgtagtgcttcagtaacagttgtattcccaagcaaataaaatcttagccaccagaaatcttgagttggactagacaaaggcacctctccagatagcagctgttgttggaattgaatataagagatgcttaatcaatgtttgtgtaattgaatagaatgggaaatgaatggctcactccaaactttatacaagacagatgaaggcaacttcgatcttaacctttatgatacatagcattttgtactacccttgagaaaatctcagtctcgggttatcatagactcaattggctatcatgggaaattctgtctcagtgatgctccatatctatttaattgaggtttattatcaatttgaaaaatggaaaattcacctcacatattttaaatagccaagatagccagagtgtatgttgtggtttcaatatgtccccaagagttcttgtgttaggagcttggttgcctttgcagtagtgttgagacgtggggcccttgggaggtgattgaatcgatgctgttatcatgggaatgagtttgctatcttgggagtggggtcctgatataaatgatacatttggctgccattttctcttgtttcatgtgcttgcttccaccttcccccttccaccatgggacaatcctctccagatgcctgtgccatgctcttggacttcccagcctccagaactgtgagaaataaatttctttataaattactgagcattctattatagcagcacagactaagacagtgtaagaaagctcttatattataactctctccttctatttgtattcaggttttctcttaattctggaaagtttgggcagcagctgggaatgggaatttattataagacatcccttcagtgtctctacagaattgctttaattaaagtactttgttttatttgtccccatttaattataattcacatcagagaaagctattgttaaaatattttggttagttcagtgtggggaatgggattttccatcccttgaccttcatgactcagtaaggagcagataaaataattttctttgctgggtgattattatgcctcagggacaagtcatatttaagacctgatagtttgattcaagctctcataattgctgtgcagacagtgttcaaagccaaagtcttcctgatcataaggtgctgagaggacattcattttttgccatcattcagagctctgcaagagagcaaattgcttgttacttaaatgtgttacctttgaagaataaaaatctgaattgacactgctgttatttgagccttcaggtgtagggacttggagcacctatgtataccatggaatgtggcttaacaggactaaactgattccttctgcataatgtgctatatactgatttgcactgtatggagtaaaacctcttcaaccatatttgaaagattgatatttactctaaaaagcctataccttgatgatatggtaaaataatcaggttctctataaccttgaatactagtaagctgtttctttgccttcctaataacatgagggtttttagtttttgtttttaaccagcatttgagtacctactatgtgcctaatagagtcagagtgactcacattaaaattaactagagttaccaaaaatttgtccttcttacacaaatatgcaatgacaacagaatgattatcagtaataaatgtatgtgcacttgcagattactaagtgactgatttaccacaaaaaaggaaaggaacattacttagatttgttgctgtccactccttgtttttcattatggttcagtttggattttcaccacaattcagacatgaaaactattctttccataatgaaatcaggtgtgaggttttttttctcattcttttctttagaaaatgtatagcttaggccaggcgcagtggctcacgcctgtaatcccagcactttgggaggccgaggtgggcggatcatgcggtcaagagatcgagactatcctggctaacatggtgaaaccccatctctactaaaaatacaaacacattagccgggcctggtggcacacgcctgtagtcctagctactcagtggtacatgcctgtagtcccagctactcgggaggctgaggcaggagaatcgcttgaacccgggaggcggaggttgctgtgagtcgagatcgtgccaagagagactccatctcaaaaaaaaaaaaaaaaaaagcaagcaagaaagtaagaaagaatagcttatattttctattaactccaaccaagcaaaatttaaaatgctaggttgcactccttgcactccgtagtgcaacccaatagcaccatggctttttaattccctgagagagagatggtggacagggtgttctgggaaactgctgacagtaacatctgtccataccgaaagtcaagtgaaaacttggttcacatgagagcaaatgaaaatatgatgtttttaaagaggctgggaaaaagtcagagaagtgctcccactattttagatgagctcagcagcaagtttctagtaggtaagagggaaaatccattgtggggaaatgtgccaatgactgtttttggttaaaggtttgaatgggcacgatttagcagaactttacaaagctgtgtcttgaagagctttggaaaaacatttagtgttgttgtcgttgatgattttttttcatactctctgttgttcaggttatatgtgactgaaagaaagaatgatgtagtttcagttacttccatgacccaccccgggctagcacctccttcagccacatggtaaggtcccagaaacatttgatagagaccacatgaaagtagatgcttatgcagatgtgacttttgaaatacattcttcctggctttcagatgtgctattaattgcaggtttaaaagcccttttttgtttgatctgataaggtaggcttactttatgtcaccttaaaatgaggttaagccaagaattgcaagatataaagtattcaatgactactctccatttctgctgggaaaaagaccatctgcttaggtaattgcattgtaatactcaaacctggctgaattgcttctgtccctgcaaacgtctcttctgtcttttacattcacagtcatatatctctcctgcatgtagatccaagacccagtgtagccttttgtataatttgtaggattaatagactctgggtctggcctagtacttatattgtaggtctataaattatcataataacataggtataattgcaggtagagttttatatctgggtctgcagtggtttgatcattgactcactgagaacaattattaatcttcaactccaaggtaggacacacagttccaattggtacataaatagtacatacatttacattacagcagggggacattgtctttgaaagaacatgaataatacgttaaacctggaagctgggagggggacatacagtaagtgggaaaagagatattgcagaaagtttaaaaacagagaagaagaaaataaaataaataccaaagcaagcatgctgatatcttaaattaggtgcaaggaattctttttccttctgtgcctcagagctgcctctatgtggccatatgtgccttgagggggaaggagtatagtaagctttgggaatgatgattcttcatcttgcaggatgtagttgctcgtgttggctcaactcagggtaaatattctagatgattgatgtatgaaatcctaatagtatgccatttaggagtttgtttaccatcagtctccacattcagactttttcttgtgggtttgaatgttctgtagtttctgtaatattgaattcaaaggtttgcttttgattggactttcctaattaaaagcaaatttattgtccctacaccttgcctctacttagcccaatctcacacaccctgtgaggctttttcccagatgttatttctccttcttgaagcttcttataggcagaaactggacctcattcatctttttatcttttacagtgctctcgcaaatatttattgaataaataaatgacataatttatacagtctgtgaggcttacaaataccttctttaagctattagtaaaacaaaagtactggcacaaagtgatttcttgttcatataacagaagtattttactttcaaacacacacacacacacacacacacacacacacacacacacacagaaagagggagagaaagagagagaagcccaacccaacaaaccacttaagggaaaccatgaaaatggtatctttgttgagagttaatgagtttatagttaatttatgctttccctggaatacatattatactcattatgtacaagtaaactatgactgtttttacacctatcacagatattccagatcttaaaatgctctgtttgaaataaaaggcagaaggggggacttgggcatattcccttatagttattcttgtgtctcttatggaatagatgcaaaaaagtctaatttgcctttctgtcacttggcaaagtttattatttgcttaagcacaagaagataaatgttttatcctactggcaaaaagtattgtttgcacaaatgtaaaattctgttaaatgtatttatatgtattgtcttagtcagggttctctagagggacaggactaataggatagatagatgtacatatgaaagggagtttattaaggagtattgactcacatcatcacaaggtcaagtcccacagtaggccatctgcaagctgaggagcaaggaagccagtccgagtcccaaaacctcaaaagtagggaagccaacagtgtgcccgaaggcccaagagcccctggcaaaccactggtgtaaatccaagagtccaaaagccgaagaacttggagtctgatgttcaagggcaggaagcatccagcgtgggagaaaaataaagaccagaagactcggcaagtctagtccttccatgttcttctgcttgctttattctggctgtgctggcagttgattagatggtgcccacccagattgagagtgggtctgcctctcccagtccactgactcaaatgttaatctcctttggcaagaacctcacagacacccccagtgacaatactttgcattcttcaatctaatcaaggtgacactcagtattaaccatcacatgtatgtttctatttgagtgtttctgtaaatgacatgctttagtttttgacaagtcaaatcctaccaaaataccctcatagaaaactcttgatgagagtaatggttatatccaagtcctctcaataacaaatttatttcaatcaatatttaatatcacaaaataacagtatgacaaatgaaggatagaatgtggttaactagtgtagagtgtgaattatttggactggattgtgaagtagatgtaactgatactcatggatgaacttgcagtaattatagataataaaaaattaccagccaagtgctgtggctcatgcctgtaatcccaacactttgggaggctgaggtgagcggattactgagcccaggagttccaaaccagcctgggcaacatggggagaccccatctctacaaaaaatgtaaaaagccaggtgtggtagtgtgtacttttatgtaatcccagctactcaggaggctgaaattggaggattgcttgagcttgagtcaaggccgcaatgagctcaggccactgtacttgagcctgggtgacaaagaccctgtctcaaaaaaaattataatgcgtacataattttttcacacatcaaccactttcctaacaagtcattgatcctcaaaataatcctgtgagtattattctcttctatgtaaatggaggaactgagtatctaataggtgattgccacatctaggcagctggcgtggagggtgttgaagatttgagtccggtgcctttgaccccaaagcctatggctggagatgcctgccaaggcaaaactgcccttaccaaagcagattttatcagctgatcccatttctctctcactaaactgagtccatgaatccttctcaatgtagacaaaatctatctgctatcctgacctatgttatttctaagtgtattttgctgggcattaacgcagatggaatacagccgagtttgcgtaagttctgtatagtacaccaccaagcaccttaacaggagcctgcaaattgccgttgagggaggtaacttttagcatctgaggctttgatgtgtttatcttctccaggaattttgttttgcctcctttgggaggggagaggtcttctgctaagcatctacttcctttatttcttactgcacaagaacttcggtctaattggccaactttgagtgtgctgaggtgacctatttctgtctgggataataaaaacattccagatgactgacgccttttactggggacaatttgacctgattctaaccctcctgctctgcctgccaaggaagatgattactacaggccttagtaccgacctctatttacttcatctactttttttttttcattttcttgcaaaaatagcaggcttgtccaagtgcctagctactatggcaataagtgctatttaaacagatgccgatgccgaatacatgtgtcccagcttaaatgagtcagtgggagcagttgtaggatctgattgcataaatgcatgggaataatgtctgtctctggggcaacagaacttcttttgagcccttgagaggaccagttcagttgcagaaaggctgatgtaatgatcacacaccttcaggtgaaagggtcagtttctccctgaatggaaagtgtcaaaaaatggccatttagactttctgctttgtaactagagcaaatgcctcaagaaagagaaaatgaacaggaaagccctcaaaagctttaaagggcttagaaaatgtaaagccattattgttggttattcaaatatccctctgattcaaatagatgcattgattttttaaaaaaatctacagttaacatcaagaaacttgagcctcagtaaatgagcactgccttatagaatattgctgaatatgtcttgaataagttgagaaagcacttggctgtgtataactactcatgtaaaatgctattggcacaaagatgacatttttttcaaagatgcctctatcatgtggctacaagtagattgtgctgattctattcctctacaaagctcagggtcacaggtggtctattagtagttgttggttgttagctctgccataagaagatggcatggttccttaggttagatgcattcagagttggtggtggacttgagtgtctacttatgcgcagagattttcagtcttttatttccatcttgacagtagacagagaagcaggggacaggcttgaaatttcagtcaaatatcaatccagcatgaaggaggacaccctgattttaaacacccactaatatttccttggaaaaaaaaagagcctaacacatctctggctccagctcttctctcctcccctcccttccctcagcccccaattctcttttcttttcctgtcttcagaatatgtgaaatgggggaaatcataaaacagtcaatcttcattattcacagtttccatatttgtgaattcactacttgctaaaatgtcttcgtaacggcaaaatcaatgctcactgtgcttttgtggttatttgcagacatgtgtggaacagtgaaaaactggagttgttccccatgcatgtttctagttgaagttaaaccaggtgacagccctttttgtttcagccctcatactgtaaacaactctcctttttgtggtcagcttagtgccacattttaaaacatttttctgcttttttttttggtgattttactatttgaaatggtccaaggatagtgccagcctactgtccagtgttcctaagtgcaagaaggctgtgatgtgccttgggaagaaatatgagtgttagataagcttcgtccaggcctgagttgtagtgctgttgctgtgagtccaatgttagtgaatcaacaatatatactcaataaacagtctttaagtagaaacacatgttaaacaaagttatgtatttatcagttgatgaaaatgtgaccagaggctcacagacacctagccctgtatctctccccagagcaatgcttcagtatttgctcagaaccaccacaagtaatgagaacaggctaacctaccccttggagttgacgtgaggatctcatgagctaatgcccctaaaatgcatggtgccttacagtgtgccccataggtgctaactatagcagttatcatcatcatcatcatcatcatcatcaatgaaaatacgggagaagaaaaaattaccaataatcccactattgtacctcaacaactctcttcattttgggtattcccttcagtcattgtttcgttgcattcacatctttgtataactgcattaaactgcatacaattttgaatatttctttgctatcattctgtcatgtgcatcaccctgtgttgcgacacagcctccatttctgtggtcttcttgatggaaagcggtaaaaactttgttcctgggctcatgtaagagcagctctcttcaagcatagggatgacttcattgctcacgacaccaatatgccttaaaattctgtgattaattgtaaaaaagaactctctctgaacactacagagaaaactctcacagagcagagaaatttattatgtgatcttcttctctccagaggaaaatggtgtgttttaagtcagaaggtttgggtcattattcagtagaacgaggtgctcgagggattacaaaagaagagtaactctaatctttgtgagagtgatggcctaatacaggtgttagcaaacatttcccgtacaggctcagatagtaaatgtgttagaccttgtgggccatatgatctccattgcagccactcaactctgccattgtagccaaaactatggataatattaatggataatattaaacaattgagtgtggctgtgttcctataaaaccttatttacaaataaggcacaattccaaacaaaatagatctgaacaccaaagtgggcagttcgtttattgctttattcttccacaaaacttctagtatgttaggccttgtcctggttggcagtaacatcagcaagagtagcaaaacatttttctatgcctcatgaagtttatagtctgaagggggagagagcgatcttaataaaataattgtataaatgaatatataattgcatgtgttgataaatactgcaaaggaagaaaacagtgggaaataggactgtgtcagatattcaggcacgaagtttagggaaggggctgcactttgaggtggccgccagacactcattgaaataagagggccttgatcattgtgcagtaagtgatttttattaacaagaacttagtcattacatacctagctgtaagtagatgctagctctgaagaatagattttcggtggtcagtttggcattcaaccaggaccaaaagagaatcccctcattcgctgacttggggctggatttatgagtgtcgtcactccctttgtattttctttttttgtcttattggtctttctaggcagaaatgaataccacatggttgagacacgcataagattcaggtccatcaggtcttgagcatctttctggtaacttaaacataagccaggatccacatatctaacggctacatgggatatagggcctcgttcataaaaacgcatacccatacttcttaatatgcccttgcctgttcctctttagttctctcaccccctgcaaatattcttcctttttaaaccctcagtttcttcaccaaactttcccagacaacctatccccaaggactttctttatccctctttgccagccaacctgtgtaccccttttcttctggaggtgcactgaggacttttccctcctgcctgatcatctgggcctctctgggctacccgggccttgcagcttcatggttcctccctgagcctctctccctagggagggaagcacaaggaactcactggagtgggcagttctgttcacaccctggtaaatgaaatcctctgcctcattacactctgcagacaatttcagcatccagtcatgcttatttcttgaaggaaaaggactgtttttccaccatttgggtctatgactccactggggattaaggaaagagacaacattgtggaatgtgtgtgtgtgtgttgttggagacagcttttgcttgggctggtatcatgtctactccaggattttctgaagtgactgtgggacaggaagaggcccattggtggctacttagcaacaccaggcccttcacgggcagtggaaagtcactggggtaatgccccagaccctcaccctcaacaggctacacctggacagagacagggcacccttatggggctttcagggatgagatgtgttcatccacaaataagggagaagcacagagacttctacaagtatgtagaggagaatctaggagatacaatgcaagggctgagaatttgggatatacacttattactgttggtgtggtcctagccttacaacaggttgtgcagcccaccaaagcatggattacagtgttaacatgcagaaattcctgattgtacctcttttccagctgttcaatcctacatgaggcctttcaaaacccctgtgatttcttacgattagagatgtaggctgtcccatctagtaaatttgtcaaaccactactgggtatcaggtagaaatagagttccctttcatcactagcaatatgtttcttttctcaatggtttgctctcctttgctcattttccatggaaggtcttcattactcctgtattttaaaagctatcttgtcaatattattccaagcgaatttctcagtatattttaaaagggaaaactaataatgtgatcctcttgcttaaaaccctttacagcttcccaagagtgttagaattaatggggctggtactagcatgcaaaatttaagggaatgtcaaaaaagtcagtagtcaagataaataatatttaatgcactattttaaaaatgttcttggcaaactttcgtccacacctgcgtttgtaaatgaggtttcaactcacaccgtgcatgtgacttgagaggccactgcagcacggccaggcctcagtgcactctctggcctcaacgtaactcccttgaccttccatgttgtattagtcctttctcatgctgctaataaagacataccccagattgggtaatttataaaggaaaaaggtttaatggactcacagttccacatggctggggaggcctcacaatcacggcagaagatgaaggaagagcaaagggacatcttacatggcagcaggcatgtgcaggggaactgctctttataaaaccatcagatctcatgatctgtgacttagtcactatcacgagaacagcatgggcaagacccgcctccatgattaaattacttcccactggttgcctcccacagcacatgggaattatgggaactacagttcaaaatgagatttgggtggggacacaagccaaactgtatcatgtaaccaaatatgttaagctccatccatgctgactttggtggtcatgtccatcccgggcctttatatgggttgtcccctttcttcacatctctgctgagctggcccctgctcatccttcagaactcgatcaagtgctccttccctcttgttggccaccctgagccccaaggtgggatcaggctcctctgctaggtgtcctcagggtggtgcgtgggggtcgttagtgtttgtccttagaatacctggcaagcagacatgcacgtgggtcattttgtttattaacaccaaactcctccagttgattataagctccatgagggcaggactgaatttgtcattcttatcgcacagtggcttacatgtcagtcatcactgaacagttaatggtcatttgatctgatatgcttctggtataatttcatgatatcagatctggagacatgaagtcattgttttcctggtggggagtgtgacaccaccatcttgttcaccatttgcagagttctttcctgtcttcgggcaagtagattaggttatatcgttatctctgtttatagctgtctcaaataaatcctttagaagagggagaaagatggtacaaagaaaaaagaagccaaggaggaaagtgactctcagagatgctaatgactttcccaggaaggctgtcacacagcaagaactcagatatgggttttacaactcagaaactcatcctgttctaggccccaacctcactctctcaggagaaggtcctggaggagattcccctctcactttccagaaaaaggacaaagggaattaggaatcttttcttaacattaacgccttgccaatttctagacctcccctcctgctcctcccttaagacatcctatttgcacgtctctgctcttagaggctattgggtttaagcgccacaataaataaaaggcaataaaataaataaaggcaataaaagatatctcctggtaggatataattttctttctttcgttcactgtctcagagttattttatccttttcaccacgagggactcaattggaactggctctcttattagccttcaggttcaactggcttccatggaggcattgtctcctcatagacctgttcacttgacagaccttcacagaagtttcatcagtataaggacccaaaacaccatctaaatggcttcatccagccatggcagatgccctttgctgctgggttgggtttttttttttttttctttcttttttttttgagatggagtctcactctgtcactcaggctggagtgcagtggcacaatctcagctcactgcaacctccgcctcctgagtttcaagtgattctcctgcctcagcctcccaagtagctgggactacagacatgcaccaccacacctggctaatttttgtgtttttagtagaggtggggtttcgccatgttggccaggctggtctcgaactcctgacctcaggtgatccacctgccttggcctcccaaagttctgggatttcaggcatgagccactgtgcctggccctgctggttttacttctgcctgaaacccactggggtgaaaggacaggccttggaaatgttgcattagtagcaactgctccctctaatgggaggacacatcccttccccatagtcagtgcaggagtcacagaagcttgagcacgacctcaggaatcggcttccattcattcattcaacccatatttactgagccccagtgtgtgccgggtacttctggacccttgggatatgaggtgaacagctcacagatccctgccctcctggagtttacattcttatgagagaaacggtcaatgaatgagtagtcaaataagttttacttccagtaatatgtggtatggagaaaaagaaatgaaggagaacagagataaagtttggtgatggtggaaggtggcagacagggtagccaaggaaagccttgcaaacgaggtgacatttgagcagagacatgacatgaagttctgggagaaaagtttatcaggcaaggtatatggctggtagaaaactctgagtccaaggcaaagtgactatccacaatcagccagaggtcaccatggctgggaagcatggcaggaagtgggaccagggatgcatgcaaaggccaaaacaggagggagttcatgctgctcatatctgttctggaaggacactggagaaatgtgtgtgaagaggaacatgaactgacttatgctttaaagggaccattctgaccgtcatgtgcaatgaatggagttgaggggctagtcaggagtagggcagagagatcaggtgagaggctcctagaataatccaagtaaaagatggaggtgactggattggggtgttggcagtggaggtggtgaggaacggtcggtcagatcgtcatgtattttgaaggcggagttcattcaccattgttgctgtaccagttgtgggctaggaaagaaagcagtgtgggtcaagcatcactcattcattcattgacacatacttgttgaatacctatcatgaacctgcccttgttctgggtgatggctataccggtaaacagaatagtcaaagcttcctgcccttgtggaacttacactttattattttatttttatttattttgttgaaacgaggccttgctctgttgcccaggctggagtgcactaatgcaatcatagctcactgcagtctcaagctccttgggctcaagtgatcctctggccccagcctcccacgtagctggaactacaggtgatgccaccacacctggctagtttttgtagagacagggtctcactatgttgcccaggctgatcttgaactcctggcctcaaatgatcctcccaccttggccttccaaagtgctgggattacaggcgtgagctactgtgcccggcctggtttacattttagaaaaagaaacagaaaataaaggtaaaaaaacaataagtgaattataatacatgttcagaagatatttgttatggtaaaaagaaaaaaatagagcagaagagggaccctggggcaggggagcagctgcaattttaactagggcaaccaaggtgggtgttcttaaaaggtcgccaggttttgggccctaagtagttagatggaagctaatactactatttaatgagaggtctataaagattacacaaataggctgggtgcagtggctcacacctgtcaatcccagagctttgggaggccgaggcaggcggatcgcttgaggtcaggagttcaagaccagcctggccaacatagcgaaaccccgtgtctgctaaaaatacaaaaattagctaggtgtggtgacacacacctgtaatcacagttactcaggaggctaaggcaggaaaatcgcttgagcccagaagtcagaggttgcagtgagccgagatcgcaccactgcactccggcctgggcgacagagtgaaactccatctcaaaaaaaaaaaagaataaagaaataaaagtgggaagaggagcaggctggaggttagggtggggtaaacaagctgttgtcatacttgagtccttgagtattgaatttgagctgtctcttagtgacaataccaagtagatagttggatattcaaatctggggcttaggcagaggccagggctatgtatatacatttcaaagtatcagagtctagaaggtctttaaagccataagaccagatgaggtctacaaggatgagagtggagagagaaaaaagagggcccagggccaggggctactgagtcctcagagtagagagaagaaaagaggaattagcaaaggagatgcagaaggaatagccaggaaagtgggagaaaaatgaggcgcttgaacgaagagctgaagaggtagaaagcaagtcacagcgctcaaagcagcaggtgagatggtgagtgggttgggaaagtgactaggagaactttttataagcgacttcctgagcagcaagtgatcaagttaccctgttgttagctatttgacggtggtgtgtagagtcacagaaaggtggcctctccctgtgtgcccacggaaacaccagggctgagccctttgcgtttgccagtgttcatgtgttcacttaagaattaatattattctccaaggcaaggcagtgggtacagatcgcagaagagtcaataccacacacaagattttgaacttaaatttataggcaatggggatttagataaagtttttcagcaggagagtgacatatgtaacctgttccatgtaaatagtttggggagcagaagggaggatgagttggaggaaggagaggtgatagggaggccattttagtagtggagccatgaaatgggggagggggagactgaaccaaaggagatgcagcgagaattcgaaagcagagatgcgagagacacggagaaggtggacatacagcctctggtacgtgattgtgggagggtacaatgagaggaacattgaagaccactcttggggttctatcttgtgtgactgggggatggagcccactgtgggtttttgctgggagatggagaggagaggctgtcagattaaccagtttatggattaattattaagaaacagcagggacctgggatttcccctcctcactgattagttagctggtaattaggcagtggctgagaatgctactgtctgtcccccatcgggtgggaggagcagagctgagcctccccacagttgctgtggtgcatggagtggggacctagaatcactgctatcacgtgacatgccccctgttcctcctgggaacccaactctgaaggggtcttcttgacatccgattttctccttccagagctcttctgaagttcttgcctaatgaagaaaaagcaagaaaagggaaaatatgtgtaccacagaattttccttctctctggtggtgttttgcaaaaatgccatggcaactttcctcttcaaatacttgggatttgtttctcttgcatctgtcaagtgcacatcaaagttgaattttccactttggaattatgatttgtattctgcttctcccatctgggcttctgttctcctgaaaactgcctattctactgtgaaatgagcattccccaaggctgatgtagccgcttcatgctaagtgttgatgggaaacctgaagctgagttgggcaaatgtttttgagatctgtaaattccccagagacttaaattgcttgaattattgagggacattttgacctcttgttggaccaatgagaatgaaagaaaagattggttaaatagaagaaatgttcagaatccccctcagccctccaaattccaaatattttcttttttctttctttttgtttcttttgagacggagtcttgctctgttgcccaggctggagtgcagtggcacaatcttggctcacttctacctctgtctcctgggttcaagccattctcctgcctcagtctcctgagtagctgggattacaggtgcacgccaccatgcctggctgatttttgtatttttaatagagatggggttttactgtgttagccaggctagtctcaaactcctgacataaagtgatctgcctgccttggcctcccaaagtgctgggattacaggcatgagccactgcacccggccaaatgttttctagttaagttcatatacccatgccagagtgcctagctcacacttcattataaatgtctgcctcaaacagaagtcctgggtccatgtttccactgtcctgcgagggatacacaagaacacttggcaaacgaagaagggaaggcctggggctacagtgggtagggagtaccagagacccaggggacaatatatgggttaaatgaggactttatttaatagtatttttaaaaattaaaattgtgacaaaatttaggaatcagtaattatttaaaaatccaaatattctgcttctcttgaaaaatcagaagacatggcatctcggggcccaaatttctatttggcagttttcagctggaggtcagctggtgtccccctaaactcaaggcatgtggtccccagtgggtcacgcccaccagaatcctctgctgtcttgatagctctgaggtccttcagggatcactggggaatgatgttctcctagaagactttctggatcctccaggtccaggttagatgctaaccaatgctcttaaagtagctatagcaacttttattaatatagataatattttatatttttcatattatataatttttgttattatattttaattgcttcctgacttatctcagtcctcttcagtataatttagtctccataagaataagtacttgttgtgtttgttattaatctccaacatcttggctgggcgcagcggctcacacctgtaatcccagcattttgagaggctgaggtgggtggatcccttgagctcaggaatttaagaccagcctggtcaacatggcgaaaccccatctctacaaaaaataagctgggtgcgatgctgtgcacgtgtagtcccagctactcaggaggctgaagtgggaggctcacttgagcctcagaagtccaggcttcagtgagccaaaattatgccactgcactccagcctggcgacagagcaaaaccttgtctaaaaataaaaaattaacaaatctccaacatcttgcataaggcccaggccataagcagacattcaaataaattaatttactaaataaggacaatagactaaataatccctggggtccattttagttgtactattctattgctctgatgtttctctttaaagaaacagattcatgggttttctattagagtaagacactgtatttgtctctacacatacctgagtaagaatgctttgggttagatccctcttttttggttcgtaaaactagagaagagaacagatggaaaggaccttgaagttcagcttcctaatttgcaggtggagaaacaggctcagagaagatacgtggacttccttcgagtcatatagttgtaacccaggttaggacatgtgcctccagggcagagtccacctgccttggtctctagtctgaaggaacaaatgaccagtgtggtagataagaacaaagtatattcaaagcctataaaagaaaagagacagagagaggaaagtggtactagctgacaaatgtcaccttagtggcaaaaacagtaaataccgtagaggtttataggacagaaattacttcagaaacgtaacaaggtttaagcaatccagtgtttattagcaatggttctctgactggggtgtccaaatgcattctaaggggactttgagttccctttgaaaacagtgaatgtacaatttcagggattttcatcatttctgtgagggagtatgacactttcctggccattgaaggggagaagggaattgatttgtaaatgatgtgtatacacaaagtgaaggcccagtgatggaatggtgatggtttgcagtagtttggggctgtggcaattagtgacattttgtttttacattataaacagtgatgtaattggagtgaaatgccattatccactgcgtcattttaatgcagtcaattgttactggcttcgtatttagtttttacacttatgttggtgtcagaattatagaagagttgtaagcaaaagcactttgcatctagttgtgttagttttgtgtacattgatgcaacattgcaatgaaagtaatctaaaacaatgccaacagtccaagagattttatctttcttttagaaagagtctatgcattattcaagcttgttgtgaatgctgacttcctatagcacttgcatttaagttatgagaagttattggcatgagagataatttaagtggcatgagctcatctgctgtcactgcatgaattacttgggaggaacttggtgtgggagatgtgatatgctctcccctcagtaggtggctgttcccacaggcaattctagattctaagataattctgactattgttttattgactttagaaccagatcctttgtaagatgttatgatgtacagggtctaagtggtggaaggatgtgtctttcctttaatgtgatataagccagagttcagcaaactatggcccatggaccaaacacagcccacagtctgtttttgttaataaaattgtattggaatttaggcacactcatttatatacagatggtctgtggctgctttcacactataaatccttagtccaatcatttcgatagagatcctatggcttgcagagtccaaagtctttattatctgacagtgccctaggacccagggtctaaatataaccatttctgcactgtgctttcagcttctgtgtattttatttgtttctctaaagtgacctaattaatctgtcctattgggataattagggaattctagatggttgttgctttgtggaagattccgtgatttctctaataagggaatctagtctattctcaacatagattcctactttcttaaaataggatgctagaagctagcaagatgctgtttgattcaggagccccacctgccagagctagcctcaggctgcactgtgaatgagccacttgtgtttccacccgtccgccctgcttttcggaacccgcttccttcatcatgtctttgcgtcactgccttttcactccatcctgcctctcagtaacatcagtgaaggctctgatatctcacttttaccaccatttaagttcacttcatttgtccacttcttgcttcttccaagggtgtttgcacttgaagctttttgtccccactgtgtataggaagctttgccttccctgaaaggtttgaccaactcagaggagtggagggagaagggatgagggggcagcacaggacggggagtggtagggacagggctgtccctggaaacacacagtcctcctcagtgactgcacggctcattgcacctcattcctgggttgctgtacagatcagagtctacctcacctcaaaagccccacagtatttgttaaatgtctgggggattccagatacttaacaaataatctttcaatgtggtcgacttatttagggaacaaacacaaaaagactcacacaaaaggcatgggagtcaaatgctctttgggatacttgactggagagggctttctacttacacgtgcctagggaaatagtcaaaggatgaggggggttggtatgatttagggacagttcctagaaggagatacttactcctgaatgtgctctgcttaaaaaaaaaaaaaaaaaaaaaaaaaagaagaagaaaagaaaagaaattgtgttgggcgtaaccacagccttcttagccagcctgagttggcattgctcaccctctgaggattaggtcagccacagtgagctttctcaaggaagtggtgccttggggagcccgcgttggaaagcaatagcagatggctgccgtgggatgtatatggtcctgcttttttaatatgtggagaaaagagacctgcgctctctgtatgttcacatatatcaggatcattatatgttaattgcttattatggcaactgatgatttgcctcctgtttcttatgtgttctgtcagttaacatttattgggcacctactatatgtcgatagaatctgcacagtggcaggtaaagttttccctgtctttaaagagctcaagtctgataagaatgacaactcatgaataattgcaatctaggatggagaaacgggggaattctcccttagaattatatccccctcattgacttcacactaaattcgactttttaaattcagcagtgattatctaaagcctgagctgttcagattgttaaataacagtactctaagttaatctacaagaatcttaattaaagaagtgaatttgggtatgttcaaattataactcagctgaaaaacagtttctctactatgcattcccctcaccaatcccacttcccaaataaactgactgaggtgggataaaagggtccagactagaggatggcaaactccagccccaaggtcaagttacacctgccacctgtttctataaatagttctcctggaacacagaaatgcccactcatttacataatgtctatcatctgtggctgctttcaagctacaaggcagaggtgagcagctgggacagaggttgtgtgtggccagcaaagcctaaaatatttactttttgtatcacaggaaaaaaaaattgccaacccttggtctagagtaaactgaacacccataaaaagtaaaaacaacattattcaccacctctgactggcaaaatgacttaagaaccagcacactggtacattttaatagcagttaaatctagacacatttggatttaaattgaaatccaatatcctcctcttcatgatgaagtattaacatggttagctagctaagaaatatttgaccctcacgtacttaaaatatctcttgttttggtgtttgtgtacacaaattagggaatacaaattatgttcatgaagtaagtcatcttcaccaacggaaagaaatattctccaaatcgctgagaccatgcatcaaccctactgcacagttagaagaagggccacattaattacccgaggatacagaatctcttaggaagaggagtggccacagagaacaagagcatatatagtgcatttcagagaagtttctcctgccctccagattcccctgtggacctactctgagtccattctgcaagggggcatttctgcatttgagcagctcccgttcttacccattacacatccctgtgtatagggggcttcaggaagaacttacacaaccaatcgatggcctcagtttaatataacatttaaaaatatctcgctctcctgattctgtagccaaactcagaatcatcaaggccacttcctctcccaggagagtaagcaaacttactgcccagatgtcccccaaagtgtctttgccttcaactttgctgcaggctggaaaggctgtttctctacaaggactggagatgcaaacccttggaggggagggtcctggggagggcaggcacgtgttaaaaagggcagtagatgaaagcaaatgtggctgcaattgtccgcttctgcttgaacagcaagtctgtcccatgctataacagggattctgtaggatggatcctgttttttgttttgttttgttttgttttttgaggcggagtctcgctctgtcgcccaggctggagtgcagtggcgccatctctgctcactgcaagctccgcaggagaatggttcacgccattctcctgcctcagcctcctgaatagctgagactacaggcgcccgccaccacacccggctaattttttgtattttttagtggagacagggtttcaccgtgttagccaggatggtctcgatctcctgacctcatgatctgcccgcctcggcctcccaaagtgctgggattataggcgtgagccactgcaccctgccctgatcctgttttttagagaaagtagattgttaatccgtcactttatgtattgtctctaagatagcatctatcatgtatataggcacaaatgcatactggagtgaattcataaattaatagatgaattaagacctcagactctggagacaagcaaaattgagtttaaatcccatctttgccagttaatagctgttagttatctatcgctgtataacaaattgtcccaaatttagtggcttaagttattatctcacagcactgtgggtaaaggatctgggtttggctttgctgggtaccaaggctgcagtcatctcaaagcttggccaggtggggaaggacctgctttcaagctcacacatgtggttgttggctggcctcaaatccgtcatggctgttggctgacctcaaatccatcatggctgttggctagagacatcagttccttgccacctgggcctctccaaagggctgctcacaacatggtggctggcttcccccagagaggggaatctgagagaaagatccaagatggaagctacagtgtttttgttttcactgggaatgtgggcaaggcattgaaaaagatttttgtgtgagtgataaaatatacacaacattatttgctattgtaacctttctttctttctttttttttttttttttttttgagacagagtcatgctgtgtcacccaggctggagtgcagtgatacttccttggctcactgcaacctccacctctcgagttcaagagattcttctgcctcagcctcccaagtagctgggactataagtgtgcaccaccacacctggctaattttttgtatttttagtagacggggttttgccatgttggccaggctggtctcaaactcctgacctccagtgatctgcccacctcggcctcccaaagtgctggggttacaggcatgagccaccacacctggcctattgtaaccacttttaggtgtgcaattaggtggcattaagtatattcactgtgttttacaaccatcaccactatttatttctaaaacttttcatcaccccaaacagaaacttgaagctacagtgtttttgcaacctaatctcagaagcaacataccaccattctgttatattctgtttcttggaagcaagtcaccaaacatagcccacaattccagggggagggtatcttgaaggacaagaagaccaggaggaagacatcctagaaggcagtcccagaagctgcctgccatacaggctatgtgaccttaggcaggtagtaacctgcctcagtttcaacctttgtaaaacaaggatgatatcttagtctgttcaggctgctataacaaaataccataaactgggtggcttatggacaacaggattttatgtctcacagttctagaggctggaaagtccaaaggcaaggcagagtctgtctggtgagggcctgcatcctcacaggtggcaccttcttgctgtgtcttcacatgatgaaaggggcaaggggtctctctcaggcttctttttaagggcacttatttcattcatgagggctctgttcccatgagctaatcacctcccaaaagccctacctcctaatgccatggcctaggggttaggatttcaacatatgaatttcggagggacagaaacattcagacctagcagatgattttgcctgcctcatagtgctgtacttatatccagggggagcacccccaagtttctactctttaatataagattaaatagatggccccaagccatgatgtttggccaccatggactccaggcagggttttcctgcacggcttctcagatcttcatggtgcttcagcagagatcacatctttagatctctgacagcatgagcagatagagggcagagcagaggcagaactgtggcaatacaaaatatgattcctacatcttcttcccagtacaatctttatggggagcagagcttcctgtaaggaaggagaagcctcccctggacagtgttgagctcccatgtcctcatcatatctcctctgggagtggatccacccctccctcagttgctcacattcaccaccaagatactatccttgtacccattatggtttattctctttcttccatgcacattcccagtatcactttaatgtgtccgccctctttcctggtgagctgtcctgtgcagtgaataagaaacagttacttcccctggagggcttgcatatgactatgcaacgtgcaagcaggctgcttttaaaactattatttaaaatttttcaaaatggtagtatctctttccatccttgtcccctctcacaggtcaaacctaaacaattcagggtctcattccaaacaccagctcatggatgtgttctgagccatcatatattccagccatatctttatacttctgtggtcctgtggaatagtaccaatccagatccttaattagctgaaaattaattcagatgattgcatatttaagccaaagaaataaattaatattgtgtgcaaaggtttctggtgatgagtattttggaaggactgttaaacacatttgaaataaaaatagtttactggctaaggctcagaaaaaaacaaaaattattactgatcagtgttttctaaagtgtgttctgcagaccgaaatgctgtttatttgcccactgaccaaaattacattgataatctgtactaatctcatcagggttgatgagaatatggtaaaacagtcatggactgttttctgctgggagtataaattggacatgcctctaggcaagcaattttgtactatttatcagaatttaaaatgtatatgccctttggcccagcaactctacttctagaagttaatcttaaatcattcttgcacatatatacaaggggctttattgcagtactgttcatagtaagaaaacgttggaaacaacttaaatgtatgtctataatagaccaggtaaatcaattataatatgcctctactcttgaatattgtacaacagtcaaaataatgagcaggcttggtacaggggcttatgcctgtaatcccagaacttcgggaggccaagatgggaggatcttttgaggccaggagttcaagaccagcctggtcaacacagtgagacccccatctctaaaaaaataaacagcccacctgtatgtattcacatggaaagatggacatagtattttgttacctggaagaagcaagtcgtagagcaatattttaatataattacttctataggaaaagatatatacatatggtattatatatataatttctgtgtgtatgcacaatattgtgtgtgtgtgtcacacacacacagcatgttttcatgctgctaatacctgagactgggcaatttacaaaagaaagaggtttaattgaacttacagttccacatcgctggggaggcctcacagtcatggcgggaggaaaggaggagcaagtcacttcttacatggatggcagcaggcagaaaaagagagtttgtccagggaaacacccatttttaaaaccattagatctcatgagactcattcgctatcatgagaacaatgcaggaaagacccatcccataattcaatcatctcccactgggttcctcccatgacacttgggaattgtaggagttacaattcaagatgagatttgagtggggacacagccaaaccatgtcatatatgtatatatataaaatacatgtacaaccacatagatttgtttggaaggatacacaccaaactgttaatagtggttattcttcctcttgagaaagaaatagaattttctagagggtaggagggttgcttcctgctttgctgtgtatccttgcatattgtttgaattttttataattagtatacattgcttctgtaatttatgaaacaatttaaacatctcttaaactcatagacataacatatttatttttaagcaaattaagaaaaagaaccatgtaatctctctgcccaaatgtaattactattaatcttccatacctttttctatagatgtattgtttgtttttaaaaaatgtaatttttccatttagaccattttgtaatctgctgcttttatttcacaatatgggataaatgtgattattccctgcatatttatgtgccagtagatattcagttatatttctaatgacttcaatgttatggtttttaggtatatgagattactggaaactaggcatttgaaatgggcaaggtaaattcctagtgcaatatcctgttacctggcttcttgctttcatcttgttcatccgtacatctagattgtccaccctttatgcctaatctctgtcattgtcttgaataaaattttccatggctgcccattgccctcaagataaatttctagtttccttagatagattgcaaggcccctcactttccagttcatgtttcctctggcacatctttggccaacacctttatcttcaactcccatcaacagctcacctcacccaggcttattctcactctgccttccggtttcagctccaatgactccatttctgattcagttacttctctgtttctcagagcatcttccacttcttccatctcttgtttttgccacccaataggcactctcccttttcctgacaaaacagttcattgtgtgtgagagacttcgggcaaggttattaagctgtccacgcttcaggcttatcatgattcatcatctattaataggacaataatagtaccgacctcctgagattgttaattggaggaagtgaatgaatatctctcagtggattagaagtgcctggggcataataagggctctatgtgtttgaggctgcagttgctgtaattggaatcatctctcttttactcagtccacctagtttggttgaagttggttctaccctctgctctaggggttgctaaggtaatcagtaaatctcatccttctagatcctgtgatgggttcagaagagaacacaaaacccgatttgagccagtgagagtcactatgaagactttactttctgaaggagagaaactctctatctctaggcatgtgcataatgcatgctaggcttactgctattggagctgagacattgcagatggaagcccatcagagcatggaaccaacacagagggaaacacagctgagcaaagagagagaagtcctgtcctggtgatactgggatgagcctttcatgaagcgatgcctgaccagctcttcctccaattcctcagtcgtttgagccaaaatacttccttgttgcttaaaccactaagggttaggttttctgtcacttacaacccagagtttcaagagatatataccatgtcttaccaacatcataccttagtataatggtctttctattgatctctctgctgcatgagaccttaaggtctgtgaggacaggcctgggtcctatttccctttgtatctccagcttccaacatagtgcttgactatattagatgcaagtatttgttgaatgaaaaaatgtctcagaggctaccttgactatttcagcataacttgttcaatgctactggtttatccaggtctaaaagtctgctaatcgtatcagcaaggcataataggatgggaaaagaattaatattattgaatgcctgtcagtaactaggtaatgtatatgatactttacatcatgtcttttaatcagaaagcataattgctttctcccttcctgctatcccatgataggtctattactatacttccaagtcagtaaaataagaataatgaaataagaatatcaatgaaataagaatatcaatgaaataagaacaaaagtcagatgtggtggcacacacctgtaatcccagaactttgggaggctaaggcaggtggattgcttgagctcaggagttcaagatcagcctggacaaaggtgaaaacccatttctacaaaaattagctgggtatggtggcacacgactgtggtcccagatacttgggaggctgaggtgggaggattgcttgagcctagaaggttaaggctgcagtgagctatgattgtgccactgcactccagcctaggtgacagagtgagaccctatctcaaaatatataatatatgcgtacgtttagtatctaacaagaaaaatgaaaggcagataaaaagtatacatattctattctttaaaaggcaataatcatttgaatcttttgagttcaaaatgctgtgttttataaatttataaatgtgtctataaatttttctttctatttcttctacttcttcttagcattgaagtgagcaattttattaaaatctgccattttggtagtaaaacatttaaattcaaagtcaccttaagtgagtgatgtgcttgttgccagccacttaattagctgggggatgtgacacagttgtctacatgcaggacaatttcaaggtcactggtggaaaccctctcacctccccatgctgccagcttattgtcccatacatggtaacattcagatttgggactagatggccaggagaaaagcactgagtagcctcactccagaaggattttttgtgcttggctccctgacttctcctttcgttcagggagcatgcagtggtgagaacacctaaatcatgatccttgtcctccatctataactaattcgtattgttttaggttagtttctcagagcataagaatgaagactgtagtatggcccggctctttcttaagaaagcactcttgatgaaacaatctacataagtagactgaccagttaaatatggttattaatcattcagttttatctgcgtaatggtcttatcaaaactaattattgccatattaggtagatatttagagagcacccttttatggaccaaactctttgcagaatacagatactcaggaagaggatctcttgtcttgaaggagctgaaaattgagttgagttatcccagaatcgcttttttcctttagagttggaattttgacagatggagaaaattatctaataaagtgttcaaaaacttggttggcccgtgtgggttgaggattaatccgttagagccacaggcagattgagcacactattcttagctcagaagaagcaagttattcagagaaggatgagagatggcacattccctctagttcctttttgctgctagagaggtgagcttccaggggctcctagttcaggttgcttgtatttttttcacctacatttggtctccacaagccttcctttcatcgtcagatttgtccaaaatttaacacctgtgtgtgtctaatcaaggaaggacatgatatcacattatgagtgtatttaggtgagaagtcattgaggaaaataatgtttgtcatttgaaagaaagaagagtgttttatttttgagtcacttcaggtctttgtcctgaagaacagattcactcttgtttaaactctgtctcagtgagaatgtttgcggggatgggaggtagcacttcccattgcatctaatcatctagaaaacaagagactacaccttaacagtgcaaatccttttggaattgatctacctggtcttctgctttttcctttctccactctgctttgtcctgaattcccagaaatgccatcttaaaactcttctaaaactgctggctactctttcccctgtttttttctaccagtttttttgtttttgtttttgtttttttttaaaccatcatataaagagacagcttccaaatggtactctgtaattgagcaataaacaacaaacttttgtctgtatgtatccatactaccagtcaaaatacttaataacaaaatatcaataaaaaatggccaatgtgacatttttcatcttgtgtcaaaatcagaaccctttgttttaccatttgcttttaaatctggggggtacataaattcctgagaaaatactaagcatatacatcaaagaaattcagacaaatatatgtgaacagagcaggtcactgacactaatcttggccataacctagagttattcagaaaagatgtccagagacaaatcttggaggttttgaagaatcagaaagataagaggaaaatctggatacagaggtatcacagaagccaaggaaagtgttttaaaaaggaagacgaggtcaacagtgtcaggtgcagctaaaatattaagtataaagaggactgaaaaatatgtcttgaatttagagacttgaaggttattagtgaccttaacaagcattgtttttggggagttatgcagctagaagtcaaactggtaggttgaggaaggagtggaagctaaggcagttgagctgtgggtacggacacttccttcagattagctgtaaagacagtagtaatagaacagtggctgtaggaggataggggactgaggactaggaaataatttattttagatgggagatatttgaataggttcaaagcttattggaaggattcagctgaagacagaagtccggtaacaagagagaaaatataatagaatagataatgttaagttcccaagatccacaatgacccccaaacgtaagaatcatcttagaatagacttgggatacgaagttcaactgcaaaataccctatttttagacagcctccgaatttaggaaaccatgtccagcccagaggaaaaaagaagagggctgagttactattttctccatgtttgattctaaggaatgtagcattatttggatattacataaaaccttggaaaataagggaaggggcaggccgtgaagatatgtgcaattaaaattagaaactagacatggccagtaaattgattacaagttaatctagctttgccataacctgagagaggtgatgtagtcaggaagttaggttttatctcaggttggctttctaaatattgaaagctgtcaccaaagaaactagcatagaaccagtacgttacctgggggagagcacctagagccacagatgttggtgtgcctgagaaagtccagaattttaaaaataaaattagaatagctgtgaccggcagtaccctccagactcctcaattgcacacagctccctttgtgtccattttgaggactcagcaccaagacttctaagacatgaagcactgggcaatgctttggggacatgacaatgctaattatgctaaatactcatgatatgttgtctaatattgatattgataacctaagcaaagacttactttagctaagctgaccttgctgaattgcctgtgttagctgccaacaatgtcaacagagaggagagtaatggtcaaactggaggcagatagtgttatgatttatgaggggccatgaaggcagtgtttttgtccatgggagctgtgattagatgctgtgggtagctgaatacagttgagatttttcaaaaattggcaggcatgttactttggaagttctccagtgacacatcagagatttaattattacagttttgtattcttgctttctgtgacatctctcccctttgtgcttaatcaatgtttgtttcccagtatgtgtttgtcactattattaattttggaagatacaaggaaatccccaaatcagtaaatgccctctaggagtgattctctagtcttgtagttggacacaaacccacaacataacctcctttgtaggctcatgcaagaggaaaggaattcagcatagtgatggagtaggcccagttccaaggatgccactgggtatcctgtacatccagagaggaacagggcaacttcctgactcttttacgtcactttctgaaaggaaagggaacgtttcaaagtaggaccatgcacagatacctgaccacctatccctttttaaagtcccacctgtcaagtctctacaccagttgtattgcattacctgggtaaaggagtcaagtgggaaggggtggagggtagtcccaagctaatgagaccagcattcccctgggttattttatagtttatcttattaatcctagaagcttgactatgaggcctgtgttaggaggtttctccttggggaaagataatcttaccaacatctttgggctgttttcctaattcttaacactactcctgtatatttcaaactgggagctatgaaatagacaggtttgcctctcgagactttctatgaaagcttttttgatgttactcctgggagcttctcagtgggccaggaaagaggccccaaagccacactgtatactaggctaagtcaccacatgacgtatgtaagattcacagaggatcctcttgttcacctatgacgaggccagacacaggccctccaaactccctttctctgtctcataaatgattagctgaacgtttacccccctgtgatcaatctggacaaaatacttactaatttgatttgaccgctgtagtgaagcttgtctcctcctccacagcctgtaaactttgactcattcctgaagctaagcaagtgttggaactgggaacaacccctccttaatggcccttcctgagactctccattggctgcaaacaaatctttcttgttcagctgtcacatcatcccacgtgtgcatcccccatgcctagctccttctagccatgtttattcctcttcattaaaagagaagccctttcagcctgaccatctggatgtttatagatcttatggtcagagtcttttccctattgcaaaaatgatcctgtccatttggcgtattctttaaaagtaaagtctgtccttacctaagtctaggtttgtttttatttgacactactctctatattttggtatttaatactgtgtacattgaacacgatcttttcttgatgacctagcttcatctttaagactattatcacattgtgctgaagaggtagttgtcagtgaggccaattctgggtgggatattggctgacctggcactaatgctggagccaacttatttctgggatagagcagctacttttgttttatgcattttgagttacattaaactcatttggatagagtataatggtgacctttcacttggccagaagaaaaaaaactacactgtttattttcttatttttttttttttttttcactggggtctcactctgtcacccaggctggagagcagtgggtgcaacctcggctcactgcagcctctgcttcctgggctcaagcgatcctcccacctcagcctcttgagtagctgggaccaaaggcacgtgccaccatgcccagctgattttttgcatttttgatggagatggagtttcaccatactgacactgttttaaaaataatcctagaattcgtaactttctagcgtgtgtatgtataaattacaatctgttatgtttagaaattaacaagaatcaaataatgaagctaattttccaaaacgtgattgagctacaatgcaggcgtctgaccatcttatttttagcccccaaggcatgcaaatgttagaagaaaaagaatctttaaaattgcaattgatagtaaaattgcttaattatatgtataatatgtggaagaatatgtatatacagccatttatcaaaaaagaggtcaggaaagttgggtgcagtgtcacacacctgtggtcttagctacttgggaggctgaggtaggagaattgcttgagcccaggagtttgagtccagcctgagcaacatagtgagacactgtctcttaaaaaaacatggggagtagggtaaggaaagaaccaggtaaggatggaagaaaaccatccagccatgaggacttacagagcaatatgatagagaaattattctcatttcttaatataaataagaaaaatgagatttgaagatttgcaatttgcataaatttacctgacttgtaagtgccagaaccagagttagaactctgttattctattttctggtctatgactgtcatcaggacactgtgaagcctttcctttagtgagttccaggtaacacagaccagaaaacagtcctaattgtattcgttgttgttcatgtcactgtcagactctacaacttgttgcttccattactgatttcaataccaggggctgctatccactcttctcttcctccttttctaggaagccttactgttcaaatgtgtaaaaactcattcttgacttccagccaatcagccagagacatgaccttcatgcagaccatcatctctttgaggctgtgtctatttctgagtgcttggaggctgctgctttgctgacggggtagagatagaaagaaagggactgtttctctgtttctccctgttagaaatgcttgttgcccagtgccataaagaaatagcacttgaacataaatttaatttcctcagcaaggccattttttttactttctgcagaaagggtacactcaccagcagttttgccatgaaagtacaccaaacaaaagaggcagggtcatttataacctgatgcgtccaccctactgctgtgtcccgtttccattggctggaacgggacctcacattctgtatttgtcctgattggctagcaacttagaactttttaaaagaggcaaaggcagaggagaacaaaggaaggaggaagtaacttgtggaatgccgagaaaggtaaaaacaccttcaaataaggaagaggaacaggctaagacctaatgcttgcttggaccagtgtaagcatgccagggcaaatatttaggctaaattgtgggagctaagaacataaagtacattgatttctttattatggctagcagatatttaagaatgttagcacaggtctttgaataatttttgcttctaagagaagttactatttattcctaattagatggggaggaaagtctttgaagaggaacccctactttattttctatactccctcaccttcctaggtcgtctgaaggtttcctgaggttctggaaaacggaaagtatcctaaatacttaaatagtattatatgctaccaattaattgtccactctatcatctaaagatctcacgacaaacagtatatggaagtatatgtttcaccttattctgtaggtccaaattctcttttgagaattatgtggacttcagagctagtttgtttcatggaggtagctagtttgtttcattgacatgctgcatgcctcacttggtaaggctcaggcctcgtccagagcagggtatagcctttggtctagccaaccttgctggatgttgtaaagtattttagctattggattatgctttctataaatgtaaagatgtcacgggacctcaggtgtattcatgcaggctttgccatttatcctagctccaattagttaccgcaggtacagcaaaacaaatgtaaggcaccgcaccaacacgaggaattatcagtcttgttactaagaggacagaggaatccctaccatgtagggtaaatttctttctaggccctttaaatgtgaaatgtaataaggcaatttaaagatcatttcactaacatgtaaaggaaaatacaaacatgtgcacatctaattgcaggtcttacaattttggttctaaggaaaataattaacataagctcaaaatgacacttcctgcctgggaacagttctggcgaaataatgaacctgtagaaataaaattgaagagctaatcagccttgaacggcgctgaggtgtgtgtttctctctctctggttgctgttcatctcttgcttgtctctctgctttcccctatgcctttgatgagacacataatttttatgttgggcgacaaggtgacagttctctctgataattacatagatgagaatatatttggttttggaggaaaaaaatttactttacaaatgtatatatagaaataactttgaccttttggtaaagataaccaagttcttcctcagcaacagaaaaacaggcacattcggaggtgtgtgtttcattttatagtggtagctcctcctaataaaaacctttgtaaggaaaaggacaaagttgttggttcagggggctagcggtagaccccttctcctaacagctcaaagataaggtaaatcaaagtgccccccaagagttaaatgagagaaaacccacatgcagtggatagcattagccgtctgtggtgggaaaggaacagattgtcaatgaatgcatggttaaagagtttgagaacacccaaaactttaatcaaggtgatatgggagcaatctcatgaaagtagaatgggaggatggttgcatttagccattacaacctcatcagttgcattcccacaggaagactgcctggatattaagatgatgtcatcacagagctgggattctcacagtgtggtaagaagacctctagcatgagaatctcctgtaaaaatgcacatcctagggctttactgcatagacaccaaaaatatttggagtgggctcaaagaatctgcattttgtttatattcaactgaattttcttttttatagtttttttctaatttaaaaaaaagtaacacaatatgggctcattgtaaccaggaatgcaaatatgaggaaaggaaaagtaaatcttggttgatccttctttttctcttaccctgaggtagcaatactagtagcagttgttactagcaacaatactggtgagcatgagcatccttccatgccatttttcacacttacaaacatatatacatttttaagaggttttattttttgcttctcttgtttgtttttatatactaggtcatattataaaatttggagatttacttttctcaagtcataatgccaaacactccaggtattttaaaaatgtatgtacatctatatatgtattcacacacatttacacatatacatacaaacacccacatacatatgtgtgtcaggttgcttgaaaatgcagcttaaaacccatttagggctaaatactggcacagtagtccagtatcataaggaaaagttgaaaaaaactttgaagaatgacattcttttaaattctatagttttctatggaatggattattaagatattcaagcgtgtcccataggtgaacattcaggttgttttctattgttgctgcatgtgttttatttcattgccattacaaatgcctttattttggggatgatagatgagcagaaatgggatttccgagtcaaaggctatgttcattttaaattctattagtattataatatgactttcctaaaagcttgaggtaaattacagttgattatcatgattccacttagttatgtcctataaaatcaccttgagcactgaagtagcagacactgactcactgtgttaatgtattaatatgttgtatcaatatattaatattgaattaatatgttgtatcagtatattaatattgaattaatatgctgtatcagtatattaatattaaattaatatgttgtatcagtatattagttattaactctggaggaaatacagggttaggtttctgcaagctccttgtcacacatttttcaacccatcaatacataaccttgttttacatgtgtttctgtttaaatacatcttatttatttatttatttatttgagatggagtctctctctgtcaccaggctgtagtgcagtggcacgatcttagctcactgcaacctctacctcctggattcaagtgattctcctgtctcagcctcccaagtagctgggactacaggtgcacaccaccatgcccagctaatttttgtatttttagtagagatggggtttcacgatgttgtgcaggatgatcttgatctcttgacctcatgatccacccaccttggccttccaaagtgctgggattacaagcgtgagccactactcccagtcagcttatttattacatattattgataacctagcattgaactcatggccagcaatatgtcccatgcctgaacaatgcttatctaacacatggactttctctatcaggcactttacagactaaagtgcctttactaaagtctgtaaagtgcattatggagaaagtccatgtgttagataaggattcagccctgtgcagaaaatgtggcattaaattgaccaccaaaaggatactaatttacattatgagggtgaaacaagaaaggagaatgtcatcttgttctgcctggactgggaacatgcatgctgggtgaccacactgcacgtgaccatgaatgaccacaaatgatctccaaagtgccacaagtattggctttggggttacaaatacatttgagagtgtaggcaaatttgtgaatacagaatccacaaataataaggattgactgtatattcccaccagcaaagtgtttgtcatgttgattattcttcgtcttcactgtttcattttttaaaatatttgtgaaattttaggggaaaactatttcctcgttgccaactaactagtgaagttcagcctattttcttaatttattacacatttaaatgcaatctttgataacttacctgttattatattttgccctttttccaaccaagtgacttaatttttttctcatcaattcttagaaactgtatattagggatatcaatactttgttatatgttatgtaaatacttttttattctattgcttgtcttatttttgttttgggtatctttgctatatgttttaatactcaaatatatcaaccttcctcttgtgatttaaggtctcctgtcttattgtatctccaagactacatagaatttcacatttttattccaatatttttattgttacatattttgcattaaaatcttgactccatccagaatgtttttgtttctagtgttaggcaggggtctatgttcattttttttcttccagacgaacattcctcagttgttccaaataggaagagaggaaatcaacctctccatgtttgcagatagtacgattctctgcctggaaaaccccattgtctctgcccaaaagctccctgatctgatacacaacttcagcaaagtttcaggacacaaaatcagtgaacaaaaatcagtagcattcctatataacaacattcaagctaagagcaaaatcaagaatgcaatcccattcataatcgctacaaaaagaataaaatatctaggaatacagctaaccaaggaggtgaaagacctttacaatgagaattacagaacactgctaaaagaaatcagagatgacagcaaattgaaaaacattccacatgaattttttttttcccatctgaattgttcctggatctacattatccatgcctggtttccaggccctctcagagattctgtaaactacttatatcctttattgatccttttctacttagcctggataaagtagattatgattttgcaactaagagtagtaattggtgctggaaatatttgtacctaatggactgtcaagtaaatgggaacctggggttagctatttaacatagttgagtttgaaggcatgtggagcaaaacatttccgtaaatattggctttggttaattggagtgaagtgcctactgaaggcagcattttgggaaactcaagtggctgcttccgtatagtattttaagaaacgtggctgtactggctacatggaattgtgctaaaaatcttaaggaaagaaaaataaaacaggctcaaggttttaaattattgcctcaatgtagtctcagaaaacaagagaagttttgactggcctaaaagaatatcgtcttttatagcaacaaggttgatgaacttgaacatcaaacatatgctctgattctgtgacttattgaattacaggctgcattgaaagattggctgtgtttcttaagtgaaatttaggacattgggaagaaaagaatgggaccctgagaattagagtagagacatttgggaggattcagatgactcacactcccaacctccctaaatcctccttatcagcagcagcagcccttatcctctgaaggacacaaacctgtctgaagaccttagaaagaccttgcctagcttctaagaggatgccagttcctcatcactcactcctatcttattacctctacttatctatttgaagtcagatcccagtgtgtcccagagatttaatcataaagtcacaccttgggagaaatatatttcttctactactgccactgctattgcaattttttacataccaaaaaatcacaagattttgcaatttatgtctacaaaatttgcataaagttatccattgctcatcctaattttcttcctaactaaaagggacatctgtttttgcaatggctctagtagaatactacatttcccaagcttcctaatatctaggggtggccgtgggacctagtcaatgagacataagtttaattgtactgattattcctaaaaaaaagttttggtatcctaagaactgctcttccttcttctgcattcttccttactgcgtgggcttggtcacaatttctggaactatagaggtcatcttgcactcatcagggaaaggccagaagaattgctaggacttccaatctgacatttttaaacccctgaacaagtgacgacaatcacttttactttttttttctgtaattaatggaagggaaacaaacctaattgatacattcagccaaacacaatcatcagcagtgatgatgcaaaaatgtagcaaagacatagaaagcacctattttccccttgaaaaagtgaaaattcttgagtttcactgattttgctaatttagatcccataccaacactttattcaattagtttggccagagagtcgctgtgtgctagttggcttaggccagtagggccctccctgggagctggggtcaatcccattaaccccacttgtttgcagctccatgggaagaagtgctaagaagaaaaaaggagatgtttggatgtgaaataggtgagtaacatgtccacttcatccctattgtgaatatgtcattaaaatttactactcttattccactttcatggtcactgaacaatctgctggttggatttgacttctcatgtaatttataagagggatatgaactaatcaactaatactagcattgtgatctgattgctggtttagttaatacatttacatagacgattttatgaatcagcatctctgtctgagcttagttaatgtaagtactccacccccacctccaagagatctgctctgcctgtgatgacaagccaggtcttgagtctgtaaggatgttcagggccagatcccagaacagggaattctccaggtaaatggcatcctgcccactcactgcctggggaactgcctttgctgtactttttagcttctccttgaacccttgaaactgttgtagatgtcatgagtgttatttttcttcatgtaagatttcagcagtagcatgtgccctgtctccaggagtaccaaagataccatgcagggtgggacagagccagttcccatcttcctggagtcaacatgattctagaaccttcaccactatagattgtcatcacttcgattccatttaagagtgctgtggcagatgtaactagaatgataccaattgcagaaatgcagggtgagcttgcaaaacaaaaagtcattgattctgtaacccataggctaccaagtgtcatgcaaaacatctggggtatagttaacttgccaatatttattgagtacaataagatgtacatctgactaatagagatgttattagtaatactcaataggataaagagagttctggatgggaagatagaagctacactgctaagtgctaattttctttactatggatgcctccatgagcaaatcacttcaattgaacggccttcaagtttttcacctccaaaactgaatactgtactcacaatagttaaatatttcctgagcagttttatttatctcattaatttactttaaaaggcctttcttcgtatcacaaactccaactggattgtggtttctgagcaaattataacaaattttgtgtttgtggaatccaaattaatgagatttaactgcatgctaattaaaacgccttagaattctgcaaagactttcccttcaagagttcaaatttgttgatgaaattttctcgttagacttcacaatgagtgtggaaaacaaatgatcagtctgtaagccctaaaaaaagaaaaactttaagatattcttcccaggttttaataacacaacctggcagcaatggaacaacctcacaaacctggccttaaggttatcttgcaggttaactccctctcttaaagagattcttgtaatgatttaaaaccaaatggcgacgtagcattgaggttcaattagcggattccttagttgggtcttgatcacatctctgattgtcacctctaatagggcgtattaaaatttccattcattatagtcattagtctctgccagtgataaggttgtgaacaaatctgttggtgttcaacttctaatttgtgtgataatttgtttatgcttagaacacttactggttgtggatggagggggtgtgacccatttagaaactattcatgtagataaatctggaaagtttgcctggaatggctaaggcatggtgatgccacctagtctagtaatagacaagggccacttagaaggtcagatgagtcttattccagagtcaggaagagaagtggtttacccagagatgcaatggggttgcttcaaatgatccagaagggggtttttgcatggaaagaaaggttccattcggtcattgttactctacaaatggggagaaaagcacctgcatcagaatcatctgagaagcttattataaaggtaagctcttgggctacactccagacctctggggctagggccctggaatctgtgtggttagtaagcaccccagattacgcctaggcgtgctgaaattgagaaccactgcaggagacacctgagagcagagacacagaaacaaattaggtatagcaaagacatcaaaacattttgtagtaaagtattgagaaaccattcaacttgcatttatcattgggatttttgccgtcaacagctgaaatacaatatttaagaggaagaaaatttcaaatttgcaacaagccataagaaatggggcttggcaaagtgtcttactcctgtaatcccaacacgttgggaggccaaggtgggcagattgcttgagctcaggagttcaaaaccagcctgggcaacatggtgaaaccccatctctacaaaaaagtgcaaaaattagccaggtgtggtggcatgcacccagtctcagctactcaagaggttgaggtgggaggatggcttgagccctggagggagaggttctcgtgggcaagatggtgctgttgcactccagcctgggtgacacagccagaccctatctcaaaaaaaagaagaagaagaaaaagaaatggtttgggtgtgggtttttttttttatatactttagaggctttcaggttttttcttgctctgtgtggtcttattgagttatttgtgtttgagtttggtacataaaataattttagtacttcttattatatatacaagaatcatggatatgctcaactttatgtctcctatgcctgaaaagttgtgcaccaataactcataagtttttttaggacactgtacactttgtgaatctgatgaaaggcgtggaacttgattcccacaaatgtgtgtgcatcagtatataaagcattacatttaatctctggggacttagagatcagtgctctctctggactctacatcaagagcctctgacctgagcctaaaccacccagcctgctgcttcacaaagtcaagtagctccacctatgactcagccatagcaagcagggaaaggccatggtttgtgtgggaaaaatggatgaaagcaaaactgaggaattcagcagtcctcgaggcctcgactcacacctttaaatctgttggaattgccacaaaaatatttgttttcctacaagaatattagagatttacccatcttgagtggcaagcctagatgccccattcactcatcaaggcctgatgccatatttagcaaaagagccataactgaaggtgcgtttgatgaatttaataggattatgtcttactaatgacattaggctcctgggtcgggcttagcctttatatttacgttttatcactgcaaatgaagatgatattctctggcatatgagttttgcaacctcagggttagtcttgtgatatgtgaagtggcccttggcttgttttgggcccattataaattagatttttaaaaaaacattcactgtgtttattttttattttatttttgagacagggcctcatgctgtcacccaggcaagagtgcagtgatgcaatcacagccctctgcagactcaacttccctgggctcaggtgatcctcctacctcagcctcctgggtaactggggctacaggcatgcatcaccatgcctggctaatttttttggtattaattttgtagaaatgggttttcatcatgttgcccaggctggtcttgaactcctgggctcaagtgatctgcctgcctcagactcctaaagtgtcaggattacaggcatgagccaccacgcccagccaaaaaccattcgctttaggaaaaagaaaaatcaaacttcctataataccaccaccaaagatacctaacgttaataatatagcatgtattcctctagcaaaaattctatgctttttgcaaaaatagggtcatactatatttagtgtaatcaaatctggcttcttcacttatatcttaaatatctatttcaataagttccatctatcatgttcactggctgctaatattctccaatatttatgtatactttaagggtcaactaatagatgcttcagctcattccataaatgagatttttctaacatctttctatgcttatagccattaacatttgggatttttgctgctgttatggttaattttggagtctctgaagaaacaggtgctttgtagcatccagttttcttgcttaaaaggaaattcctcagagtttaagggtgtttagatgtaattttcacttttcactttgttctggaaaactaagaataaataaaaatccaaatctatagcccatgtccacccactcctttgaaagtaatcaacctcagtctctgaaatttcaaaggaaaaaactgaaaataccactgaaatcatttttaattagacatttagcagttcctaaagcaagttataatttggccttcaaaagcagtatttttaaagaagggagcattttaattggtatgttctggcttagcatattttctcagacattaaaattttaaaatctagatgtcatatcaaagtatatgagatgaaaaatatgatttcttctatctaactagctaaactgtggcacataactggacgtgtctatatggatggatctctgggagaaaagaaaaacttttctattagctatggcttgatatatctgggggcccagagctgccaattttatatcatgcatatgctgtgtagtatctcctactcaaagtgtggtccacggaccagtggcatcaatatcaactgggaacttgtcagataaatagaaccatgaatcccagcccacatatcctgaatcggaatcttcattttaacaagatccccgggtgattcttatacactttattgattgattgcttgattgattgagacagagtcatgctgtgtagcccaggctggagtgcagtggcgcaatcttggctcactgcaacctccacctcctgggttcaagcgattctcctgcctcagcctccaggcgcattccaccatgcctggctaattttttgtatttttagtagagatggctttttgccatgttatccaggctggtcttgaactcctggtgtcaagtaatccgcccaccttgacctcccaaagtggaggcattacaggcgtgagccactgtacccatgcatgctgttgaggacaccaaacaaatcaaaccaaccagatatatacacaacattcatctacttctctccactagatatacgacatttctttcaaagaacttgattcttgcaggtgtttgtaaagtgatttaaaatatgaagatgttgtatgtgcattaatataggaatgtgtgtgttcaatcaaatggacataaagagttacatatagtgaaacttctcactttattttgataataggagatttggtgagcaccttcattccttcttttcattttaatattgcatactgtgcagttttttaaaatttgttttagacacaagatctcaccgtgttgcccaggctggacttgaactactgggctccagcaatcctctcccctcaacctcctgagtagctgggactccaggcaagcaccactgcatggggcttggaacattttcttaatctggagacatctaaattaagactacaatattaaaatgatgaaaaaattgaataaagatgttcaccaaaacccctagtgttttgggcaataatgattttaaggctttgaggccccttcccaatgccagtcattctacaaattgttcataagcacaagcaaaatcgtaagttgtaatttggccttcaaatacagtatttttaaagaagggagcattttagttggtatgttcttgtttagcatattttattagatgttaaagttttagaatctagatgtcatattaaagtatatgagataaagaatatgacttcttccgtttaactagctaaactgtggcatataactggatgtgtctgtatagagggacctctgggagaaaagaaaaacttctattagctgtggcttggtatgtttgggggtcccagagcaagccagatacttgactggggaggggggaagagcaatttatgtgccagtaattacaattataaacacatgaatgtcctgggattggagaacctgttctgtatgagggtaccaggagatcttaacagtggaagaacatttaaactgaatcttgatgaataagtaggattccccaaggggaaccaggaggaaccagcacctcaggtaactggaagaatgaatatgaaaatacaaaagtaggccaggcacggtggctgacacctgtaatcccagcactttgggaggccgaggtgggtagataacttgaggccaggagttcgagatctgcctagccaacatggtgaaaccccgtatccactaaaaatacaaaaaaattagccctgcattgtggcgggcgcctgtagtcctagctacttgggaggctgaggcaggagaattccttgaacccaggaggtggaggttgcagtgagtcgagattgcaccactgcactccagcctgagcaacagagcgagactctgtctcaaaaaataataataataaaataaaaataaaaatacagaagtaggttaccatgttaacaaatacgttcatcatcttgttagtagggacccattggagggttttaatcaaggaatgccattagatttgtatttgagaaagataattctggtggttcagtagaaatagagcaaggtgaggtcagaggcagggaaatcaactaggaagccgctgcaaccatctgagtgacagaagatgaacttgaatcgaacattgaatgtagcaatagtagtgtgggactaagttcagagacatgctggaagtggagcaggcaggttagggactgagcaaagaggtagcgtggggagactagaaagacaagaaacactttgaagattctagttcggggctgggcacggtggctcacgcctgtaatcccagcactttgggaggccaaggcagccagatcacctgaggtcaggagttcaagaccagcctggccagctgaccaagatggtaaaactccgtctctactaaaaatataaaaatttagccgggcaaggcggcaggtgcctgtaatcccagctactcgggaggctgaggcagaagaatcgcttgaacctgggaagcggaggttgcagtgagctgagattgtgccactgcactctagcctgggcaacaagagtgaaactccttgtttctgtcttcccttccttgtgaaatcattgtagatacatttgggaaaacaacacaaagagattccactgtcccccaatagtaacgtcttgcaaatctatagtaaaataaacccttctaaaaattgtatgatttatgagcaattttaaattaaaatatcagtatactctcatgctgatttctaactagtcatttctctgacctcccacccctcccctcaccccttggcccctaccaccctcccacacacatacctaatggctctccagaccaggtcctgtccccatgctcccctgatcaagcagatcttgaaccttgtggggaaaatcacgtctctggtggtcactggatgcctggtgtccatcctgaccctctaaagctagggcttcccattgtgggctggtactccctacatgtaccctccatgtcctcttgtagggaccccagcttcagcagtgctctttaccatgttgttaaatatatggcaggttggggtttgattctggccacagctctccccagataactgacagagtcatttagggcctttgtcccacatttctgggaaatttgtttctataatagttaggactttggtatgctagtgacagatgcacagatcaaattaacttaagaaacataaatgtactggcttactgagttgggaagtccagggataaagctcccttcggagattctgggactcaaacaatatgatcaagattctctctcccttgcacttttgctgatttgttgacctcatgctcttcatggtgtggtttatatggccattggcagatctggagatacatccttatatctcagagtgacacatgaggcataagactcgcttctccaccatcactgcaaaaccctactggagaagggctctgtttggcctcatttacatcctgtgccaatcctgtgggccaatcacttgtgcagggcgatgtagtgtattttggatgaatcaaccaatgactcagcctgagctccttatcatctgatagacttggaattggggtatcaaattgtctggcttagtagaaccagatggaaagggaagaaagagtttttcaaaggaggagatattgacgggatgggctaggcagaacagctaatgtccattttagttattcctggatctagcgtcttctcctgtggtgaggagagaggaatgtcacatggcacctatggttgtctcttgggagttatggtcagtgttgacagaagaaggcaaggatggctgtaagcaccaagatgtttatatgtatgaggttggaatttagaggtgttcagaactaatagccttaattgtctttgtgaaattgaaaacaaaagcacttgtgaaaagacaggaaggcagggtggggagcttaaaaagctagttgagggtttgaaggatgagagagagatcacaaggacagtgtagaggactgctaagagatattgaggatccaactaagattggaaactgtagcactcaggattctccagagacacagtaggatggatatatatgcgtacgtacacacacacagaaatttatttcaaggaattggcttatgcaactgtgggggttgcacatctgaaatctctaggacaggactgcaggctggaaactctcaggcaggagctgatgctgcagtctcgaggcaggatttcttcttcctcggggaaacctcaattttgcttttaaggccttccaggtgaagagatgaggcccacctgcatgatcaagggttatctcctttactgacagtcagctgattgtagctgctaaccacatcaatcaaatacttccacagcaacacctaaattagtgtttggtgggataactgggtaccgtagccttgccaagttaacacatacattggagtgtcacagaggcctaaactctgtgagccagtctgcatgacactagatgatctatttttcctcttcagttccacagagataaatacctagcaaatagaagccaagagagtggattgttaaactgattgatgattggaggaatcttcaggctggggtcactggagtctcaaggggagatcttgacgttgctgtcgagagaatggtggacaaagtccctcagggttgtggctggactgagaagttagttccccaagcgtaaagtgacaagagcatcaaccccaccagttaaaatgaataatgcatgaataatacttatgttgggcactgaactaagtatcacattaattttaaattattatcattgttacgatttcatttaattgtcaaggaactgacactacataaagtcagagtggatttagtgggagtaagagggtgagctaaatgtggtatattggagtttatttatttactcaaccaccagttatttaataagcattgattatgagccaggaactgttttaggtgctagagatacagtggcaaacagaacagacaaagtctctgccttcatggggcttaattctgttggtgggaggaggtatctgctaataagcagacaacttcagcaagcaacactagccccaggtccagtggtaagcgtgttatgaagaatagtaaagccaagttaggcaatagagagtgatggggccagacagggctggggtaggatgctagacttataagagaaaccctttcggataaagtgacatttaaacaggaccccgaaggcatgaagggagagcgtgggctatgaatatatagggaagagcgtgttcgagagaaagaacatggtgtgtgcaaaggtgctcagaggctggaggctgcttctccctgtaagtgaggaggagaggggtgggggatgaactgggataggttgcaacaaggagccatgttgggtgtggtgggtcattataagttctctggagttcatgctgagtgaggtggcaagacagtggagagttttgaacacagaagtgacaaggttcttctctaagggccgttttggaggccgtatgaggctgtatgaagggatactgggaggacaaggatagaagaaggagaccagtgggaaactgttaccgtaatccaggcaagaagaatttgtggtctgaaagccatgctaggtatgagcatgaccaggaccatgccacgggtatgcattgctgaagcagcctgccagcgaagaccaagatggcccaggaccctagagcagcatgtctggaggggtctgctgtgttgacatggaacttcttcaagatggagacaggatgggtgggcatggggagaagaactctgacccagattctgaagtcctccaggagagggaagatggtggaggaaagcagcaacggggtagaaagaggagcattagctgcatgcaggcaggtgcttgaggctcctgcctctgggtctttgcatgcacttctttcttttctgaaacattctcttcctaatatccacgtaactcagtctcttccttcccacctcagatctttatttaaatagattggaagactgctgtcaggacatagtttatgtaagaatgaagataactctcttgcctccatccttatgtcacctggcatggggtggcatgagcagccactgcctggaaggtctacttggaagtggtgtcctcaatggagaggcggatctggcttgaggctgggaggtgaggggactctcctgtgaaaggggtaggaatgctggggaccttattgaccatgggctaggggtttcagcaggcactgtggggagtgtctttagggaagtcaggaaaggagggtagaatcaatggggatgaagtaatgagaggaccagagggaacaggtgctgggatgggagctgaggatgccagaacatgggattgactgccctgggagggcctggcaagcctgaggctggcgtgcatgcagcctgtacgcttcctggggcaccaagcagagcatgggtggccacaggagacgtaagggagcgttgtctgaggggatgtgaggaatgaccaggtgctacccacctacagagctctcaggatgcttaactcctgaagaagctgtagcctggaatggcttgtagacctgaatgtataccaggtgtaactggcagagagggagcaggccccagaaggtccttgttcatcctagtcaggtccttcatcctgtcccacttcagggcccaaagtgctctgattctaatgccagcctctttggccttgcatttgtagagaagcgagttccctatcattggaggtatctaagcaatgaagtggacagccacttagaaggagtgtgcaggatggaggcttgggtatttcttgggggctggactcgaagacctttattttccacttggcctggagcgtctgtgagtccttgtcaaatactgcctggcacttacctccatcgggacacagtgcaggcatggctcaagtgggtaaattgtttatggaatgcaaacctcgtgggacttatagatggcttatcaatgtggaaactgtattaaaaataagttgagatcagcaccttccacagcctctgcatatgaaatgtcacttacatttaaacccacatcaaaggttctgggttgattctttgtatacttgttagtagtccaatgcttaggacaccattttcaggtagctgttttttagtgtgtgtttggcagggctggttctatacaaacgttcacagtgagcagagggacagcatgatgtctcctgccatggtttcacaattagctagaagagagagggttgcaggctcactgggccagaccggacgctagaggctgtattcagtaggtggggcagtggcatggacctctctgcccatgatgtggacatcctggcagatgggctgtttcgagagcaagccatggcttcaagaccttggctgtttgtggtgatggggtgaaggaccgaatagttagagttcgtactgagtgtctgtggtgcagggagattctaatcacatcatttgggggtagcggctgtgcttagcactggttaagggaacgaacgggcatagttgtgctatgcttgtgagtatgctcacttcctggagatggggagagtcaaattcttagagtgttgtgtggcttatatattttattaagcacctgtgttctaagtccgataagcactttgcgtacactgcctttaattttccgaatcattccgttttgcttgttgaggaaggcaagcagttaagacaggctcatctcttgacatgaccccacatagtgactgtacctcagaggggtaaccattttctgagagctgggtcccaactgtgttagggtcaaaattctgatttgcataaccagaggtgaatgaagacctgggaaactgacacatactatcttgactcataagagactgatgtataaaaacagaaatgatgccagctgcttattttgtgagaagaaaaaaaaaacaattctgtgaaccagatacatatgttctctcatcagtgcattcaatatgaaggcaaatttatatgaggacataaattaagatcagaaggttgcttatcagcatgaaacagtgtaggctgagtgaggataggacaccttactgacagggttacagagctgtgatcgtcttggctccagtgccaccctgcctgctgtagggctggatggtaaggttacctcacagtgacagggacaccaccaccagtcccagccgctctcagtctctgcttgcagtgcctctaacactgatcatcatcagcccattgggctgattcatcctttctttagacattttcctcatggaccctcagtaagttgtcatcttcctttgagagcaagttttctctttgtggtatctttgcatctcaccactttatttcgttatttttgttttgtggctataagctctacagagaagttgtattgttccatttccaaatttgtgggaaaggggaagaaaagaggagaggcaccatattgtcagcctgatttcccacctcagagacgatattcttgtcctcgttttacaattgagtcaactagatggcatggctttttttcctagctcccattgccatctgacgtggtatttatttagttgtttgtttattgtctatttctcctgttagaatgtaaacttggggacagcaggtctttgccatattcttggcatctggaacggtaagtggcctgaggtaggtgtgggcaggtaggagtatgcgtggattgaagaaggatgaggcaggccctcaatcccagtctctcccacaccccaccttcagtttggtgaggtgacagaagggaggaaaatatgagaagatctgagccaaaatgaaaatcagacaaaaactcagggcatgttctgggggtccttgtgtccctacatcgtcttaaagaaccagcctgggacagtggggactggagctggtgacacacaaggacccaagaatatggaaggcctttctctggcataattgaaataaactttaatgaacaatttgtcctgttttaaatatctttatagataatatctggagctggacaaatcatgtataatctacttcctttatcattcttatttcaattatatccatctacaatgtctcagccaaagggaacaccatttacctggtagcagccacctgaattttaggcattgatatctaagagaaaataagttgctcaatggttgctcctttgtaacgccaaacctaggacttgactatatggttctgatacagtccaacaatgtgctagttgataacagcttgtagatggatatatatgtattctgcatattttgtttggtgaataacccacagcattctaactcaggtgtccagtactgcttatcaaataaggctttaacatagaaatacataaattctagaaattgtcttgcatttattgtattagaaagtgaaattggtttctttaaatctttgtaagggctattaacataatatcttgttccaaatcaaatagagctacttactactaaagacttttgtactttcttcaataattaaagcaagcaagatttgtagacaatgcaattttcatgatgcattgaaaaatgtattcttacagcagctgtgtttatcacacactttcattttcttaatatcttaaaattgcttggcaaaatgaaagggaaggagggtggtcagggatgtttccaacattctattaggatcattttcacacaaacagaaaatctgaagtaattgttcagtgggtcccctgcacccatcacgtacattttacaattaatgttttcctctgtttgcttcatcactggctatccatgtattcatccctctcttcatcttatttttggtgtattttaaattaaattgcagaaatcagtacacttcaccactaaacagttcagcatgcttattattaactcgagttaaatatttaatatatatttcaggtaaaatgtgcgcacagcaacataagcacattttaagctttccattcattgagttttgacaaatgcatacacctgtgtaatgccaatcccaagccaaggtacagacattctttttttttctccaatttaaaactttaattaaaaagtaaactttaatgtcgaaaatgcaaacttggggaaggcagaaagatcacacacaaggctgtcacttcacacttggaaggttgcacagcggccgggcagaggcgctcctcacatcccagacggtggaggggccgggcagaggccctcatcacttcccacacggtgagggggccgggcagaggtgctcctcacttcccagacagggctgcggccagagagaggcactcctcacttcccagatggcagggggcgctgagcagaggtgctcctaacttcccacacgcggtggcagctgcgcagaggcgcttctcacctcccagatgggcggcggccgggcaaaggtgctcctgcttcccagacggggcggcggcattcttaccacccagaatggtgatgctagtgcctctttccagtcgatttccaccctacgtgcacgcagagggaacccatgttctgatttttttctcagcatggattactttagtctttcctagaactgtatacagttctagaatcatatagtatgtactatttgggataagtacatgcaatacatactactttgcatgagactttttcacgcagcacatttttgaaattcatctatttttgtttgcatatgtcagtaatctgtacccattttagtgctgaatcatattccattgtgtgaatatgccacaatttttaaatctatttacttatcgatggtcacctgcgctgtttccagtttgcagctattatgaagaaaattgctgtgcatgttcttatgcaagtctttttgtaggcataagctttctgattacttttgaaactcctggaatatgtagtcttagcacagagtctacacacagtaggtactcaatgaatgtatatattgccctggcacaaaacccacatgacatgttgggttttacagtacaccagacgttttcttcctcatctgttctcagatgagcttcgtaactacctgctgaagaggcagaggcaatccacacaatggaagctgagacattacataatcgctaattgttggagctaaactagaaccctggtttcctaactcctagtcctgtactctctgactgcttgctattgagacgggagagttcccttgacccctttgcaggacttgtgaaaggggtgtggcccacttatttgactgccaccatgctcaaaccccctgcctgagagggagcatgcaggtgagcaggtacaggagctgggggaatgtggcaagaatgaaccccgtactggtactggtcaacggcagcatccagggttgtctgcgacctctggagccctcgagggcatgtgttacaacgctcatagcagttactatctgcagatagctaagtgttaaccagctcagtggcaagtcagggtgacaggcctttacaccctgccctctgggtacctggcttcctgtctggtgtccaggaagaatcaggtcacataggcttgaaggatggttcaaaatatggagattttattaagcagtgggagtggctctcagtggaaagggagctggaaaggggatggtgcgggaagaaggtgctctatctctgaagcttggccgtctctgaggaggctcttctccaaagttgttctctttgaagttaagccgcatctgtttatagtttcggacactcagttgcttctccttttcacgttcagctgcttgtctctctgccagctaaggtctgaggtttatgtgggcacaggagagggggagcgggtaggccaaaaaggtaacatttgggtgggaaaacagggataactcttctcatttagggctgtggtttccaggcttgagggtggggcctttgccaggaaactgccctcttctacccagtacttccctgtctcctgtctgtatcgctatgtcagtgccaaaccgaaggtatgtgtactttacatcctcccttccccccaagcattgctctgtgccacagttacggtctttgagagttttgggtttgtactttggctctatttaagctcctggtcatcagaacttatgtatattttccccttttatatcatcttgttttctcagtgtgtatatattgaggtgaggggaggggcagcagggagggcctgtagagggagttattgaaaagtgacctaagccaatctggtacttttgattggcaatcagagaagtcagccatgaggttcctgagtctctctttctctgccactcccagctgctctgggatcatgaaaaccagcctccaacctgattctgcaacacatgaaaacttttattaacaaggagattcatataccatgcctaaaacactcatacaacctgttctgtaaactcaagttgtcccccatccgtggtttaggcagcccggttgttaccagtggaaggtgtccgagttactggcagcaattccatatggatctgcagcaacttcaattcttgcctcctcagaagaaagaattcaatggaggggcataaagcagaaaaagagactgaagttaagtttcagagcaggagtgaaagtttatttaaaaaggctttagaacagtaaagaaaggaaaattcacttggaagagacccaagtgagcacctgaaggtcaagagccccgtttaacggtgatgctaggactttctaggattcccatgattcctcccttagggtgagctgcctgcatgcacagtgccctccttacctttgggaattgtgcacacacagtgtgtttaggaagttgtatgcatgcccatctgtggctttcttcccttttctggtggtgtgcccctggaagtcatactttgccattttgtctcttaatgcacctgcccaggaagttgcttctccctggagcctgcgtttgattaacactttaatgttaacagatgtgcctcatcaggagattgtctctccctggtgcccttggactggctgctgaattatcatttttagagaggcagtgtgataattgtcagaccatcacctgacattcctagtgggtgggggagaagagccttctcctgccccgctcatgcctgtctaactacctgtaacacagtgagcacctctcttgacaccagtaatctgatagcaggatcaggaagctgcttcttgaggacagagtctttccggaagcagtaggacagtggtgtgaaggaagttctgggcctcagccctcctctgaaagtgtttgctaggctggctaagcccagcacccttttcatggaaattttgaggtttctagccatccctcaaatctctcatagccttcatttgaccattgaaaataatttctaatatccctttatgctaattaatgaactatctgttgcagattcagatgggagagttagaagcttttatgaggccacctctgggaatataaacaccatttgggatctttcaaatgctcactaacaccactgtcttggtacttcctgcttagggtgcttcatatattaactagtaactgttgagggtgtcctaacatgaatctacacacacacacacgcttaaagctcactatggatggcggagtgtttcaacataaaacccaggtcacattggggaggtactagagtccatgtgtccttcccctaacccccaccctctaacggtggcatttccaccagactcttgagttttcagtttgagggaatcctttgaataaatatgattttctgcctccacacttaatgtggttagagctgcagccttgatcctaatctgtctgatctcccatcctcattgatagtaaaccagtgagtaggcaagtcaactgtgagttaatcggggtgggggggatttttaaatgcaagtctgatgtttaaatgtagctctgattatgcctcttggctatcagaagtgagtttcatttggatggagagccattttactgagggcacacagcacagaagctgagctgcagtgtaaagctttcaagtgactcttggagctattaaagtgccactcatttggtaactgttgctgttaattaagtttgtagccccattattaattcttggctctactattattaattatgcttctataaatttatagtaggcagtacctcagggaatttttcaagttgtatattaaaattagagataaataaacacttaagcttccttctcaatataagaagagtttggggtttttatttccggtactaggtaaatttgaaaggtatgtgatggtcattttctctccttactgaaacattttctacatggtttgcagcagaaatttctgtaacatatttaacaatgcggtttagtatttaaatatttaacccattcactgataacttgtagctaattcctacaattaaacttacgcctttggccaggcgcggtggctcacccctgtaatcccatcactttgggaggccgaggcaggtggatcacgaggtcaggagattgagaccatcttggccaacatggtgaaaccgtgtctctaccaaagattcaaaaattagctgggcatggtggcatgcacctgtaatcccagatactcgggagactgaggcaggagaattgcttgaaccagggagtcagaggctgcagtgagctgagatcatgccactgcattccagcctggtgacagagcgagactctgtctcaaaaaaaaaaaaaaaacaaaacttatgccttttatgagagcaagcagacagagaaggaaaagaaaaaaagcctggcattttgtgtataaaaaatcagagctcaagtaatgttggtcaaatatagatgcaaacaagtccatgtgcatattaacaacccctttcaccatgtgctttatttctgaaaatactttaaatccttttctgtcttctgatccagctctccagacaatagttaataaatgggttcataggtaattatgatgcattttggttcttttacctacagcaaattcctttttttctctctctcttattctaagaaggaacaaaaattgcccataattctccaggttatagaaaacgtctattggcattttgatgtagttcctttcagatgcttttccaagcatatatcaaataatttagatcacacaatgttatggtttgattttaccccttaacatttgatgtagcaattctttattattggacatttaagttgtttataatttttgtccttgcaaataatagatatatgatatgttggatagctctttaaataaatatttgagagtacctctaattatctattttaatgcctagaaatataaattttttgcctaaaggcatgaacattgttcaagttcttgatacatactgaaaaattgctttccaggaaatgacgccaatttccagtccactagaaacattccacggtgtctgtcttactgcggccatgccatttaatatagctaatacaattataataatattaacttgctaactttataatttttgaattcggaaacttgaatgagatatgctggaacatcaaatagtgacctattttatctcaacgcttcattttgctttttggagccaaaagagttctttctctctcaaattggattcagtagttgaggggctacacattaactgacagtagccatattaacaagagaaaagacaatatttatttacccatgcatgggagagctgctcagtaatgagtaacccaccgactagccagagataagggtttatataccaacttaacaaaggtgaagggggcaattagggattcagggggaaggcatgaaggtgctcttgggcttttcagtgataatgggaataggaaatatgtcttcatggcagctgaattaggaggaaactgcctttgaggggagttaatggcagctgtatttttgggaggctctgctatagtcagataagggaagttcagataagacttctttctgcatctcctgcagctcaaatgttttcaccttaaaataacctttataaagactctgagggtccaagtgcatccccatactttctatttattttaacatcacaaataaatgtgctcaataatagataaatttttcatcatgaaatgtattgaatattagtaataatggtgttttctgccgtttttgacaggtaaattaccagtaagggatgacacaggaggagaaaaggagaaaatgaagaactgtcataaggataatttttattacagatatgaatatatttgtttggaactaacaactatttttagaagacaaattaggcagaagtggtcactactgtatggacaagggtgaatagtagttgtgattttcaaaaattttttaaacatatctcttgatacagtatttttccaacttcatttcttttctttttttttttttttttttttttttttgagatggagtctcgctctgtcatccaggctggagtgcagtggtgcaatctcggctcactgtaacctctgcctcctgggttcaagcagttctcctgcctcagcttcctaagtagctgggattacaggcgcgcgccaccacacctggctttttgtgtgtgtgtttttaatagagtcagggtttcaccacgtgggtcaggctggtctcaaacttctgacctgacgatccacccgcctcggcctcccaaagtgctgggattataggcgtgagccactgcacccggccttccaacttcatttctttcaagtcacagtcatggaacatgtttacaacttctgagttacactattttggataaatagtcataaatatcagaaattgaaaattagattaattcctccttattttgatattcacctaggaaatagtttttctacagatattattctggcaaatctcagtttcttgaatctcagttccttgaatcttgacttttgtcgccacccttgatttgaacatcccttggcagctttgtggataatacagtgtgagagacataattgaaaagcatgacaagtgagaaaatgggttacatacctcaaaacaaaggctcattatacatgacaatgcaattcatttgggtctctccattgcatatttgctacaggtattgattgccttccaactcttcccacagccttttgctagtcttaaaggcataaatcacttggtgaaaggatatttctatttcagccagataaactctttcctttttgtttagatttaatatgaaggcaaaatgcactgctctcagtgaacagccttgtttcctttcgtttaatggggaagggaacactgaaacatttcctacattctctaggaaaagcaccttttttttttttcttgtctttataaccctgtatctgttgtcactgattcagctattcagtctgggacaaagcgacttttaagttctagagctatgaggaagctataaagggaatacagttcactctgtagagaaataacagcctgggagatcatggaccagaaatgttactctccaaaggtttgctagagctttactttgaattctattcatcaatatttttgttggcctggatcagtgactctaattatgtatagaagatagaaacagcagttatatttagcaagctggaaaagtccctgcagtctaccctcagaacagctaaacatacggagtcaacctgagattctgaatgctctgttcactccctgagagataatgatgactgaagagtgatagcgcagggaacagagtaaagctagaatgggaggcaaggaaagttatcagtcagacctctaggagaagtcccagcccctgccccatgcttttgttttttatttgtctaactttttttttttttttttggagattttccatttcaggcttttgttgcttttctcaaatgtcaaccctacctacctctctctgaacgaacagcccacactttctacttcatcaagaaaattgctaccacagggatgatatcatagcccattactgtatgatgctatctataccttagcctgggcttccaccatttctttgtctcccaaggagaagggacgtgactgcaccggatcttagtgtcatcttttctgcctcccattggggactgtgaagttattccaaggacagttgttccccctaccatagctgctagctccttccctcgtgccaggagccacttagtcacagggtaactgaagagaaaaaagaacgagacctattgctgagcctagagcaagctcccccatacctgcaccccacatgtgtaccaaaagcttgctttctctcccattcccaggtctttgatggggacgaagctaagaccatgtatgccattggccccaggcaataagaggtgcattgtctgcaaaagtcttaaaacaatattaaaatcaactaaaaattggtctttttttttttttgagacaagagtctcactctattgcctaggctggagtgcaatggcacgatctcagctcacagcagcctgcacctcctgggttcgagtgattctcctgcctcagccttctgagtagctgggattacaggcacccaccaccacaccccactaatttttgtatttttactagagatagggtatcaccatgttggccaggctagtcttgtttttattatcaccatgttccagcaattctaaacgatatcagcgttggggaggaaaaacatctcttctttctacctgtcttaagttcattggctggggcccctataacaaaagacagagtaacaagagaaaagcacacacgtttgttgaatgccagttttatgtggcatgggaatcttcacagggaaatgactttgctgagaccagctcagtgggggagaccctaacccagcggtactagaggaattaaagatatacacacagaaatatagaggtgtgaagtgggaaatcaggggtctcacagccttcagagctgagagccccaaacagagatttacccatgtatttatttacagcaatccagtcattagcattatttctatagatgttaaattaactgaaagtatcccttaagggaaaggaagggatgggccaaattaattgcagcaggatcacgcccttaagacacagattgctcatgcttttgtttgtggcttgagaatgcctttaagcagttttcctccctgggcgggccaggtgttccttgccctcattcctgtaaacccacaaccttccagcttgggcgttatccttccagcttgggcgttatggtcattatggacatgttacattgctgcagagattttatttatggccagttttggggccagtttatggccagagtttgggggggcttgctcccaacagacttgaagaagcagttaaactgggagtttttatgctagcttgagtgaagagtggagagtcatggagaaatgtgttaggacagaaaaagtatgagccgaggatagtcaactgggagaaacaacaaggtctgtatgttcacattcctcttgacatccctgtgtctttggagagaaagatgttattttcctccaggcatagggagggtacctttcacatgatctgcctcagggaaggatcagacaatctttgctatacatgctgttttccaaattccttcaacctaaaatattcagtattccaagtcaccatattttggggtagtatgtcttgaaccttatcatcagtgatgtaatattcctccccagaaaatccttttgttggtaagttacaaacaattgctataacgattgttgacccactggcttcctacaggcaacccagctatactcagctgagtgtcaattcataagggttggaatcatttgagtttgctgcctgcacagtttgtgtctctaagccctgtgatactacctagtcctacgtttaaaaagtaggttcaaaataaacaatggtaatacaacaattctaagggtaaagtgacagagcttgccttattgcacttttgtgtgcagatctttctctaaccttgtagcatttattcctttggacgtgtttcttttatgctctccttctcccttaaaataaatacttaaatgtaattaaaaattattaatccattactttgtttccttttttgtactgtgatagttttctaactgacttgaatgtacatacaaaatttaataaaagactatgttttatgtttgccattattttttggcttttattactattattttaagaatattattgaaggcttggcgcagtggctcatgcctgtaatcccagcactttgagaggccgaggtgggcagaccacccgaggtcaggagttcaaggtcggcctggccaacctggcaaaaccccatctctactaaaaatacaaaacttagctgggcatggtggcgtctgtagtcccagctacttgggaggctgagacaagagaatcgcttgaacctgagaggtggagcttgcagtgagctgagatcatgccactgcactccagcctaggtgacagagcaagactccatctcaaaaaaaaaaaaaaaaaattattgaagacaattttgttgtgtagaggaggagggtcttaaatgatcctctctggctgtcagatatgctggggactccctgtgttcctgcacacctgcccaggctctctcctctccttcctccctcattcctgcacctagaatgttttcaaaagttattctaaaagcctaaaataacttccgtgaagacttgctgtgataattccagctctttctttcttctctgaattcttctaacacattgtagttttccatacaatgtagcaagtgatggtatgccagcttagactttttctaatactttttttcccaagatagaatgtaagctccctgaaagttggggttagccttatatttcttcttttgtgtctccccaaagacaacttttggaagtatcccattaaaatgtatactctgtagaaaccagctcaaatccttcaaaaacagctcttctactcctgcaaacttcattatcctctcataactttatgtgatcatttaaaatcaggtttttctaaaacttcggtctgagtgaccaaatgcaattgcttatcttcaaggaaatagtgcttgctttaggcattcactccagaggcacacaaggagagataggtgaaatcaacatgagcagttaatttctggtttcacccgtaaaatactgatttctgtggtttgaatgtgtccctcgaagttcatgtgttgaaaatgtaattccaatgcaatagcattgggaggtgggatcttcaaagagtaatttggtcaagagggctctgtcctcataaatggattaatgccattatcttgggagtgggttagttatcgagagagtgggttgctaatgaaaaggatgagtttgttccattttcctgttgctctcttgtggactgtcttattcttctgcctttcactgtgggataacacaacataaagaccctcaccagatgccagcccctcaaccttggacttcccagcctccagaactataagaaataaatctctgttcttaattatccagtctgtgttattctgttatagcaacacaaaacagactaagacagtgactctacaaccctaaagaggtagtcactgaagaactattaagcattctctcagttgtgtcagtgaaagccatctctatttgtgttccctatcttaagccaacagttctcaaaatatgatccagggactcccaggagtcctagagacctttccaggggttctgtaaggtcaaattatttttataacatgacccagacattatttgcctttttctctctcctaagtgtgtcaaggcattttccagatactatatgacatgtactatcattatagatttagcgtggaagcagatatgagaagccagctgtggtccattaagccagagggtaaagagatttgccaagaatgtaaaaagaatgtcttctcatggagttttttgtttgggaaaatagagtaataattcataaaaatttcctatttatgttaacatatgagtttattgctaattttaaatcaattcataaacacatattttttaatttttcagttttaattttgtatacagcaaataacactctatgtaacccacatatacaaaaggtccttgaggccctcaataagagtgtaaagaccaaaaagtttgagaacttctatcttaggccaaagcagagatttttagaaacatattcttttaattctttctttggttacttacctccaaatcaaagcaatgtgctgcaactgaatccagtggaaaaattaattagctctatgttaattctttggctttgctgtgaaaagcctgatctttgggccattgacatctgttagaaatttaaactcttgagccctgacccagacctactgaatcagattctgcattttagtaagatcactaggtaattttaacctacaggttgagagttatgagcactgctccactttgcctttgtgaatctggctgggatctttttccaactttattgaccatgttaattaactccctcttttttgattctctcctaataaggcttgcagctataactgcagtttatcctgataaaacttatttctgtagggggaaaaaaataatcttctccttcactcttcaagaatttttagctgggactccctgtaacaaaaggtagattaacaagggaaagcaaacaaaagcttaataacatgtatacttcctgtacacatgggagataatgcagaaaaatgagtaaacctctagagtagatctaaaaaagttgtcttagtcttcaggcttaaataccatcctttgctaagacaaaagaaagttatagggaaaggcctggttaagaagaggtggccaggaaaagcatcataaacaaaaccaaggtttgttatgcagatttaagtaatgccttctgcattgataagagtctctagtgatttagacattttcctcttcctggtgcagagagggagacattcctaccaatagggatgtcctgtatagatgtaaatttatgttacaaaagggtaacttttcagtgcttcttctgtatgtgcagtttctcaaaataaccagttcaaaataatcccatgccaaagaggcctatttggatgggcatattctggtttcctacaatcatatgttgggatgacatgtcctgaattccatcacttcctaatgaaatctgataaaggactgacttgtctgacatttattttcatcctacaatgtgaatgcaatgaaggatcaatttgcaattgtattttttatggccttttggatttatgcactagagaggtgctaaagctgatgtgttgattcaagtgaggagtaagaggggtgagaaactgtgagaaaaaaaagtactataaagacacatgcacacgtatgtttattgcggcattattcacaatagcaaagacttggaaccaacccaaatgtccaacaatgatagactggattaagaaaatgtggcacatatacaccatggaatactatacagccataaaaaaggatgagttcatgtcctttgtagggacatggatgaaattggaaaacatcattctcagtaagctgtcgcaagaacaaaaaaccaaacaccgcatattctcactcataggtgggaattgaacagtgagatcacatggacacaggaaggggaatatcacactccggggactgttgcggggtggggggaggggggagggatagcactgggagatatacctaatgctagatgatgagttagtgggtgcagtgcaccagcatgacacatgtatacatatgtaactaacctgcacaatgtgcacatgtaccctaaaacttaaactataataaaaaaaaaaagtaactgtgttttcttctgtttaatgattgttgcactctcctacaaattctctttaaggaaattttcctagaagccttcttccttgaatttgtaagaaagtggcttttcagtgggttgacctcttggcttttacatgtaaatacaccgaaaaaaaaaaaaaaccccaagggatgtaaaaacattgagaagtttctcaaaaaaagaaaaaagaagtccatttagtctggtataactatgaagtaaaataaatcatagtatctgagaaagaaggggaaaatattcaattgtcaaaattagcctgtctcatttatttggccttggagaataatagtcattgatatagaccagtgggtttcaatcttgaataaacagaggatcacctataaactcaagaaaaagcccatgtctgagagattgaattggaatttggtaggtacttatctttaaaattttgacaaggtgattatgaaacacaatgagaattaagaatgtatggtatggtcaaatacgtgagcagatggaacacaaagtccctagtctttaagtgtgtggattcaatcatttattcatttttctttatccagggttagatcctgtaggggcaaagataatttccccctccccctctgaaggttcaagtctgctgaaatgaactgatgagagagattaacagggcaaaggcatacaagtttattaatgtgcataagcatggaagccatacaaaaaaatgaggctcacagaaaggccagatagctgaagcttaaaaagcactctctttgtagaggagccagagatggtggatgcatgaaattgagggttagtagtaaatgctttttaagagagcttaatggacccaaagaggaaacaatagtttataaatgattctctttggaagttgaatttatgggacggtaaggggcagaactgcaaagcaaacgaaggttgtctttttatgcagataaagtttcttgggtaatttcctgaagcggtcctcagaagggtagatgaaaagtttgtctgggtatggtcagaattttgctttcttctcttctccagtggttaatctttcttgttaatttaatgaaattcctagggagggggtttaagactattacaattcttttagaaaaagttttcttaatcagatagggaaattccagagagaggtcctccctgcacttagaagcaaggaaaacagaaagttagcaagtccttggttcagaggcactttctgaggtattccaatttctttcaattcaaaagtggtcagcatgccaaagcactttactttggaatatcatttttctgagccacaacaggcctgtccagagatttgaattaagcaaattaacacaggaacagaacaacagatgccacatcttcttatgagtgagagctaaatgttgaaaatatgtggacataaagatgggaacaatcgacaccagggactactagaggggaggatggaaaggggagcaagtgttgaaaaactacccattgggtactatgctcactacctgggcaataggattgttcattcccccaaaccttagcttcacacaatatacccatgtaacagatctgcacatgaaccccttgaacctaaaataaaagttgaaaagaaaagaaaaatgaataaatcctgtttaacacaagaattttatggccttatacattttctaatgactattagccaagtgggaaacttgttgaaggtgtagagaactaagttcaattcctcatttattccctagatgagctatgccattggagtgaagactctgaactaaattaaaaagaatgtgttagactagtttttgtaccatagataagatggatgcacttgtgctttttaggtacaggaattcagacctgtggaagatccctggagggttaaggaatgcaaatctgcattatctgtaagccaaacatgtaatatgattcactcatgcgtatgcccgccattctttgtcaaatgtatgtgtgggctttattgacagaaaaggttttcaaaaaatcatttagaagcaccactgaacaatgattctttttatcagttagtttagaaattattaatgaccatcaactatgtatcaattacatgtaccctgggatacagtagtgaatctgacagccctaaatcagggagacatacagattaacagatgattaccatctagtgaatttagtgctgatcccattatatctatctgcagtataaatttaggtgtctgtaatcctagaaatactgctttaaagccagcatgtctgctcccatctccctgttagcctgtacaaatctgctcaagtgttaattagtaatcccaggagagaagtgctgtcattcacaattttctcaaaattacctctagaaatagtaaacagtggctcgtaactgatgaatgtgatggttttagccaaaacatattctcaatctatgtctactcaaagtagggcaatagtcatgatggggggaggggtgatagtaaaaatgcattaacatgaaaatgttgaaaacaatgatgcagtccaattatctctttatagaggaggactctataaaatgttaagagagatacaatgacatgttctagattcatggtctattaactcttgatcctaggtttctcaaagggctgaactgactcaaatatactggggactccctctgctcctcacacctgcccaggagggttacttctcaaggtcttgtgccagccattagtgttgtccactcaaactgctcaggaagcgtggtaagcacggtcagttgtgtcagcatttgcacaaagtcagtgacttacggtgcttccttgtggaggagttctctatccaatggtgccaggcttggccatgtgacttgctttggtcaataaaatgtgagcagatgtgatatgactatccacatccgtgcttaggctgtaagagccatcatgtgactcagccatgctcttctctctgccatgagaatggcatattaccataggaaatagtccttcagcctgtggagatagggcaaaacagagccacggcccacctgccactggcatgtaaggtgagtaggaaataaagctttctttgtagtgtacacccctgtgattggaaggttatttgttactgctgcataacttagtgaaagacaacttatatagtaggccagagacctgccaactttttcttaaagaccagatagtaaatattttaggcttgtgggccatttacagtctgtcatagctactcaattctatggcaaaagcagctattgacaatatataaacaaataggtatggctatgtgccaataaaactttatttacaaacacaggtctttggcttgtgggctgtagtttgcccacccctgccataggattttgcttcctcacctccttgaagttggatgtggccagtgaagttgggtgtggcacttgctttgcctagtggaatgcaagctatttaaagaagtggtgtaagtggtggctactctgtcagtctgagtcttgagagataccattagagagctgagcatcggccaacctatgctggacattcagcataactaagaaataaaccttattgtttaaaaccactaagatgtatggggtgtttgttactgcagcatatataactgcgcctatctgtactgatacaggtctatctggcattacgtttcggggcaccacctctgctcactgccatcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacattttcaaaggtatgaaatcacctgaaataattttttagttcattttttagtggctaaaatctgttaatagtttgattcacaagcctggcctttgaaaaagtaaaaattggataatgctgcacaagccatgttctccctggtgtgtaagggttaattattggactcttgcttgatgatgacagtgcaggttcattgaagtcatcactttatatcaccagcctgtctgcagcactgttggggccacgcctcttgtgcgatggttggctcagacctgtagcttcctttgccttatcccctttcacattgaagcctcatctgctgcttgacagtgcatgcctgagagttgcttttccacagtccctgttcttctcctaggtctggttaattgcttctctgttaaacagagaacatgttgaacagcagccttaaattattgtccaattttagcctactgggaacccctctgcagctactctgatcaccactgatatttctagaaagttcctattcacaggggactcttttctcccttctttatgctcaagggagaataaatcacagaagcagcaatccctccatgtgtcaaactatcaatcctacatggagctacaaaacaaaaggcagtatccctttgttgccagagaacatccagtccctgtacaagtctgtgcctcaggggctcaggctcattagcaccatagcagtggctcatgctttccatacacttttctctaccaacacctacagttagtctcagagttgttctttatcatgataggttacagagcagtgttttaaccatattaccttgactgaggtatggtgaggccagatgtggatcaagagaaagaaacagggatggattttatggttttgaggctcacagttccctggggagacacagcaggctgtgctgggccactcagcggaagcacagagtgaggcatgaggcagagggagatgggggatggtagggaagcagctttattgtcgtctccagggaaaggaaaaggaaaggcagggtatgcaggtttaggattggctaatttgaaaatgttcttggggctctggggcatagaggctgtccccggttgtctcatacctggccccagggtgatgaggtaggtccacggtggcctagggtgcaagagccacttaagggaagtggtgggagtttaaactacttggttgactcctcaagaaggggaactgactggcctctagctagggcctcaaaacagggtgaagacagtatagaataaaaaatatattacaactaggacagataccaacatactgggggtttgtacctaccacagttattccttacatttatgtttcattttgtctagtaatagtgaagtgaatggagttctagactgaagtctctgtttaggcagactctgaatttgttttctcattggttcccagagatggactgagatacctcagtcctgtggatacctcaggcaggcttaaaatgtggcacaaattctctttaactattcagttgatactttttcgtgagggcttcaaagaggctgattttctattgctaaaaattgcatacctctctatgttcaaagaaaataccatttactttatatatgaaagagcatttgcttatttggaaaacttttatttgcatttcacattttttatcacttcttactaaatagaagtttctcacattctctagggattgaactaagtgataacttagaaagaaagtattgttcaaatacccattttttggcttttatgttagtaaaatgtttcccctttttctagcttttctttgtgatttcagaaacgtgcaacttctttgaacgcatattaaatgtttttaaatttaaataatgaaccacttgcttttgttacagcccagtggttcttcttgcctgctgcacagacagagccaaggcactgagacagtagtgttgcagcgagaaagatttaattattgctaggcagtcaagtgacagaatgagaggcatttctcaaatccactgccccaagagctcagaggctagggtttttaaggataatatggcatgcagggggctagggaataggtgctgctgattggttaaagatgaaatcattgaggtcttcatgcactgagtcagtttctgggtaggagtcacaggaccagttgagtcagttccctggtgtgagtcatgggtccaggtagagtcagtcagtagccagaatgcaaaagtctgaaaaatatctcaaagaccaatcttaggttttacaatagtgatgttatctataggagcaatttgggggcattaccaatcatgtgacctctggctagatggctcctgagcagtaagaaattatagaaaagcaagctaggggacaatggttggttatcatttagttactcctacattttagcagaattcaggcccctcccataattctaaccttgtcgcttttcattagttttacaagggtggttttcagtccctaaacaaggagggggttagttttgggaaagggctattatcatccttgctttaaaattaaactgtaaactaaattcctcccatagttaggttggcctatatccagaagagttagcttgggaggttagaagcagaatggagtgagctattttgctgactagctttctgtcattgtcataatttttagaaaggtggtctcactcttagtaaacagtagtatgctatgctttactcagttgtataatttcatttgaattcaacaaataactacagacagctgtcaacttagtgatgttgagattggggctaggcctgcagtaatcctctgaaatatgtatgtgcaccccaaaaacatgtcattgagatgggtagacacctgcaagaggagtgcttttaaaacgtttttacatgaagatgctttctacttcagtgagacttttgccagtggtgttagaagttgctgtgaaaaccaagataaggagccactgtgtttttgatttgttctagggatttaatatccctcatagttaatcactcaggcaattactgggttaacaatatgtcctgaagaagagtagtttttgagccatgttctttgaatcactaagattcttcaaaactgctttagagtttcccatgaacatttggatcacattaaagcaggctcattatttccatcttcatgtccatgtaaatgaggttgagttcttcacttggttctcagctttagtgttgttagtatatagaaatgcacctgattttttatgttaattttgtatcctgaagcttcattgcagtcgtttatcaggtctaggagtcttttgcaggaatcttttgggtttctctaagtataagagcatgtcactggggaccccaaaagtgaggaaggtgggagagaagtgagggttaaaaaattctctattgggtacaatgttcactatttatgtgatgtgttcactagaagcccaaaccttaccattatgcaatatacccatgtaacaaacctgtacacatactttctgaatctaatataaaataacaaagaaaaaaataacaaaaagtaggctcgttagtaagacaatagctgaggagccctgaggattggtcaccttctagcagagagaggaagggccaagctgatttacaacagtcctgatcaaagaagggtgacctgtccagggcaagtccacaagcctccccctctgtgtcatgaggccacagagcactggagttccatgaagtcaatggaaaagaagagttctactgcttaaacaagtttaaaaaccactgctctagcattgtttataagaaaagaaactaagaataaaaacaatactgaattcaaacagctaattccttaagacctgggaacattgtgtgttcttatgcagttataatttaatccaaatacattggaaccacaccataattcaattctaggtcaagagcagagttttgtatacagcagattcattttggagcactctctggggatttggttacagaaaaatccagaggatttatctgggctgtcttactcataaaactgcacaatggcctagattttagagatgacattacagtgaggtctcctccaggacatgctatggtatacaccactatacaccacttaatctttagagggctcatttgaatcacattatttatgtagtgtgtccacatgttagatttggccagattctcaaactggggtgtcagttccacgtctagcccattaatttgttgccattgtgaagacagtagacttgaatgccttcagaaggagcatgctgtactgcacaagtgcgaggggcctcattcctaaagtgatcacactgtgttttagggaattgtgcccctttacaatgctgtgactttgggtgacactctctagcttctatagtacccaagtctgggttgcgtctgaatttgaaatctctactatgagactgtattgtttgtttttaaagtcgatggagcacttgacttggagccagaagagaaagcttgggtcttcacgcttcttgattaattatcaagccagttaattttctagagcctctgtttattcatttgtcaaatgggacaaataatgtctgtttcacagggcttgttgtgaagattatactctgttgtgttatagaggtttaaagtggacctgtgggtttgtatgaaatacagcaaggtaacataaattaaaagtagatgagggataaaagcggggaaagggtctaaaatggggttaacaagttgtaccttttgtgcagatctatatgcttgctaggaatgagccacaaatttgcttctgtgccctctagcagccaaggagaaaatggaaaccttattttctttaatcatggtgtctacgagattgggaacacagtagggagtcatgaaaaatattccttttcctagtaacttaacagagagagaccaccctcaggggtctgcaaaagaggacattgcatggtacagcctatagtgtctgctacacagagaggttgcaaactggcagtccaccagtgtcaccatttgttgggatttttgttttgttttgtttaggcttgatgtctaaaaagtttgatccaacatttaaaagaatcagattttgcaaaaataacatttttaagttttctttcaaaatcagatgatcagttaatattgtaactatatatcaaaattaattggcactgtgtagcagcttttttttaatgtagcaatgatttcaggtttgccacagtctccaccattccctactgccttacttactacattttatttcctacttggcatttaggcatctgatttagtgactcctattctacagcatccttgtagtaggctcagcagtacgcttcataaggctgagaatccctgagaggattgattgatatgggaaaatgctggtactctgtacaatattgttctacaataaaaatgtagaattagaatattgaagttactgttagaactttgaaatcatgactgagggtttaaaaatgcttaatgagggccgggcgcggtggctcacgcctgtaatcccagcactttgggaggctgaggcgggtggatcacgaggtcaggagatcgacaccatcctggctaacatggtgaaacctcgtctctactaaaaatacaaaaaaaaaattagccaggcgcggtggcaggcgcctgtagtcccagctactcaggaggctgaggccggagaatggcgtgaacccgggaggcggagcttgcagtgagccgagatcgcgccactgcactccagcctgggtgacagagtgagactccgtctcaaaaaaaaaaaaaaaaaaaaagcttaatgaacgagagtctcaaatagctaattaaaacaacctcaacttccaaactaatctcctagcaagtagtttacccagagtatccattccaattgctctttaatcaaataaaaatttcagaatattttatttaaatatttacatagctatatattttcatcagaaaagagtatcacaggaaagacatgttttaagtatgcttttaactgtataaagtttgattgttaggctctatgatctggtgacaatagtcgttactgttagaggtgaatccttgtaaagttgttatttttgtcaaggtccactttggcttctagacttgttgagtttggtaagatgttttgagcgctgagttgctaattttccagaaatgtaatttgcaatgaagatgttggatggggctttcccaattatcagaaggaattctccaaagttgaaaatgagtgataattatctaatattctaaaacatgctgctagacatggatatagagtgtttaataaaagatgtcaaagttgtgttgtggccaccagccaccatcacagctctagccaacattagagatgactggtgatctaggaggagattgtggagggttatctcagtgaagagcctcataaagagtattggggaattttccctcccattgccgtggagagaagagatgagtgctcttaccctttccccaagccaagagagaagagctctgatctagagataggggttatggcaaccatgggagattggcatctcacttcccacttggatgcctgcggagctctctccaggcccatcagaatggagcacagcgatgattttagggatctgtgagcatatatacagatgcttccaacatacagtatttgatagatgcaaagttgctagagcagcctgtgaaagtgaggcaaagaaaaagatgttcagtggttgacaagctcaacttccaccatttggcagagaaagatgtgtacattttcgtggggccaagcaacatcaggaaaggtagagagtttgagcaattgttgctggttccttgtccagaggtggccttttgggttgaggcaacccagactgtgagaaccctgacatgtatgttgaagtagaagatgtgtgttttgggggaggggctcacaaaaggctggtcaaatggttcttccaccatgctagggaacttggaatagagggtccatgtgggcctctgaagaacctacaaatgcaccctgtgaaggtcccaggatgtgactgcctgccttgcacagctgactttggtagccaagagaattgaaaacagcacgacctgatgtaagaagatgttccgtttcctcaccactgatgtcacttccctgtgttaacctgagaagagctacggcacagagtgatggaggagagaatgaaagcagaggaggagggtaaaaggaaaggctacagtcccttccccactacaggtcatacaaaaggaggagggaaaagctttgagttggatatgagattgaagttttgatacgaaattactatacttttagtaagtgagtgagtcttagtttccataaataaggctattataagtgaaagtgatggaaaaatgatggggtcttcctgagctgtccagctgcagggaatggagatccactggaacaagtcaaagataataataatgagaaaaaaaaagattcttaaatccccaccattcaatgaaccagttaccaaacccacacgatacagagacattgagattccaatatgaatctctccacagaaggaggcaccttctcttgccatcttctgtgtattataaccatttttgggggggtttggtgcttcttgttcaaaattgaagtcttgtagccaaaagtcaaaatcatattcttctaaaattcacttgaaaaatatttccttttacagttgaattaaagcaaattacttggttaattaatgtcaaaggtgactctgttctagagataatttctgagtcatgatacctaatatttaaaaattatgttttgatttttatctttagtcatggtgatttcaaatgaggttattaaatcactgtaattcatgatttatataaaatatgaagacattaacctacaacatcttggattgctttttttttttaattgcattagtcactagtaccttctaacagttccagtttttggaaggcagcctctagtttcctattcagcctcatcatagctgttccttttggagagcggtggagaatacaggattgaaggtgaccctcacagcatgacaaattgtcaatctggctccctcagaaaccttatagggagtgtattagtcagctttggctgtcgtaagcaagtaccacagactgggtggcttaaacagcagaagtttattttctcacagttctggaggctggaaagtccaagatcaaggtggaggcctctcttcctggtttgcagaatcccaccttctcactgtgtcctcacgtggcctcttttctgtgcacttaagggagggagagagacagctgtctggcgtctcttcctcttcttctaaagacaccaatgctacctattagggcccatctcttatgaccatagttaacttccctaaagggcctatctctacatatattcacattggggattaaggtttcaacatataaatttgggggcctggggagaacacagttcagtccataacagagaggaagaaagagattcttaaaaagtgttctcttctgcaagttgacatttctgaaaaatatgtttattctccaaatttaagagacttttagaaccaattacctgtgaaattttcttttccaaatgaccgaaactcaactcaaactagctgaagcaaaagtggatattttttggctcacatagcagatggccaagggtcagatatgtcagccacagctggatccagggtcgatgtcatcaggtctttgtcctccccttgagctctgtgtccccccatgttggcccctcctcaggagggtccttttcctgtggtggcattgattacctggggcagctccaggctgatctggcccttagaatttgcagctttaaatggagagaaactgtctcccaagagtcaactctgactgcccccgcctgggttagggatacatattagcagcctggacccagggcctatctgggtggttatgggctggcattcccaacagctgggagaggaccaaatgaaagattccaggcagatcaaactgtaaggcatgtccacagtcttccccttctaagtttctgagctaaaacaacttatttgtcctttgtgacttgtataattgtataattgatagtccagagaaggtccaaattagttcatctttatatgtgtaagagattctatctaaaggtcatcagaacctttttgaaagtcaactgatgtcatgttggcctttgctggtgtttctctgcagactctccggacgacccagccttgtcaccacctggagatttggctccagcctggctaaccacaggctgttgacatgatggctgtggtctctctgcactcctcctccaacctcccccttctctatcctcttatgcatacctattgttgtggtctaaatgtatgtgtcccccccaaattcatatgttaaagtcctagcccccaaagtactagtattagaaagtaggtcttttgggagctgattaggtcatggaggcagggccctcatgattgggattagtgcccttatcaaagaggcttgagagaggtctctcacccctttcaccatgtgaggacacagaagacaccatccatctgtgaaccaagaagtgagccctcaccagacaccaaatctgccagcatcttgatcttggacttcccagtctccagaactgtgagaaacgaatgtctgttgtttatcagccacccagttggtggtattttgttatagcagcccaaatggactaatacacctaatgtcacccatctcatgtgaatgtaggtgctcatctcttgcctgaaattcttggggtcaagtgtgttctggaactcagtttctaatttcagaaaggccatatcgtatacacactgtttactgacacccttagcagagtctgggacagcacccagaaatccatctcattaacatttctgcagagaaacacgtgaacattcatactacgtaggataaagaaaatcaatagtagccttatatcagttcaggtcaggttttgtcaccaaacacattacgagaaaggtttgttctcagggcttttcgtaatttcagaattgtaaacaagggatcccgaatttatattttcttgtatgcattaagtgctacctttgttggactctcagcagctaggactggtctccataaaatttaaaacttaagaaacattttaacttaaagcactttaagcagcactttccaaagtttaaagtatgtaagtaaatctgtgtgagtagataactataaagaacaaactttcagccaatatcttcactttgagtggttactggggggcaaagaattagaaagccactatgtataaaattaaacatttttatttgttcatttctttaaagtacaacttattttccgggagaggaaagtactctcaccaaagaagatttttacagagagaaatcaggtcaacttgaaacttgtttgcaactctctatttgtaacaacctttgtggggttttcataaaaggattttccaagtcttttgtcttcaagaacataaattagaggacactcttaccaggagtacatgcagtttaagtacccaaaaataagtttgtttaccacttagaatcatggagttcaagagaattttcaagtttgcaatcctgggtctctcccagggacattgagagggcagaatcgattctagttttgctaatgcgcctgccaactggtgtcaccatttcccatcacgatatctcagttatcccatctgtcagctctaagagtctttgatgtatttcaacataccatgctttcaggaacctctcggtaccacgttctggtgcttggcagctgtccaggatgaatttgatgtacctctccctgatgcctgccaggagggagttggaggaggggcttaaaggattttctggtaaatccaaatgatcacatatgagctgttatcaatgtgggagaatggaattaggggatagtcttctcattagaattgtgaaaattcaggatggtggaaatactcagtatgaagattttcaggttggctaagtgtatgtgaaatgtcctaatttgaaaaacactttggatttgattgaattagtggtgttaaattagtggggtgtggtgggcatggtgacacggtgctgggcatccttgcatacatgacggatcagaaaaccagcaatccaggcaactctgtggccaatgcggcattttgggtccaagccccttgaccctgtgtctctctccttgcttcatgggaaatcctgccacctggctcagacacaggcctgggggttaaatggagcatgtgctgccaggtactggtcagtgccctcaagggtggagaagacctcttgggaaccacagacaggctgtagggttgtcgtgtttgtctgtttttaagtgacaggctgcttgatctcatcccattagtagtgacgttgctagaggtagagcttgcaaccacccccttcccattaactctaccatcaccacctgccgctaactactgacggctacccaatggccacaaggcacataatattcacggagagccaaagtggcttgcctgtgtcattacagtagctctccttgttaagagtctcttaaccatttccctccttcccacaccccactcttcacacatacatgtacatccctacctgagctagagccctgcttccatccactttcctggccttccccaagctgcctgtgcaaagcctcccttttctgctccctcagcctccggtttcttcctttttctatacctttccccaacaatttcagcctttattaaccttttccttctctaactatcagtcctatcgcttttttgggggggggggcgggaggcaggtgggaggtgtacagctcctcatacttgctgttctgtttatgtatgctctatagcaaactatccccaaatctaacggcttaacacagtaaactgtttccctatcatcactcatgattttgtggatcgggaattccagccggactcagctgggaaattcttttgctcctcgctgtattgaagggggtcgctggatactttcactgggcagatgggtgaactggaggtgattaagatggcttcacatgcctggcgccttggtgggatggctggaaggcatgttcagctgggtgtgtccactggggcttccacacatggtggtctcaaagtagtcagacctctttcaggtagctggcttccacaagagtgagcatttctagagaaaggaagtgtaagtggccaagcctcctaagcctgggcccaggatcctctctgctgtattcggtggttgcacagttatgccgtcctcccagtttttacctagcccccacctctctgtgtgttacaacaaagtctgccaccactattaatcttccacacgtgcctcctccattctcgaatgttcttgaagattatattgctttctccaaacctaaactgtctcataagtttttggcgcttaagacaagtttcaagaaataagaattgaaaagtgttggaggaaagaaagtttccatctctaaccactttctcagaagggcatcagggtttttgcagcaatgtggggatacctcttctgatctcatagcttagggctctgaactaaactgatggccttttctagatttcttcctaggggtgtcaggttggaagtgctgagggactgctctttctccccagggctcagctgtgtcaaggctaagaccaggagtggttcccacagccaggctgggtgagggcaagtttatcctgcggtgcagcacctcagaccagggtctagccaatggtggcctgcaggctgaccccagtccaccacctgtgagcagccaccaccacctgtgtttatactacccatgagctaagcacgattgtcatattttgtttgtttgtttgtttgtttgtgaggcagagtcttgctctgttgcccaggctggaatgcagtggtgcaatctcagctcactgcaacctctgcctcactagttcaaatgatttctggctaatttttgtatttttagtagagatggggtttcaccatgttggccaggctggtctcaaactcctgacctcaagtgatccgcctgcctcagtctcccaaagtgctatgattataggcatgagccactgcacccagccaatttttatatgtttagatgattgggaaatagattttaaaaagaataatatttcatgatacataaaaattataatgacatgcaaatttcagtgtccataaataaagtttctttggaacacagtcatgctcattcgtgtacatggtagctgtggctgctttcacactgtgagagctgggttgagtagttgtgacagcaattattagatgacctgcaaaaccaaaaatacttgctatcttgctctttacagacaagtaacttttttgctgttcttgccaaagaccaaatgcatttttcaaagctggattccaggctcagagttacagcaaagagaacagaaagtatagctcatgattgggtgctgacaggacaagggagagagacgaaaaccattaggagcattagcaacaaatatattttttgccattccaactccatggagcaaatggcttcctaaaagccagcagagaaactaattacctgaactgggagaagaatgaaagactcattgttagaatattcctcagagctgaatcccttctttcagcctactgtattttagtgattcctaataaaagaaaaaaatgtatttttgtcctcacagccaattaatttctgctccaaagcatagaatatgattatttctgtcattattttagtttccagagtcattgatgagacagggaatgacacatacctattaacacactcgcacactcactcacacactcgtgtgggtacatgcatttccctagaagatgtactggaaggatctgactttactttcaggtgccttcatgtcctcgcaattattctacaaatggtttttaagatatttctattgtatttgttgaaattttcctgacattttgacttgtctagacgattattcttgcatccagcacattgtaggaaacactcatttgaaataccccactgtgcttccgggggagctcatctttctggagcatggcgggtccctcatgaggccctctttcgttaaccgaagaacaagctgcagtctgaatgtgagttgttaaaggtatggtattgggagttttctgttctcctgttttcccattctgtaatgttttctttctttctttccttcatttcatttcatttcatttcacttcatagcaacttttgaatgaaaacctccccacagggtttgacaggcaatgaaacttcctcccttgggaggtgtctcagcctgagggaaatggaacagcaccccacagaggattttcctcacttcctccctctctcctttacaaatcaatgttaaagagcctgcatggatgtggttagcaccatctctgccgcatgtgacttttcagtcattttcacccgaaataggatttcattcaccagttactataagctactcgtgccttctaatggactttgcagcagtgattcatccaccctgtgctgggagagagaaagagactttaggtgagaaagaatggttgggagaggggagacaggtaggcagaacagttgtggtaccatcccgccccataagacaataatgatattcagtgttaggcgctttataccaagaaatattccacctgacacattatcctggttgaatcttatgacacatctgcaaatagacattaccaaatacagagggggacttttaggttcagagaggttaagtgacttgcccagtaacacactgctggcaattcgacctgatctctctctttcttccgccttttccatttcagtcagtggcagtgccatctttccacctgcttctgtcaaatgtgttggtgtgatttgatttcttttctgtttctcttgtatcttttaatccagcaataaatccctgctggctctacttgtaagatatacccagaatctattacctccgcccccccaccacccaccttgctccaagcctccatcatctctctcctggagcactgtgatacccttcttcttggtcatcctgcccctgccctgacttccctaaagttgatgcccaacacacaggcagataaaccagatcagacttgtgactgttttcccattctttgggcaatcccattgcattccagataaaagcggaagtccttagagtactgcagtttgcctcctagcccacgttatctctggccttcctttctcactttctccctccattccagccacgttggcttcctgctgtctcttgaatagtcagggcctttgcccatgctactccctctgcttgaagcactcttatcccaggagactgcatgattgagacccttacctccttcatgtctttactgaaatgtttttacagtgaaacctatcttaaatttttttttttttttttttttttttttgagacagagtctctctctggagtgcagtggcacagtctcggctcactgcaacctctgcctcccgggctcaagggattctcctgcctcagcctcccaaatagctgggactacaggcacccaccaccatgcctgattaacttttgcatttttagtagagttggggtttcaccatgctagccaggctggtcttgaactcctgacctctagtgatctgcccaccttggccttcccaaagtgctgggattacaggtgtgagccactgcacccagcctttgtatagctttaatgcatcaaatatgggcttagttcctcatgtaaacaattctcccaggaaattagaggataaaaagttaaaaatagcatatatgtcctgccctcaggaagtttacgttttgaaggggggatacaacaaaaagctagaatttgtagcagcgtacaacacatgccaataaaacttgcaactcaagccctgtgcacagagaaccatttggcagaaattctagagaggcttcctggaggaggtgctagtagaggagaccttgacaaatggggatggatctagatcaaattcccctatgccacgtgctcctctttgcgttcagaatgctcttgtttgcaagatttcagccatgtacaactcttctggcactcagccatggactaaaacgaggttcatgcccacagtattggtctgcagaaaagcatgagactggatgacagtcagaacaaatggaatcctctagggtagggagaagagaaagaaagaggaaataaaacagcataatcccaggaactgccaataggaaaggatgggagaaaggacaactggcaaagactctgatgtggtgtccagcctttcagatgtcacctgaggacgttgctacaattaacatgcagccagacacacacagtgactacacattttggtgtggttggcggcattagttgagtcttaaacaaaagcaatttcagttgcaaatcttgtgccaggctttcagagaaagagaataaattatgctgctgtgacaagctgttccactgtggcaacaatagtttggacttccagtgctgcctgtcaaccaggactgaaaatacatcttcatttgttgctgggcagctgggaagatgagtcattaaagaattttataatacatcaaaggccatgattttctacctttcacgcagttacaccttttcccaagtcctcattctgccacaaaaaacttttgaatgcaccgaaagttaagtagaattccttttaaaatgttctgttctgtgcacatatctctaggggaagtgcagaagacatggggcattcccttttgtcatgcatttcagctccataaagatttattgaccacctactatatgccaagcattatgttagtcagtggggttaaaaagatgagcaaattgtggtcttgaaacccatgccttttgttcagattattacagtgcaagagaagcagcatcagccatgtgtctgagaggccagaggaaggagagagtgaggaaatattgtacctcattaatattgttcctctcgtttcaccactgtattaatctgttctcatgctgccaataaagacatacccaagactgggtaatttataaaggaaagaggtttaatggactctcagttccacatggctggggaggcctcacaatcatggcagaagttgagagaaaagcaaagggacgtcttacatggtggcaggcaagagagcttgtgcaggggaactcccatttataaaaccatcagctctcatgagacttattcgctaccatgagaacagtatggggaaaaccacccccatgattaacttacctcccactgagtccctccacgacacatgggaattatgggagctacaattcaagatgagatttgggtgggcacacagccaaaccatatcaaccactgtagacatgaccaagttcagacttggtcagtagtcaaatgagcctgtgagagaatggtgccacatctttcctgtaagagcacagcattttaacctgcgatggatttgtgagcagtcattccaactctgtattagttttctacagttgctgtaacaaattaccacaagcttaatggcttaaaaccatgtaaatatattatcccacagttctgaagtcagaaatctgaaatagataggctaaaagcaaggggtgacaggctgcattcctttctggaggctctaggggagaatctgtttccttgccttttccaacttctagaggccgctggcattccttggctctttgccccttcccttcttcaaagccagcagcagtagttgagtcctccttaacacagcatcactttttttttttttttttgccttcttcttccacttttaaggactctgtgatggcactggggccactgggataatcgaggataatcttcctattttaagaacagccaattgacaaccttaattctaagcaatcttaattcccttttgccatgtagctgaacatatccaagttctggggattaggatgtggatgtattggggtggggaaattattcttcctaccaccaaccctcatccatctctaaaggcactgatttttttgataaatcagataagtaccagagatgtgtactctgggctcaggagtgaagagggttagctggcctttgccaacagtgacttcatatcaccatactcaatgcaattgaggtgacttaatcaaggggaaaagatggacagcatgttttatggaaatagcacttgcctggtaatcaggagacttggattttagcttctctccttcaaacagactactgagtgtcagtaggcaagttgttgaactgctctgggcctctgtaaaaaatcaaggttgtggttagatgttctcaaatcctctttcatcctctagccttccatggctctcaatttctacagggaatgtactggaaatggagagaggctagcctgtggaaaatgcagtgccattatttcagcatcaaaatcctgaaataagatacagaatgttgtgtaatatacagctcggtgtctgtgcccttttatttctctcttgggcccagccccatcatcctgtccttgatcattgtaatgcagtgttcactaccagtcttttctccccctacattggaaattatgccaaaagagtaatgaatgaattaggtaaatgaattagatgaattagagataaaattatggctctacagttgaaatatcagctttaagagaatcgacttggagaccaggtgcaatggctcacgcctgtaatcccaacacttagggaggccaaggcgggtggatcacctgatgtcaggaatttgagaccagcctggccaacatggcaaaaccccatctctactaaaaatacaaaaaattagcagggcgtggtggcaggtgcctgtaatcccagctacttgggaagctgaggcgggagaatctcttgaacctgggaagctgaggttgcagtgagtggaggttgcagtgagctgaggccgtgccattgcactccagcctcggctacaagggcaaaactccatctcaaaaaaaaaaagaaagaaagaaaattgacttggagatgtacgggttcacatataattgaaagtgagcattccacagtgacttgagaaagttgattccggctttcaaagcttgcattatgggtaagaaacttgagcctaaaaagaacttatatgtatgtgggtcattagacaatctcctccctcaccacctttttttttctttaatcaaagaattatacatatgcaagtaactgaatcacctcttctttcatttttttccctctttaatcacagctgtgtggaaagtttccagctaggcattaaattgggtcaacagctaacacagcataagtgtggacagcaggggcaatcggtggtatatacataggaaataaacgacactgtgctgctggcattgataagctgttgaatagtgcaagggccctattaagatttaaagtaataaaagatgggaggaaatatggttaccagcagctgataaacattcttgccttatgaaggcattagtttcacttaatggcttctagtgcctggagtataagctcttgtaatttttctcccccagagcagactgaaagaatacctaggaattgtcatctttgtagttgctcaagaaagatctttgggtggctgtgagcagatctgaaaatagtaagtatggcaggtacatggagctgcatccgtttgcaaaagctatcaataaagaaaggtatagaaaggatgcccttgaccccggtatgtgcagatagaagtggaatttcctccggaatgtgcatgcaaatgtgcctagctgcaaaagaagaggcattccctgctcaggtgtgtagagtgatttagaaccatttgtttctgctcaatggttctcaaatgaacagtatttcctcactaggaaacagtgctaattccaggctaggacggtccacagagatggtggctgtgcccagatcattcttggaaatctgaggaagggagtcatttcttctcatgccacacccagtaaggggtacattagatactctatttcctccaggcagatctacagtgaccaggaccacgtactaggataggagaggttctggcactattcatcattggctccggaaatagctttcccctctgagctcaaaggtaggctcatcctctgctagagtctattaggtctggtgggattggaactcaggtgcatacccctgggctctccaaccactagtgctgcatccagggcttggggtcctgctttgtgccatcaggtcatcagtgacatgactagggcagctcaacccgcacctctggcatcactgccttcctcccatggccccctagcatgaacccaaagaccacagggccggttccctccttcaggcccaaggctgggcctccaaataatggcctcccaaagatgcccacattcacatgcccagaacctgtgcatatgttaccttatgtggcaaaagagactttgaaaatgtgagtgaattacaatatggagattggcctgggttatctgggtggactcaaagtaatcaataagagggtgacaggagggtcagagtcagagaagaagttgtaatgatagaggcagggagccatgaaccaaacagtgtagacagcctctagagactagaccaagcaaggaagtggattctctcccagggacttcagaaggacctcacccctgccaactcatccgaggacttctgacctccaaaagtataaaataatacatttgtgctgctttaagtcactgagtttgtgataatttgttataacagcagacagaaactaatacagtttatcttattcctttactcatgatcaactactttggggttaacgaacaacagtatatttacttccttcaatgaaacacttacctccacccaccagagtgaaagtttgtcaccctggttccaacaaatgccacaaaccactgtatgatcatctttgggtaggtcagcttgtctgctatggtatttttcttttatattgcagtttacaaagtgctcatttgtcttgtatgatagttatatatggaaggtagcattactatttcacttttctgattttctaaaaaatatctttaatgaacacatattaattttgtgattaaatgacacaataattagaaatgttaaaaggagatggcagttttagtcacttaataaccataatactaacaaattcaggccacatgctatctcagtggatagtccccagaaccaagttaggctagttcatgaggcatttcagatagctgaagggactaagtatacactggaagattgggtacgaagatcaaaagacagctctacaacaaagcttcatgggccattggtttcacagtagggggaactgaaatccaggctacagattcaaaagcttacaacctggcaatttatgtagcatagggaatcaatgtctatagtcttaattacatagaggctaaagcctcaattattctatttctgtaggcaggattcctacataatctatagcatctattggcataaaacattcttagtggccattctgggtacaagcatcccatttctctttctgtccttccacacactaccagtgtctctcgcttatttcctcccaactctaatgttcatatgtgggttatttgagcttctaagttaattccttgcctatatgtaaggaacatattggaaaattataaccaaagtgtagtatatattgcagagtctctacttcccatgagcagctttggagggtacctcacaggagagggttagctggcatctttccattaggaagccagcatcagcacaaggggaaaacttctctccaacgtctagacctctctatcccatgagactttggggactgggactgggtagcagggcagaattgggggaaggaggcacttaagagctttttaatttcaatattctaaccattagtgagggtgtgctgctgggtacatgtctgcccataaataaacatggactgttcattgaaacttgcatttttatgtagaaaagctcatgctaccttatcactttttgcacaaaagttgacacattatgaatgctttaaaaaaaaaattataccttactcccatacactgaacatatctttcctcatctaaaactatccaagcagccaactttttaaaattaatggaaggagagggtctacagcatgtattctcaatgggggcaatgtagccccctaagggagccaaaattggttctgggttgggagtggtgaaaaaagtctttaaaaaaataaattgcagaatatacatgcagcacatagattgatatatatatctgtgatattaaaatttcatatggaggtagttgggaaaaaatgtctaaaaaacctccttagggtgatatttgatatggttttgctgtgtccccacccaactctcatcttgaattgtagctcccataattcccatgtgtggtgggagggacctggtgggagataattgaatcatgggggtggtttcccccatactgttttcgtggtagtgaataagtctcatgagatctgatggttttataagggatttctgctttcacttctcattttccttcttgcctattgccatgtaagatattccttgctcttccaccatgattgtcaggcctccccagccctgtagaactgtgagtcaatcaaaactcttttttctttaataaattacccagtctcagatatgtctttattagcaacatgagaagagactaatacaatattgaaaaaaaaaaagttgagaaacactgatctatagtaaaatttaaatatccaacttctactatttttttggctgtccattcccagtagaatacaagttccatgaaggcagggatatttgtcttttttgtgcactgatttctcctaagtgcctagaatggtgcctgggatgtaggaggtattcaatccatacatattgaattgaatgcatgaatgaacaacttccctcagtgtcccagagtccactttctctcaacactgcaagtggtggcaagctggaaggtttgtgagcagtgctggagctgggctcttccaggtgcattcacaatagtttaaaatagcaggtgcatcagaggaggcctctttgttcctggtactatgctcattgatgtttactatgagccccttgcagactcaagcatccattgtttgccttttaaatatctctactagccgggtgcggtggctcacgcctgtaatcccagcactttgggaggccgaagcgggcggatcatgaggtcaggagatcgagaccatcctggccaacatggtgaaactccctgtctactaaaaatacaaaaaatgagctgggagtggtggcacgtgcctgtaatcccatctcctcaggaggctgaggcagaagaattgcttgaactagggcatcaaaagttgcagtgagccgagatagcaccattgcattccagcctggtgacagagagcgactccatctaaaaaataaaaaaaaaaaattttaaatttaaaaatctctactctccaggccaggtgcagtgagtggctcctgcctataatcctagcactttgggaggccgaggcagtcagattgcttgagttcaggtgtttgagaccagcctggtcgacatggtgaaaccccgtctctaccaaaaatacaaaaattagctagacttggtggtatgcacctgtagtcccagctatttgggaggctgaggcaggagaatctcttgaacccagaaagtggaagttgcagtgagcaaagatcatgccactgcactccagcctggacgacaacgagactatgtctcaaaataataaaataaaataaaataaaaatcctctactgtctacttcccccacccctaatatcctagctatgtggcccaagtacttatttagcccagtccatgaaagtaaaggacagtggacagtgtcctttgataggaggatggggcagaatgggaaaagaaaatggtagggtctggaggtacaagtgggggccagagagaggggctttacagattattcgggtgtttgaaagtcagttggtgttatctttaacatacaaacatgtattatgaatctctgagcatccttcaacgattcctgaattttcaaaacagttgtgtccaaatgacacaccttgtccagaaacaatttggttttgatagaaaaagaggcaaaataaaaacactgatttacaggctcatggtgaggggtttggggaggcagatgagaagagaacctagaaaggatgtcaagagcagacttagctgacctcactttgctttgggcttgctttcctacagacattgacagtgagagttgtttttgctcaccacactgggaatatgtattgcttaggagacacatggcagttaaggcaaacagcacatgccaacaatatgttgcatgatttgatgcctgttttcagggaacttcactaggaagtgtgtgtgtgggtttatatagccacgtacatacatatacatttatatatgttttatatacttagaaataaatacggaatttgttacaggaacgtggccttacacaatcatgggagctggtctgccatcttcattaagccattgtctggtacagatgctggagtttgaagtctgtaggataggaaatcagatgttgtctcagttggcacctgctgcataatacggtaccatagactaggtggcttaaacaacacacatttattctctcatacttccagaggctggaagtccaaaatcagtgtcttgcagggttcggtttctggtgattccccacttcctggctgtgggcagtgccctcttgttgtgtgctcacgtgacctcttctttgtgcacatgtggagagaacaggctctccagtgtcttcacttataaggacactcatcctatccgattgagaccctaccttatcatcgcttaaccttaattacttctgtaaagggcgctatctccaaggacagttatattgggattggggctttaacataagaattttgcagggacatgaattgcagtccatgacagatgtaaactttgagaaacaggaaaaagctggaacctacaagcagaagtgggaacctgtgaggttggactgaaactcagatcagttcttgctgcctctgaccttgatgtatgtatcctggaggagatgctggcatctctcatcatggagctaattgtaggacaggcccagaaatggaagaagctggaagagagtctagtggaaggtggggcagcgtgggcccagctgctgttgcctgccaaagaggtgagcagcagataagtgacgaggtatgtgagctcacacacccaatccactgtggcacttctgccttccagatcctccataagaaggtctctttggcctactctgctcagaaatatataaggcaggagattctgagaaatctagttgagtccagccacgttgacatgctacaaagccaccacagactctaaggagaaattatgtccagggttgggagaagagagccattagctgtacttggatgaacagttagtggcctagaaactgatctagaaagggatctctgttgatgaaaaaggacagtggtgtaaataaaggaagagtgatttggcgatggggtgttggttcagagttaaagacatgagaatgacaaagaaaggacaagggtggcaattgagatagatgcctttattaagtatagggtatagaagtgtagaatagagaagacaaagaaaagcaaaagaactgaatagctagaatgtattaatgcagggcatcaggcatgtggagccagctaaaaagtgagagatcaaacaagattcttagagcaagagaacatcagtaggaactagccacatttatttcacggactcaatgatactgagtttctactactacagggtactgtgtttgatgcacataaaaattattaacatgtattcctgcttatcattattggaggcaggggttgtgaagtcagcatggtccccaccgccacgcccccaccccaggccaaactctaaaggtatttacctgggttttctttcgaaaaaggaagaggtcttattttttttttttatgggagctgagggcagtggataaatttggaaccagacagttgaagtattaccataagcatcagaaaaagtgaataggtttttaaaataatagggaatagagatagaaagcaatcaacaaggcttgttttagaattaaaactctacaaagtaaaagatgtagcctgaatgacccttgaaatcacatgtataatttatagcacctgattccctccaagtcatggtacagaaaatgtatgtctcagctgtgccatgctggccaatctggtctagcctcaggcttgtcacatatgaagtggtgatgacatatttatatcacagaacaattgtgaaaaacaacggctaatgtagttactcaacaaatgtagtgtgcactaaccttatgctaggcactattcccggcactagggacacagaaatgaagagagaaacaatgtcctcattctcgtggaacttgcaaggtagtcagaagagacattttattatttaatctctcactgtctaatatcatagaaatcatacattcacattcatccagagagatagttattattacctttttcacatgctgaaacagaggttacttgtctgagacctcttgctatcaagtgttaaaggtgagactgagtccaggtcttatatgactccatatgcccagcactcttcaaacggccaaatgcctcgtcccacagaaaatagaagcccacagtcctcatatactataaaacttaaatagaatacattatctcatgtggacagatggttatgactttataaactaggaaatcctatgtaggcagatgtttagttgatgaaaagaagtgtaaacatgaccctaatgaatacatgttctgcaagttattggttgctattaatacagagatagttatgctgtattaacggacaaataaggcatatgtagcaagctaaaaagtgagaagtgaaacaagattctttttttttttttttttttttggagacatagtctcgctctgtcatccaggctggggtgcaatggtgcaatctcagctcactgtagcctccgcctcccaggttccagtgattctcctgcctcagcctcctgagtagctgggattacaggtacctgccaccatgcccagctaatttttgtatttttagtagagctggggtttctccatgttggccaggctggtcttgaactgctgacctcaggtgatccgcctacctcggcctcccaaagtgctgggattacaggaatgagccaccatgcctggcctgaaacaattttcttaaggcaagagaaaccactgggaactagccacatgtatttcatgacttcaaatgatactgagtttctactactagaggaatacatgcaatagaggaaataaaagggggtgatgggatcgagtgatggaggagaagatctctttagactggttggtgagggaaggcctctgtgaggagactattgagatatacctgaggaatgggaaggaggcagatctctgaaaatctggaggaagccctttctaggagaaggaacacacaagcaaaggccctaaggcaagaatgagcttggtgtccttggggaacaaaatgaagatcagagtggctggaggttgctgagcaaatgggacctggttaattcatgcatctggaaaggtagaaaggagctagatcctgcaagtccttgcaggccacagtaaggaatctgaattttgttaatatataagacacaaggtattggaagacacaaagtcatcggaagattttaagcgagagtgacaggccattggtattttttaaaaaatcactgtggctgctataaaactatcacttatggagcaactgtaggctttttgctctttttaaagattattgtgcattggatcattcatggatgccagacttgaaatgaacaagatggggaataatggggaacttctggaatatcagtaaaaataaagaagctgctaggatcctggctacagtgtgaacccttgagttgtggcagccgtgagagatggatgtgatggctgtttggtcctgcgagtcacttttctctatcaaatatacttgaccttcatgtgaccctttccatctctttgtgaccaagtaccaagtgataagcgttaattaatttttgggtcactgtgacagatcatcagtgtgctacacttttcaggtaacaggtttccgtgaaccatttgcaatgcccaaattataagaaatcccttaatatctgactctaacagagttgcagtttccaagtctatagcatcccactaacagaggggttggaagacaagatggagccacaaaggtagcagtggcaacccgtccacccctgcttaatgctactcctggtttaagacatgagcccaatttctctttagctggtaggatgacagaaaaagttttaacagcttttttgaggcataattgatattaaaaaggacacatatttcatgtgtacattttgatgagtttggacatatgcaattacctgtgaaactatcatcacaatccagggaataaacatgcctgtcacctccagaagtttccttgtgcccccttgttgtttttgtttgtttgtgtggtagaacacttaacatgatatccaccttcttaacaaattttttaagcgcacaatacagtattgttaattatagggactgtgttgtacaacagatctgtagaactcattcacctttcataactgaaaccttctacttgttcagtaataactccctatctctccctacccccagcccctggcaaccacgattctactctctgcttctatggttttgactattttacaatcctcatataagtgtgaccatgtagtatttgtccttctgtgactggcttatttcacttagcatagtgtcctccaagcttatctatattgtcacgtatttcagaatttccttttttaaggctgaataatattccactgtgtgtatagactatattttctttattctttcatccatcaatgagacacttaggttgtttctatatcttgactattgtgaagaatgctgcaatgaacttgggcgtgcaaatatctcttcaagatcctgatttcagttattttggctatatacccagaagtgggatcactggatcatatgatagtgctatttttaatgtttttaggaatctctgagatggtttggctgtgtccccacccaaacctcatcttgaattgtagctcccctaattcccacaagtagtgggagggacccagtgggagataattgattcatggggatggtttccccatactgttctcatggtagtgaataaatatcatgagatctgatagttttataagaggttttccctttcccttggctctcactctctcttgtctgccaccatgtaagacatgccttttgccttccaccatgattgtgaggcaccccacccccagccatgtggaactgtgtgtccattaaacttctttttctttataaattacccagtctcaggtgtgtctttatcagcagcatgagaatggactaatacagtaaattggcactgcgagggtagggagctattgtaaagatacctgaaaatgtaaaagcaactttgaaaccaagtaacagggagaggctggaagagtttggagggctcagaagaagacaggaaaatgtgggaaagtttggaacttcctagagacttgttgaatggctttgaccaaaatgctgatagtgatatgaaaaatgaagtccagattgaggtgttctcagatggagatgaggaacttgttaggaactggagtaaaagtgactcttgctatgttttagcaaagagactggtggcattttgtccttgccctagagatttgtggaactttgaacttgagggagatgatttagggtatctggcagaagaaattgctaagcagcaaaccattcaagatgtgagtttggtgctgttaaaagcattcagttttgaaagggaaacagagcataaaagttcagaaaatttgcagcctgatgacgcagtagaaaaacccattttctgaggagaaattcaagccggctgcagagatttgcaaaagtaacaaggaaccaaatgttaatcaccaaggcaatggggaaaatgtctccagggcatgtcagataactttgctcccattacaggcccagaggcctaggaggaaaaaatggcccccccacctgctatgtgcagcttagggacttggtgcccggcatcctagccattttagccatggctaaaaggggccaaggtatagctggggccatggcttcagaaggtgcaagccccaagacttggcagcttccacgtgggcacacagaagttaagaattgagttttgggaacttctgcctagatttcagaggatatatggaaactcctggatgtccaggcagaagctttctgtaggggtggggccctcatggagaaccctttgctagggcagtgcagaaggaaaatgtgggattgaagcccccacacagagtccccacaggggcactgcctagggaagttgtcagaagagggccaccatcttccagaccccagaatggtagatccactaacagcttgtatcgtatgcctggaaaagccacaaacactcaaagccagccctgaaagaagctgggaggtaggctgtaccctgcaaagccacaagggtggggctgcccataggaacccacctcttgcatcggcgtgacctgaatgtgagacacagagtcaaaggagatcattttcaagctttaagatttcactgccctgctggattttggacttggatgggacctttagccccctcattttggccaatttctcccatttgggatgggtatatctatccaacgcctgtacccccattgtatctaggaagtaactaacttgcttttgattttacaggctcataggcagaagggacttaccttgtctcagatgagactttggactgtggacttttgagttaatcctgaaatgagttaagactttgggggactatagtgagggcatggttggctttgaaatgtaaggacatgagatttgggaggggccgggggcagaatgatatggtttggctgtgtccccacccaaatctcatcttgaattgtagctcccgtagttcccacatgttgtgggaaggacctggtgggagataattgaatcatgggggcagttcctccatactgttctcatggtagtgaataagtctcatgggatctaatggttttatatgggttttctctttcacttggttctcattctctcgtctgccaccatgtaagatgtcctttttgccttccaccgtcatcatgtggaactgtgagtccattaaacctctttttccttataaattacccagtcttgtgtatgtctttatcagcagcatgaaaatggactaatccaatctccatactgctttccatagcagctacaacattttacattttacatttccactaacagtgtacaagggttccagtttctttacatccttgccagcacttgtctttttgataatagtcatcctaacaggtgtgaggtgatatctcattgtatttttgatgtgcatttctctcatgattggcaatgttgaccaacttttcatatacttgttggccatttttatgtcattttttgagaaatgcctgttcaagtcatttgcccatttttaaatttgtttattttcttgccattgagttgtagtaggagttccttatatctcttaggtattaaacccttgtcagatatgtggtttgtgaatattttatcccatttcataggctgccttttcactctgttgattgtttcctttgctgcacagagctttttaatttgatgtagtcccacttgcctatttttgcttttgttgcctatgtttttggtgtcacatccaagaaatcattgcagagaccaatatcataaagttttgccccatgttttattctaggaattttatagtttcaggtcttacatttaagtctttaacttactttgagttgatttttatatggtataaagtaagcattcaatttcattcttttgcatataagtattcattttttgcagcataatttatcaagggactaacctttctccattgtatattcttggcacgcttgttgaagatcagttgactgtatatgcatgaatttattgctccactgtctcttctgttccattgatctatatgtctgtctttacgccagtaacatactattttgattactctaggttcgttatatattttgaaatcaggaagtgtgatgcatccatttttgttcttctttctcaagattgctttggctttttggggtcttttgtggttccatgagaattttagtattttttttttctatttctgtaaaaaatgcccttgggattttgatggggaaagcatggagcctgtagatcactttgggtagtatagatattttagcaatattgtcttctagtccacaaacacagggtatctttccattttttatgttttctttaatttatttcattgatgttgcctcagtttcagtgaataatcttaaaccttcttggttaagtttatcctaggtattttattctttttgctgctattggaaataggacccctcccctcccctccccttccctcccttctttcactctgttgcccaggctggagtgcagtggcacaatctcggctcactgcaatctccacctctcaggttcaagcaattcttctgcctcagcctcccaagtagctgggattataggcatgtgccaccacacttgcctaatttttgtgtttttagtagagacggggtttcaccatgttggccaggctggtctcaaactcctgacctcaggtgatccacccaccttggcctcccaaagtgctggcctcccaggtgcaaactaccacacctgaccaggattgttttcttaatttccttttcagatagttcagtcttagtacagggaaatgcaactaatttttgtatgttgattttgtttcctgatatttcactgaatttatttattagttctaacagtttttgtgttgagtctttagggtttactgcatataatatcatgtcatctgcaaacagagatattcttacttctttctttcctgtttggatttctttttcttgcctaattgctcggattaggactttcagtagtatgttgaaagtaagtggtgacagtgggcatcattatcttattcttgatcttagaagaaaagcttttatttttcgttagtataatgttaactgcgggattgtcatatgtgaccttttttatttttatttatttttttgagacagagtctcactctgtcacccaggctggagtgcagtggcgtgatctagacttactgcagcctccgcctccccagttcaagtgattctcctgcctcagcctcccaagtagctgggactataggcatgtgccaccatgcctggctaattttttgtatttttagtagagacggagtttcaccatgttggccaggctggtctcaaactcccgacctcaggtgatctgcccgccttggcctcccaaagtgttgggattacaggcatgagccaccacgcccagccaacttttttatattgaggtaaattccttctatacctagtttgttgagagttttatcttggaaggtcagatgctttctctgcatctattgagatgattgtgtgatttttgtccttcattctgttaatgtatattatatcaattgatttgcatatgtcaaactatcatcagatcccagaaataaatcccacttggtcatggtgtatggtacttttaatgtgctatggaattctgttttctagataggtgagactttttacatctatgttcatcagggatattcgcctatagttttcttttcttgtagtgtctttgttttgactttggtgtcaaggtaatactggccttataaaatgagtttggaagtgctttctctccttcagttatttttttaagactttgggaaggattggtgttttaaaaaaatatttggtagaatttgccagtgaatccataatggaaatattgtatataggtaatttagtaagtcaagaattgtccctcaaaaggtactagaaaactcagttcttacttttaagactcttctaattatcctggtggaatggcttctggaatatcaccataatactgaaatttactccataatactactgaatggaagggatccagtgctggaaactttacatttgaccaggtgcagccctcaatactaggacagtttggctagggggctacccccacaggtagcagggaagaaggctgcattggtttgactgggatggaagaagaataagctaagtagtctgtcagagtttgccaggttaaagaggaaagatgatagcacaggctggagggaggtcaaagtcacattctggggaaactagatgtatgttgaccagtaggggcaagcctagtatggaatggtgggtgacagtgaacattgagggccaatgagatttagagaatgaattgaggagtgaggcttaggggaaagaaggccgggcacattagaaggctcagaggtctaagaagcatgaggaagattgtcctccagagagctgtccccttgaaggaggtgcgttggcatgatcttgtcatgaatttctcaccctgtcagaaacatcttatgtagattttttaaagggcaacagttttcctgctcactctgagtacctgaaccttgattctaagacttaggtaaggttcacttggcctggatgtttataaatgccagtaccaaggggagtccttgaaatggcatagaagatggcaaagggctctgcagagccacgaaacccaaatttagaaatgagaattactaacaatgcatatacaacatgtctacaataaactagaaaggatgatatagtttctgataacagtctttgaactttccctacctatgaaatggtattaacccttaatcagcagctcaggaaatagtccacggtagatcctcatctttgtatttcctttactgtctggttacttactgaaaagtggtagctgaggccgtatctcctaacctgcatgctctccctctctattttctttgtctcccatgttctccctacaaagttagcattcattcattcattcttattttctttctttctctctctctctctctctcactctctctccccctccccgttttcctgtggtattgaaagcttattgtcaggatgagccccttattgcttggaacccaatctgtgtccatgaattgcccatttcacagaatcacgaaagccacgctgcttcctgagcaacacagctaagtggcattccccacccctgctcttagcaaaagttcctcaggacattattgttgaattactcaatgcctattatcatagaacctcatgttcacgctgggaggtagttactactacctttttcaaatgctgaaacacaggttacctgcccgatacctctctgctatcaaatgtcaaaggtgaaattcagcccaggtcttctgactctacatccagcattctttatagagctaaatctctcttcccacagaagatagaagcccacagttctcacatacttacaaaacttaaatagagtacattatctcatgtggacaggtggttatgactttataaactaagaaaatctaggcagatgtttagtcaatgtcaagaagtgtaaacatgaccctaattaatggatttgctgaaagttattggtctctccttgtcagaactgttgttttccctgtcacttctcagattggattagaaaaaattaagcatgaagaaaattggcatttaaaatgtgtttattcttcactatcaagacagatagaactttccattcaaaagagaatgaaaagttcattttggcatggtgaatcataaataagaaaaacagaatagagaaatcctaggacgatcaatctctcataaaataaagaaatcgagattttatcgcaaagaattctgcagcacataaaggcccttaggactggactgatctccgagttcaagcgttacacccagtatgctgcataaaccctattcagtgtttgggctcattctcaagaggttgacatccttcccattttcatatcacctccctggtccacctttgctaggtcacaggtttttcaggcactttgcattctgccctccctcctctcaaaagacttcccggcatgttttcgatagcttcacacctagcagatggcagtttttcttctgaccttctgccagccctcttccttcctcagcttccttcctctccacagcttccatttaaggtattttggaagtccctcgaaatgggtccttggtgagtaaacccctttattgagtctcggactttaagaagttcttggcttcatgggacccccttcttctagttgacacttttggggattgatttcaagaatcatctgttgctgataagtcagtgtggcttctattgctgcagaagcaaggaagaaactaggcatatagtggaagaaaatgcgcttaattagaaactggtcctcattagggattcttaaaggaagtgctcaatttgcacctatgttagcagagcctcacacggattaattaaaagctgctactctcaccagcaacacccttcatggctgggttgaattgtttgtagctgtcaactctgtgccaagggcaacaaggtttgaatctgagttctttgaaatgcaggttctttcactcactatgcagaatctagggatccagactctcaagaggcaaagctctggaagaacaggtggagtgagtatccctctggcttctgctcccgccagatgatcaccatgcctctcaactctacactcttttccctgcctgtgctccagttcacactctccacatccctggggccaggctatacctagatccttctgcttgatctctcaggctccgatgtttcaactcgtcattccctaggctattaacttcaagcccttagatggcattcaagctccttggtgacctctctgcgtccgtctccatccccatctgcttccgtgagcttcataggcaagccactctccatagttatatgtccctcaaatacccagcatccccatgccatcatttcaaccagactgtcctttttcttttcccacctaaggaaattctattagttcttcatggctgggttcaaatccacctccttcactctccaggaagactacattattcttttcctaacactcctgaagtgcttgtcctctacagcattgctgcacatattttgttctgttctttattacactagtccatatggctttactccctgctgaatttaaactcttcaagggcttgatctctgtcttattcatctctgtaacctcacagtacctaatcaagttctttgaacaaagccagtgttgaaaagtgtttgttgaattgagaacagcaagccagactttctgatgggctagaaagatatacctagaaagatagagcagagtagcatttctaaagatggaaaggacaagcctggctaaaatcatgctcaaagaaaggttttcttttagggtcctcatcacatcacaatagcaaatttttaaaaaaagaaagggccgagcacgtcagtatagttaccgagcgtacttgtgtactgggcaaagtactgagcgcaatagaaagttactaaaagaaagaacagatgctttttctcctttagagctggtcccttttcaaaataaggcctcaaagtgcatcccattattaaccctgaaatagtgggacacaaacgtccagatagatatgtgcatgccaatacgtgtttaaaaatctggcgtcacacagcacactccagaggaagccaagcctaagagacatgaacacagtaacacggtagggagccgtgtgatccagactgtcctaagcagaagaggccccgggtggagaattctcacactgacagccgcagagcctgccttccccagtgtactggttttcccagggcatcaaacattttatttaataagctacatgtttgagtcacaagcgtagacttgacacccctgtatggtcaactccagctgtcgtttgttctcctcccctctcttctggcacagtggctggaacctgtatctggtgtatcacaacgctccatttcgctgatcacacacagccagaagtgacagtcgcttctctcactgccaaggacagaggagactctggctggacaggagaaattcaggtcgaaccaaggcaagtgaacgatggaattaaaaacggctgagaaatcccatagacttagaattactcatatctgcagactagagggaaatgagttggtcctgatgacaaaacaaccctttcttttctctagtctgttaaacttctattttcccgtcagactgttttaacaatgccctctactgggtattttcaaaactgcagggttctgcaggcctgacctgctcttgttctccttgagtaattctttctgcaagatgaactgaacccaaagttttcttcacataagcaagatgttactgatgtatagtttcttaagagcataaaaagtggaccagtgcatcccctggaaggagggcctcttgccctcttgagagatttctttgtaaaggtgcatgaggaattgaaatctcaccacctcctgaactggcccagagctgtcctggcatggatgacacagggaccttgacatgggctgatggattaagaacaatgttacattttctgaacgcatcacttttccaacagctcttgatctcacatgtgaggctctttctcatccctgaaggctactgacttttccctggatatatttgtattgtgattattctgcatatctaagaatttcatccctttctaaccgctcctctgccaaaacagaaaccaaaaaaagccaaaacatcactctgtgctagttagtttctttgacccctcttaaagaaactctaaacaaaaaatctgcgtccagttatatccaagggggtgttcttactgggtattcccgtcagaacctcccatctgtctattttggttcattctttgccattatcatgtaacaagttcaagataattgtgtttcatctccagttattattcatagtccctctgcatgttgaagattgctgagacagcacagaaaaatagtaaagcaacagatgaggtctgtttgcaaaaaatgtagaacaattcgaggtgcaggatgttcttcaaattgtgatggggtgaggttttgaaaagttcttcggatgggctagtgtttgttttctctctccctctccctctcttcccccctcccctttccgctttcccacttcctctctcctccttccttcctccccatccatttctcttaaatagaaacaaaattccatatattcttagaatccataggatccatatattcttagaatccataggatccagcattgcattttatttaaaagcaaatgccgaccaagtagtcagtagcaccctttcagctccaatagttggtgctatattctgtactcagcagtagactcatttcattattttggagtatggacctgaagaaaatgaatatcagacatgggctaagccaaggccagttaataaatattttaggctttgcaaaccgtatagtctctgtagcaactattcaactctgctcttatagcaccaaagtagccacaaataatagtaaacaaatgggcatggctctgttctagtaaacttacttgtggaaacgggacaggctgaatttggcccacagaccctcgtttgccaatccctgggctaagctattgcaggggtactgctgatggatatgcgggctgtgtcctgtgtgacagtgcctagccaagggggcaagtgggacctgaaatacaacccatgctctgcttctccacgccttccaccacaagaggtcctttttgtaattcagacagaggtaccatttgttcacaggctgtctccaaccagaataagcacatttcctaatggattagggtacttaacatggtttgcataagtgggaggaagagggacctgattttcctgtattaggataagggttacctttgatcccaatggctgttattgaaatgactaaagccacatggttcaaacatggctgccttagcccacatctacagactgggagtaggtggtgggagcaattccaacagagatgtagactgggaaagtgccccaggtaagaggaaccccaaagaaggtgagtttattggttagggggcttgttggatattattaccaaagccatagtccctttatgaagtttgttctgtccaaaaatgtgatttaggccactgtatgagtccattctcacattgctgtaaagaaatacctaatgctgggtaatttataaagaaacgaggtttaattgggctcatgttgctggaggctgtgcaggaagcatggtggcatctgcttggcttctggggaggccttgggaaaacttagaatggtggctgaaggtgaaaggaggagcagcacttcacatggccagggcaggagggagggagagaggggagctatcacacactgttaaagaaccagatctcgtgagaactctatcatgagaacagcaccaaaggggtggtgctaaaccgttcacgaaggatccaccactatgatccaatcacctcttaccaggccctatctccaacatgggggattacaactaaaatgagatttgggtggggacacatatccaaaccatagcagccaccactctccatcttagaatggtagaataataaaattaggaggaaacttggtatgcttttgcatgcattttaacatcagaaccctttgttcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaccctttgttcaaataaaatcttatctagaactccagtatacgcaactgtgaaaaagggagagtgctctggtgcagctggagaggaaagacaaggagtgccctcagtaaccccctccccagatccggctggcccagagagagctgctgagactcccccaggacccagtttggagccactgatctcatcactgcataggagggagagagagaggggagatatgaaacaacggaggcaaaatgaaataaaataatcttaggtgacaacattttttaccaggttttgttggtataaaacaccctttccttttcagttcccctacctgaaagtctttggttgcttatatatatttaggatgtttttatatagggtaatatagaattgtaaggcttaatataatattaatatttgacattctattggatttaagcagccagtgggaagagagtaaataaaaataactacacaaaggaaactgctattagcgtttgttaccatgtgaatgaaatagcacatcagctgtgcatttaaagatctggatagaagtttgtttcagttatttgtttgttttgaggtacatttacatacagtgaaatacatagcttttaagtacacagtttgatctgtgttgactatacttacgtaacccacagctctaccaaaatcaacaacatttccatcatgcgggaaagttctcttattccccttcccaataaatctttcccacccagaagcaatcacagatgtgatgtctatcaccacacttggttctattctaggactttgtataaatggaatcataccatatgtactcttttgtgtctactttgtttcacttagcataatatttttgagatttatccatgttgcagcatatggccatacctttttcctttttatgcctgagtagtgttccattgtgtgaatgaatatgccagtttatccattctcctgtttatggacacttggaatgtctaaaagctgccatgaaaagccttgttcaaggctttttgtggacatatattctcatttctctaggataaatgcctaggagtagaattgctgagtgataagagtgatgcatatcttttaagaaaaaaactatcagagttttcacaattatccattttacacatccatgcaatatatgagcattctgattgttccacatccttgccaacacttaatattatcagcctttaaaatttcagctattctatttggtgtgtttctcatgtagttttaatttgcatttctctgtaataatgttgattgccttttctaagtgcttattggctattcacctatcttttgtcaaatgtctattcagatgtttgccctttaaaaaattgtgttgtctttttattgttaaattgtaggagttctttgtaagatacaggtctgggaaatattttctcccaatctgtagtttgcttattttattgagattgtcttttgataatgagttttaaattttgcagttaaatttatggatatttttctcttatggttattgcgttctgtgtttgaaggaatcttgccttcctcaaagtcacaaagatttatcttatattttcttctagaatatttatacttttaagttatacatttatgtctatgattcatcttgagttaatttttatatacaatatgtggtaagattcaaagttcttttctttttccacatggctatctagtcattccagctcaatttcttgaaaagatgtttctttttcaattgaattgctttgatatctttgttgaaattgatttggccatatatatgtagggctacttttgggctttcagttttatttcattgttctgtttctattttatttcactaaaaccacactcttgatttgtatgtttatagttaatcatgaaattagatagagtaagtccttcaactttgttcttctatttcaagaatgtttgggctattctaggtcctttgcatttctgtataaattttagaatcagcttatcgatttctacaaaacgtcttcagaaattttaattgagatctattaagtcattagataaacttgaaaagaaccaacatcttaagaatattgagttttctaatccttaaacatggtatatattattattattattattttttttttatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtggtattccccttcatgtgtccaggtgatctcattgttcaattcccacctatgagtgagaatatacggtgtttggttttttgttcttgcgatagtttactgagaatgatgatttccagggacatggatgaaattggaaatcatcattctcggtatatattatttatttagatcttctttaatttctctcaacagtattttgaggttttcagtatatatctcacatacctttcattaaaattattcctaagtactttctgttttgggaagctattttaaatagtattttaacatgttacattgatgaattctttatgtagaaggtttttttttgaagattatagaattttatgtatctaccaggtttgctaatttgttttagtttatttatatctttgattaattatagccttgtaaaatattacttaatattacatactggtcatttcctgttctgtcttgcagatgattttatagctgacatcggtcaagaactacattatggtgggataaaattttaatttactagagtattatagtgagggaagttttttctttcttatggagagtttttattatgaatgctttttaaaatgctttttctgcatctatttagatggccatttggtttttctccttttaatctattaatatgttgaattatattgactaattttaggatgttaaacagcctttcattccagggttaaacttcacttggccgtgatatattattattattatgtatgtgtggatacatttgagtttttaatgttttgctaatgatttttgtgtttgtgttaatgagagatattgtcattaatgttcttttttttttttttttttttttttccccccctctgagacagagtctcgctctgtcgcccaggctggagtgcaatggtgccatctcagctcactgcaagctccgcctcccgggttcaccccattctcctgcctcagcctcccgagtagctgggactacaggcacccaccatgacatccggctaatttttttgtatttttagtagagacggggtttcaccgtgttagccaggatggtctccatctcctgacctcgtggtccacccgcctcggcctcccagagtgctgggattacaggcgtgagccactgtgcctggccctaatgtttttataacttgcttgtttcagtgtctgggcaacactggccttttaaataattggaaatgttctctcctctgtttctcagagaatttgtggaggattttactattttctttctcaaacatttagtagaatttgccagggaacctctccaggttgggagagttctttgtgggaagtttgtatttatgagtgaaatttctttaattgacacagggctattcaatttttctatttcttcttgggtaattttgttcttttcagtctttgaaggaatttgttcatttcctgtaagttgttaaatttattggcataaatttgttcatacaatttccatattaccttttattgtgtctttgtaggtttttatggtagcatctttatagagatataactcacatataacacagtttaccatttgatgtatacaatccagtgtttttaaagagatttagctatacagctaattttagaacatttttatcaccctaacaagaaatcgtggtgccataccagtccttcccaccctatttacccagccttaggctaccactcctctcttttcagtctttgtagatttgcctattccagactttttatataaatgagataatataataagtggtcttttgagactggcttctgtcacttagaataatgtttttaaggtttactatgctgctgttaacattcatgtacaaatgtttgtgtgaacacacatttttatttctcttgggaatatacctaggggaagaatttctggatcataacgtaactctatatttaagcttctgaggaactgatggactgttttccaaaataactgcaccattttagactttcaccagcagtgcaggaggatttcaatttctctgcatccttgctaacacttggtgtcatctatcttttttattacagccatcctagtgggtgtgaagtagaaactcattttgctttggatttgcatttccctgatggctaatgatgttgagcatcttcccatgtgcttgatggccatgtgtatgtatctttcttggggaaatatccattcagccttgttatcctttaatgactgtagaatctatagcaatatcccttctcactttcctgatatcagtaatcttcatttctctcgtttttttcttaatgagtctaaataggagtttataaattttattagctctttaaagtgccgacttttggttttatcatttttctcttttgtttgttaattttatatttcatttctcctttttactacttcattcttttacttaccctgagtttaatttgctcctcagattatttagatcaaggatctaaatttctaccttaagaaactagctttttctagcatatgatctatcctagtcaacataccatgtgaacttgaaaagatcgatgtattgatagtagcttttactttttctctatcttttttttttctgatactattgattgcttagaagaactgctttaacatagatttccaaactctatacccataaaactggaataggttacactatacccaatttatagataaaaaaatgaaacttgaggctcagaaaggtgaaatagattgctggtctgaaacttacctagagatgaaagttaggtagactccactgcttaggttggaagaatatgcagacaggaaaccagtgggaaggggacagtacaatgtacctgcagacctgattattccagtatagcaaaagcattctgtctcagcctgtcacactttgataagatatatttgggggaatatcatgagtttttggcttatttgttaaacacctggatttttatggtctaactttagttgttgactaagcaaagtatttgttgactaatgtgactgagttgtgaaacgtctcgaaatggcatttcaattgtcagtgaagggggtggcatagacatatgattccttcatatccactcaactgagtctggcgtctccttgaatgcaggcatgcggaatgtccatgtgcctggcatcttggcggtggtcagtaaatgtttgtcaaaaggagctgaagtgtataccgtttctttgacttcttctgtgagtcaagcaccaggttcatctgagtgaaaaaatgcaatgtggatgagactgtgatgtgtcctgtacactgaaagagatcttgatcgttactaaatgggtattaaatgaggcagtgtggccatgacagaaatatgcaagaataaaagaagtgttgtagttcgcagaactttagagggggaaaatatgatttatttattacttgtggaatctcttgatttgatacactggtggaacatagcattatagtcaaagcagcagtgatagcttggcttgtgtgaaaacaaggtaggatttgtaataccatctgatattcttctccgagtttcagattcagaaagaacagtatcaacatgtaccgagcaggggaaacaatataggaaagatataaaagaaaatatgcaatccttgaccaatgtaaataaatgggaacttttgatttatttgtcatgtactcagattgatgggtttcgtagtgaagtaaatgtgtgtgcatccctggttcaggagagagtgttttgtgtatcattctagactactccagactgacatttcaaagcaacgtatcatcagtgaagtatgtatttatcgttagctcttgaaggatttttttttttagttgatagagtcatgtcttagtttctcaatgtggagaagctaaaactgtgatcctgtttctcattttctctctcaccacataggaaactatcctggtcagaagctaccccttggttgtatcagtttgctagggctgtcacaacgaagtaccacaaactgagtcacctaaacagaaatttgcaatctcagttctggaggccaaaagttcaagactgggatattggcagtgttggctcctaccaagagctgccaagaagaatctgtgccacacctcttccttagcatatgttgttggctgacaagctttggcattccttggcttgtagaagcatctctcccacctctgccctcatcttcacgtggtgttctacctgttgtatgtctccaagtccactcacactggattagggacccacactactccaggacaaccttaattaattacatttgcagaagccctacttcaaataaggtcacattttgaagcactgggggtggggacttcaatatatgaattttgggggacatgataacatgctgcttataggtggaaaataatttctacatatttattaataaggaacctctaagatgaacagatttggaaatctagtttatcttcagtttgttctaagcatctgtgtgacctggaataaattacttcattatcccaacctcagcttcttcatctgcaaggtggaagaggtgatacttgctctcctatgttatagagtcgtagtcaattataacaatagctgctgccatttattgagtggtaataagagccggcactatcacaagagtggacaccttttacaggctaggaaacagtggcacaaagaagtaaagtaatttgcccatagccaattaagtggcggagccaagattcgaacccaagaagaatggctacagtgccaactctttcaaccagggaaccaggagagcatcactatataaattctgtgtaaagtgcaagacacaatgcaaaagttcgttgtcactaaaaggagaactcagggcaaagtcttgtccttcccacttctaattctttttttcctactccagtgtttatcaaacttttcccccttttagaatacttattggaaacccatacaaaactcatatctcctctgatgtttttgaaatttcagaacctgcatcattattgaagtaaatccaagcaatcagaatttgaaaatctagctttccaaacggcctcagaggcccccaacacacacatacacatacacacacacacacacacacacacggacacataacacacagtgtgttaactcagtccttcctgccttcagtttctgtggtacagccatgatatggcttggctgtccccagccagatctcatcttgaattgtagctcccataattcccacatgtggtgggagggacccagtgggaggtaattgaatcatgggggtggatttttcccatgctgttctcgtgatagtgaataagtctcacaagatccgatggttttagaaagggctgttcccctgtacgtgctctcttccctgccgccatgtaagacatgcctttgctcctcctttgccttctgccatgattgtgagggctccccagctatgtggaacagtgagtccattaaacctctttttatgtctttattagcagcatgagaacagactaatacaagccataaaaggccaagatcatcattcctttacctacattctttttttgttatttgcccttgcttttcatcatgcaccacatcatttatgtaactaaaaataccaacttccaggccaggtgtggtggctcacgcttgtaatcccagcactttgggaggcggatgcgggtgggtcacctgaggtcaggagttcaagaccagcctggccaacatggtgaaaccccatctctactaaaaatacagaaattagccaggagtgatggcatgtgcctataatcccagctactcaggaggctgaggcaggagaattgcttgaacccaggaggtggaggttgcagtgagctgagattgtgccattgcactccagcctgggcaagagtgagactctgtctcaaagcaaaacaaaaacaaacaaacaaatgaaaaaccagcttcccttagattcccccatgagtttctgactccactacctaattcaataaaggcatttttaagaaatataaatcatatttattcatggttatatgtacatgatacaaaacatttcacagcagaaatggactcttttttaccccatcctcaatcaactaatttccttccctataaaaatctattatttgttttgtgttgtgtgtttcagccagagatactctatgcatgatgcaaacatattagcatccatatgctactttcatctaaaaagtagcatactctccacagtattctaaacctcttctttcacctattaagatatcatttctctattgtaagacttaaaatttaatgtagtgcctttgagcccaaaagtcttgagtttccctacttctaccagatattccccccaaccttcccaaagagaaaggctccctacttaaatggttcctctatcatctgggcctgctgggccgtacccattcctcaacctaacaggtttcacctcccggccagcccatgacattagtcacatcctcctgtaggaacctgaggacacctctcccccttgttactacatagccggcctcccacagcccttgtggtttgctctgctgtggactgtagcccctgtatggtgaacagtgtcctcctcccccaggctgcaagtgtatgtgactagtaaaccacgatctgtctcttttaagtggtgtggggtgttgtttgtctgaccttctcatattatttagggcagaggatccacctttaccaactgggtgaataggaggtgattagaactagtccatattaccacatagagcaatcctttgcttttcctaataagtgcacagaactctatagtatgaataggaaccaatttacttatcttgttccctgttggtagacactgggtttttactctttggttccacagcaatgctctagtgaattttctattccacattttgcatctgaagtcatcttgcatctgaaggagtaaattattacaagtaaagtatgggtcaaatgctatgcacattaaattttaataaacattggccaggcgcagtggctcacacctgtaattccagcactttgggaggccaaggcgggagtggatcacctgaggtcaggagttcgagaccagcctgaccaatatggtaaaaccccatctctattaaaaatacaaaaattagctgggcgtggtggcatgtgtctgtggtcccaggctactcgggaggttgagacaggagaactgcttgaacccaggaggtagaggttgccatgagttgagatcgtgaaactgcactccaggctgggcacagagcgagattctgtctcaaaaaaataaaataaaaaaattaataaacattgccaattgcttttcatagaatgtgtaccaatttagacccccacaggcagctggacagtctatttccccacatcctcatcaacccaggacattaccaaactttctgatcttggccaaggggagaggtgaaaaatgtcaagtccttgtggttttagtttacagttttacaagaagtgagggcaagtgtcttttcatatgcttacaagtcatttgtatttctggcctttctcttattgactcgaggaagcttttcctttattgaataaattaccactttttctatgatatgaagttgaaatatcacttatcatttgtctttgtttatagtaggttttgctgcctagatttgtattttatgttatcacatttaccttcttttgtggattctagtgttggggttacatatagatgcatcttctccagtctgtgtaggagaatctcattttattgtgcgttctttgttgtgattcacagatatcacatttttttacaaattgaaggtttatggcaactctccattgagcaagtctatcagtgccattttcccaaaagcatgtgtttactccatatctgtgtgtcatattttggtaattctcaaaatatttcaaactttgtcattatcattttttcttttatggtgatctgtgatcagtgttgtttatgttgctattataattgctttggggcaccatgaaccacacctgtataagatggagaacttaataaatgttgtatgtgtactgactgttccaccaactggccattgcacatctctctccctctcttcaggcttctttattccctgagacacagcaatattgaaattagaccaattcataaccctacaatggcttctaagtgttcaagtgaaaggaagagtcatacatctctcactttaagttaaaagctagaaatgactaagcttggtgaggaaagcatgtcaaaagctgagacaggccaaaagctagacctcttgggcaaaataattagccaagttgtgaatgcaaaggaaaagttattgaagaaaattgaaagtgctactccagtgaaaacaggaatgataagaaagcaaaacagccttatcgctgatatggagaaaattttaaaaggtcaatgcctggcttcaaaagacaggctgactctcttgttaggggatagtgcagctggtgaagccaatgctcatttaccattccaaaaatcatacagcctctaagaatgacgctaaatctactctgcctgtgccctaaaaatggaacaacgaagcccagatctgtttacagaaggatttattgaatattttaagaccactgttgagacctactgctcaaaaacaaagattcctctcaaaatattgatgctcactgacaatgcacctcatcacacaagagccttatgaagatgtacaagaatgtgtaatacaaggcatgttgttttcatgcctgctaacacaatatccattctatagccctggagcaaagagtaattttgatttccaagtcttattatttaagaaatatactttgtgaggctatagctcccatagataaggattcctcttggatctgagcaaagtaaattgaaacactcctggaaaggattaacagttccagatgccattaagaacagttttgatttctgggaggaggccaaaatttcaacattaactgtagtttagaagcaattgattccaaccttcatggatgactttggaggggttcaagacttcagtggaggaagtcactgcaaatgaggtggaaatagcaaaagaactagaattagaagcagagcctgaagatgtgactgaactgctgtgatctcatgataaaatttaaacaaatgaaaagttgttccttatggatgagtaaagaaagtggtttcttgagatggaatatgctcctggtgaaaatgctatgaacattgttgaaatgacaacaaagtatttagaatattacataaagttagttgataaggcagcagcagggtttgagagattgattccaattttgaaagaatttttgtgtgcatgtggaggtaaaatgctaccaaacagcattgcatgctacagagacttatttcatgaaaggaagaatcagttaatgtagcaaacatcattgtggtcttattttaagaaattgtcacagccaccccaaccttcagcaaccattatcctcatcagtcagcagccatcaacatcaaggcaaaacctcccaccagcaaaaagattacaacttgctgaaggctcagatgatccttagcatttttagccataaagtattttaaaataaggtatatacattgttttttagacataatgctattgcacactcaatcaactacagtataaacataattttatatgtgctgggaaaccaaaaaattcatgtgacttgctttattttgatatttgctttattgtggtggtctgaaactgaatgcacagtatttctgaggtatgcctatagttgcattaaaaaaaattctcctgatgttattgtcaagattttaatggcttcacttttacatttaaatatttgattcatctggaatctatgctgatataaggtatgagataaagatctataatttgtttttacagttgattatttgacaataattcttttttccattaacatacaatgtcatatttatcaaatactgagagactgtttctgatctgtgttctgttccatggatctgtctcttcatgcacaaaaatgagaatgttttaattattatatatttaaaatgttttaatattgattattatgtatatttgtcttttccttattcttgtttattttgttttccaaatgaactttaaaatcatcttgcctatgactccatgaaaaaattatattgctgtttttggattcttgaaaattcatatactaaagtaagaagaattgaatctttaaaatgacaaattttccaatcaaagactgtgacatgcatgttatttctttaaaggtcttcatgccctgatagtgttttagagtttagtttatatagctcttccacatgtctcattacatttattcctaggtatttaaatagtagtctttccttcctttgagactttctgactagtggtaatttacaaatattaaggctgctgatttctagatatgagcttcccccagccatctaattaaatgttttattattctaattttccaggtgtacagtgatatcatctttaaatatgatgattttacttcccttgcttcaatttttgtagtccttacgtctttctcttgtttattttgggttggccttcagaacgatgctgagtaaaggataaaggatgtcttcatcttattcttgattttaacaaaaatgcttctgtagttcccctaccgcaaatattgagtatccatgatgttctaggcaccaggatgtagcaaatacaactgtccttcaggactcaactcaaatccaccttcttccaaagccccctgtgatcatctcaaacagaaattgtctttgcctcctccaaacttcatattttccttccctttactgtcctactttttatcttgctttagaattatcagtatacttgtcttaaatagtccactaaaaatcggtatgctcagagaaggcaggatctttgacaaatcatctagtcatcctcagaactctgccttgcccacagcaaatgctcaacacagtcctgcttaattaattataaattagttagtatgaaaatttgttcaaatatatttgagcaaatactaagtaagcatctgctcagataaaaatgcaggattctcatacagagcacttggccatgagtaataaatgtaagtccggctctcaaaatatacatgtattcctatttggcactagccaaaagggggtgcaatatttacctttaaattattatagagagaatgagctagaaaggaaaaagccagttggagccagaaagcttggagtctttgaacctccctcagttctctaaatctagatgaaatgatatgaatcatcaagtcatttcatgccttttacacttcactttaggatctttttctctaaaaagcctctctcaacagggataatagggtgagtggccttagtatcagtgtttggtttctttgcgatgtgtaattggttttagctagtgtggaatgtcctcttgattttaaattcctatttttagctcctctgtatattgtgttatgtgttcactgttgctccccacacccctccttgcaagtctatacagaagcatttcatgtggaaccggagctgttctagggaagcctgtcatcaaggctgccctttgctctgcacctccccagcaccctcagaggtcagagcgaggctggtgtacagggcagtggatgtgagagcttgaatttcttgccaccttgttacaagccaaagtaggaagaaagtgtatccagaccaggaaacatgatttgtaatcgtggttgcaaatctagcaccctaaacctagcacaccatttggcacatactcggctcttaaatgtccatttaatgcatgaatgactaagcagataagtgagtgagtggatacatatgtgtcttattgggagacggctcatgaactgacattcaccatgggcttttctaagtttttcagtgggatcaatgttggtagtttgtatatttgcacttggtttagaaaactttcctttacctaatcctcaggcgatactgtgaactttgggttgcttacttgataaatatagttttattattaattcatgcatttgaaataacacatgcattgaaagcagcagcaaatccttttaagctctgtgctcttttaaataggttctttctctcatgctcaggaaaaaattcagtggagatgatggcaacagactggtccctcaaatctctggccatagcccaaggaggagagaacccacaattgcaggccatatgtattgccctgtatgatcagtattaaactcaaagtatgtctttgtaactagagacatattctgggtagtgtggctgttagtttgtcccaatctttattttaaggcactatccacatctctttctcttttcctttgcccctaacattgatatcaactgagttttcagggtgccagctgcccatgtcagctctttgagagagcagcctctctcctccttctgcctctcaatcctttcctctccgccagctcttctcggcatgttggtcattcattattgatgaccctccagcaccttctccaccccggtgttcccatagccctgtgcactgctgagcagagccaggtgcaggatctagtcggggtccaggactgctgctccaaggccgccaagactctttcccttcctggctgtcagagaggatgcctggcactagagatacagcagcagcggcgtcagccgctggtcttgaggagggtttgtttctctcctctgtcttctaggaagcaaaaggttaaactgttcattttaagagcctccctgggtataaaatactgagctttgtctttctggagtgagccgattcctaggccccttgacctttgctccaacatgtctgctgcccatcccttagagtgtttttctttgctttctatttagtcagaaggaatgaggctagtgtctgccgttagcttaattattggggaaaagcgttggaagaaaagaaactgattctctccatttttctaattgttacttaaccaagtcttgacaagatacaatttggtggctaatatgcatggagtgccctttctgaaagcagaggctctgcttgtggattctgcagtgaaggctggagtcacaccttggaaatgactgtccaccttcacatttgcacacatcacttacacacatggagctccttccaccaccagcctcccctgagccttcataagacacaggctgctgctttaaggaacattaacaatccagacccttccagggacccatgtgactccagcttctcccacaatagtcagaaatcgtaattgagagttcagaattcataggtaccaggataatattgcagaaagataatcaggcacctacttcccagttccctgaaattaaaacaggtattcatcttgtcagaataagaaaacagggtcctgctgtgttccagccacctggcaaccttgttcttagaatacagaaagggagggaagcaatgtgtgcgatcactctagccgaagaatgtagagagaagcgaagaccatttttttagtcctaatttcctacaagggacaatgcacctaaagtttttcaagccttgctcagaatcatctcacaaaaggaaaggccctttgcttcacaaaatattttaatgaaagcaaaacagtgactaagagcctcatgtactgctggttctgcctgtttcaaatcttgaaaggcctttaataacctccattatgtgactatgtgatttttatcacacaatctcagattcttacattttttaaataactcaccagcaagaaccaatgtcagaactaaatgctaataagatttggcctgggagagtaacatagtaagattgttaatgtttaatgcactctcatcaaagtgggataatcctacggctgaaggttaagtgagccttttgtaaaaaaaaaaaataatagggaagaaaacattattgtagcttttccattttactcagtcaaatgaattcaacataaacttgttatagccaagcccaggctagacatttcctggtgatctggtaatttcccttgtattgttcatgtggtttgtctctttcctcttcctctttgtttctaatgatgatgatgaacagcatctctgcaataggccacattctcaaagtgctccattcattgtcacttgaaaagaccactgttgggttttattgccatcattgatatacaaggataatttacatacaaaattgtggtttggttttagagccatggcaaccagagtatcacttctgatgggaaaaggaagaatggccttcagtgatggagtaggcaattgcaaagagttctgctcccagttctcttgctaaatcaaaagattgcaagggtcaagatcgatttcttcattttctttaggcagcaatctgaagaggccccagcagaaaactccagccttaggatttctggtaatcagaaaaagaagcaactgttcttgggtaacatgtggtgcccataaaagggcatcagctcttgggggcagcctgaggttaccaggttcacctttgctcattctgcgcaaggatcgctcccctcagagtttctgcaggggaatgtgtactctggtgttcggtattaaagcttctacatgaatttatagagttgcttacattggctgagaaattgttttttttttttttttttggtactcagccctaattttccctggcaaatattgctctgtaactttgagatgaatgtacccatcaaaaactccagaagaaattctcatgcagttctattattgctcatcattttgccaaggaacgttagtaaagagagctatgaagtggctaaagaagttgtgttttttgtttgtgtgtttgtttttccttttcatcgttttatgtcttagtaggagaagaatccaagatgaaaaggacaggctctggttttagctttgccactaatttcgtgtgtttccttatgcaagtgtccagatcttcttgggaattaatttctttatttgtcaaagggagctaataatacctgccctggccaacctgtaacatagttatgcgtaggagtaaaatcacagatgtgaaagtttgcaaaattctaagatccttaggtagctcatgcgtcgacaggagtaatgaattatacacctaccgcaaaaggtgattgtggggatccagtgtcaaagggcttagaagagagtgtgacacataagtagcatttggggatggtagctggaagaccaagcagcaagggtgttaccatcaaatcccttccataacccctctcccatacaaagcaaaggggtctaaatagccccagtgctcacttcaatgctactcatattctttggctttggagactttgcttttttggagcccctcattcctactttccagacatttgcagaattcagctgtgctttctaagagattctctggcattaacacagaatgaccttgcagtgggaatgaccttggagctgcagcgacttgagtttaaattctagctctgccccttactagctgggtgggattgattccaggtaactgtcagtaccttgtgtctcaacatcttcagttggggatagcgtcctaccatctccctcatagaggagttaacgagttgaaatgacacagatgctacagtcaggagatgctacgtaattttctgggcccagtgcaaaatgaaaattcagggccccttgttcaagcatattaagcacttcaagatggcaacagcagagcatgaaaccaaggtctaggtcttctgagctcagggtcttgtgcaactgcataggtcacatgcccttgaagcccaccctggccactgatcccatagtggcagcttgccacttagtgggcactcagtagagaccgcttgcttttctttcttcctctttctctcttcttctcttgatagccttaaatccctgggagggggggcttgcatttactcttacacttcctgccacagtttctccccttatgatcgttccttctgctggttaaattgccgcttctcttttgcccctgaaatcagggagccaagtgattaagagaagctagcttatctacacgagcctcccatctctatgtctgtatttcccaagttctttcaaagataacccaataaaataaagaactaacagcatcatgatacatacaaaggggctatggtgtatgtgtggcaggctggggagtaaggatggagaaggtattttgaggcaaagaagaaagaacaaaggaaaatgaaggtattagaagataaaagcttgcacttcacagaagatattattttgctgccatgtatctaagcacaattgaggcagattagttgtaaaatcacctcatttacttttcccagcttttttcagccactttcactaaatcaaccaaccaaaccttttctgtgcccttatgtcccttgtctctgaacttcatcaactaaatatttgttatgcattattttattcagcattcacagtatctgtgggtttgggtatgctacttctttcttcattttatagagaaggagatgatagagtaaccgtccatagttactgtgttcattggaaatgttttgtctccaagtagcagaaagcccaacttacagtgtctgtgttcggggttggaagttggggagaggttcctcctaatgagatgcttggaggcagaccaccgcctcaggggttagacagctcactgacatcctggctcctgtctgctgctctcttggcttttccctcataatcacaagatggctgctgtgggtccaggcatcacaacatggtcaggagaagaagaaatgagggaagaaacagtatccagcctattgttgtcttttcttgggaaagttacactttctcaggcatccactggcttacagacttctacttatgtctcattggccagaactgtgggagtttctagctatagaaatggcggagaaggtgagtgtttagcttttcccgcctttttcctggttgggggagacagctctagagtgaagcacacaacagtatatactttatagtgacaaagatagcaaggggcaaagacagaacctgaacccaggtcctctaatcttgagtttagagattttgccattctgccacattgctcttcttttaaaaatactttcagcaacatccagcttgtccacttcctgctgagacaagccaacaggtataactccaagttatggaaatttaaaacaggaaatatgtttatactatgccttcccttaaggttcctgagagagaactttctacaagttatgtaaaacagagataatgtggcttatagaaaatttattcctcacatgataaattctgtgcatgtgaagtttcgtagaactcactgtagcgcatttagaaacacacgaccagaaattgtgtgaaacattgctttgggatggatggtgcccgtctgaccttaagctatccttcccccactctgctgctcttcaaaccacagccagtttattttttggtagaaactatttacgtatgaagatcgtatttggatgcctttagtaatttattaaactcactttcctaaagcaagatcagagtttaaaacatatgtaaatatcagctgagagattagaaacaaaagccaagaaggaatttctccactgcaattaccacatgcagttaccatggcagggaagctgtgcgggataattcagtccaaggtagagaaataacagagtctggaaatgtaaatatgtttctgttagagatacttgaaataacgtttacactggcttcttcctttttagctatgggatattgtgcaaaacttttttgttgtgttttctttaaatgctccgggcagtaaattggaagtatatagcacctgctacatgtttagtcagtagtcgaaacattgaataaatcatgaaatctgtaggtgaactgaataatagctgccctggagagaactgtaattcactgttgacaaaataaatccccctgcatttttctggggaatcttttatttttagcaagagtgtttgatactcctaagttaattagtagttttaacagagtggaatgttattgaacctaccagtgttgtttaagagctaatgtttatgtgccaggcgccagattaggtaattttataagcatagatcattacattctcgcccagccctgtagggttcctagctctgcttttccagatgaagagccaagacccttagaggttgtaactagtccagagccacatgggctaggaagaaaggaagacctttcaccacttatttacacaagtaagttcttcccaggcagtgtggcagactcagcagattggcccacttaactcttgttccacccccactctatcttgtctacttctaccacagaggccagaaaccacaaatccccagcctcctgtggcttggcttggggtagcccaaatacacagttctgtccaaccatgcataggcagaattccctggggaacatttctctctccccaagtaggtaaagcttctttgccctttaccgtttgttgttccttttcttccttcatggaaagaagagtcactttcaagacatgcagcaaccaccctctaacaatcagaaggaaatacatggttaagattgttgaaacaagaagtaaaagaagtcaagttgcttgacgatattctcttttgtctttttattttttttattttttaaattatactttaagttctagggtacatgtgcacaatgtgcaggtttgttacatatgtatacatgtgccatgttggtttgctgcacccattaattcatcatttacattaggtatttctcctaatgctatccctcccccatgcacccaccccacaacaggccccagtgtgtgatgttccccaccctgtgtccaagtgttctcatcattcgtgtcccacctatgagtgagaacatgcggtgtttggttttctgtccttgtgatagtttgctgagaatgatggtttccagcttcatccatgtccctacaaacggcatgaactcatccttttttatggctgcatagtattccatggtgtatatgtgccacattttcttaatccagtctatcattgatggacatttgggttggttccatgagcttgatgatattctcaaatagattccctagccctaggctgcctgccattgcattccttattacacaagaataatcatctcttattgtattccaatcattgattggcattattttttttctgcatagcaaaatacatggccaaatcagtaaacctgaacttctcaaagtggccatctggtagctactagcttataaactgttccctaggtatagagaattgaaagcaggtgaagtgtgtgtgtgtgtgtgtgtgtgtgtgtgtgtgtgtgtgtatttcacatatcactcaggtcaatgttcctttgaaaatggagaatgcaactctattaagataatagtgtaaatttggtaactgatcacttacagcaattacaacaaaagatgcaaaagtcaggcagaactgggttctaatgctggctgtagcactggttggttatgtgaccttgagctcattagttagccttgcacacatttcctcatatatgattgaggataagagtagttttatctcatagagatttgaggggcatttggcacaggatcaggcacaaagtaagcactcagtggtattgctgccaataataataacaataataataataatagaattatttaagacttgcagattgagggaatttgatgaaatatataacaactgaggttaaagtgttctaattttctgtctagattcatcttttatggtccctttttaatctcacaccagtgtccttccagaattaaaaggtcaatgattttacttcctagagaagcttccttaggggcttatgaatggtgaaaatgtgcacgtttgcctcgactctctatttccattgtcgaaggccttcgcaaatttacctagtgattctagccaagtgcttcctgacattcttaggggctcgaaggtcaatacttgatttggattttttgttgttgtttctttttccctccagcctcctgtgttgtgttgatttgtaaaatggccattgtaaatgttaaaatggaaagaaaaccgagtctgttataagctttgatgtagtaaaaacagcatggagcatcttaaattttaagatgtcatcagaaaagaagctcttcccagtttcctcttgaaaatcattgtattagtcagggttctctagagggacagaactaataggacagatatatatagaaaggggaggttattaagtagtattaacttacacgattacaaggtcccacaataggctgtctgcaagctgaggggcaaggaagccagtccaagtcccaaacgattttatttgacaaaagacaaaaacagaagttatttacaatagtttttgctcaaataattcagtgggggcaactgtacttttcctccaggtttatcttataaccaaacccaagcagaggctgccccaccccaacaccccattttacacagctgggaatgccaaccagaattcagcagcgtggctccctcacccctcaccaccctctattgctcagtgtacagtggggagggaaagatcccacctcagcccaagaacttggagctgaagaacttggaatctgatattcaagggcaggaagcatccagcacagtagaaagatgtaaggtgggaggctcagccagtctagccttttcacatttttctccctggtttacatgctggccatgctggcagctgatttgatggtgcccacccagattaaggatgggtctgcctttcccagctcactgacttgaacgttaatctcctttggccacaccctcacagacacacccaagatcaataatttgcaccctccaatccaatcaagttgacactcagtattagccctcacaatcataaaacagaaaaatgagtgaaaagcataaattttgctttcaaaaagctgggagattctatatccatgaaccacaatatatgacgtaaggctggccaaatgcagtggaacgaaagctcaggaagggctaagagacaatcactatgatcaggttatagattttgacaaagcaagcaaaaaacacgtctccaaaactggtacttcagagcaggcataccctaaaggatgacgccaataagcctttgtttggaaaatggcaagggtattgcaagactggaagtagaaaacctccctggaccctacctgctaccatgtagtagcaaatgaaactgaaagggaaatgcacagtcatcctgtgtgtataggaagcagtccattgttgtggcactacggcagcctgttggccgagaagaagcagtggctaaaataactcatcagcacacaaccctttgtaataagacttaacagtaaatcaggtaaatttttaccaactcacaacatcctgactcctatcccacaaaactgtcctctaaatatctgaatcaagaagtttccacattcagaggaaagtaacaataaaaaggaaccagcacaggatattgtaatatgccatacatgacactacaaagatattataatataaaaggagaaaaaactggaaaatagatggtaaatgcagaacactcactataggtgattccaacagacaaatcaaaagataacattaccatgatcttgacgacttaaagaaaccaccaaagagctcaaaacagaaataaagaggtcaggggtaatatggtgacgtgagaagagaagaaacatacactgatgtagctctccagagaactgaagggggaaatttttttttttttttttgagacggagtctcgccctgttgcccaggctggagtgcagtgacgtgatctcggctcactgcaacctccacctcccgggttcacgccattctcctgcctcagcctcccaagtagctgggactacaggggcacccaccaccatgcccggctaatttttttgtattttttagtagagatggggttttactatggtctcgatctcctgacctcatgatctgcctgcctcagcctcccaaagttctgggattacaggcgtgagccaccgcacccggcctgaagggggaaaatcatcacagatatgaagatgattttgaagcagccaaagtaaaatagacactagacactgccgaacatagaatagaggatatgatgggcaggattatcaaagcaaacaaaacggaaacaacagcttaaaagtattagaaagaaaatagtatatttgggtgacgaggaagatcccagagatacatcacaatatatccctgaagaagagaattaaacaaatgaaacataaacaaagatataattctacgtaactttcaataaataaaagatttgaatttatagattgaaggagtctactatgttacagaaaatttgctaaagaacaatcaatactactctgtattatagatgtattgatagatcttggagataagaatgatttggtcacaccagcaggaatatcaagtaacctatacaagaccacagtttaaaaaaaacctcaggctaacctaagccttccttacagcaacattccaagattgcagagagtaatgcccatgaagccctcagtgaaaaagtatgtggccttagagttttatgcacagccaaactgtcattcaaatgtaaaaacaataaataaaacgtgtccaacatttaagaacccagagaagatgattcccatgagttattctttaaaaaactattggctgggcgtggtggctaacacctgtaatcccaacactttgggagactgaggcaggtggatcacgaggtcgggagatcgagaccatcctggctaacatggtgaaaccacatctctaccaaaaaaattaaaaattagctgggcgtggtggcgggcacctgtagtcccagctacttgggaggctgaggcaggagaatggcgtgaacccgagaggcagagcttgcagtgagcagagatcacaccactacactccagcctgggcaatagagcaagactctgtctcaaaaaaataaataaaattaaaaaataaaaaataaaaaactattaaagactttatctaagagatgaatgaagaaaccatggcaaaaggattttcagtgaacactgagtctgttttgcttttagactgggtctaaataagtgcagaaacttttgttatagaaaaaaaaaactaagctctgaatgttcataaatattttaactaatataaggataaggtggaaggtggtatgtagattcattcatcatctcatttaaacatgataaatcaagtatatttaaatatacttagcatacttactaaagtatattagtaaattaatatatttactgaagtatattagtaaattaatatatttactaaatatactaagtatatttaaatatacaaaaataagtgtaggaatgaacatatatgttagtttgaaatatatatgtaatatataaggtacatgtttaatatgtaaacatataatatatattaaaccaatgtttagtgcctattaaccaaattcaagtgatagaaggaagagaaaataaagaacaatttgtattgcttttagtggaaagtaaaatgtcagtgtttcaagaaacagagaagttaaatagctaaataagggttagttacaaaggtgatcactggaaaaattaaccataatacaaacctgcccaaatagcacaaggaatactcacaaaaagaaaatatagaccaaagagtagaagatttttttaaaaaagcaatagaaacagaaatcaaaatactataaagtaagaccaaacctgtttctcatatcaacaaataaaagtgggctaaactcccatattaaaaaaaaagattctgaaatcgagtaataaagtaaaacttaaccatatgctataccccatatatacctaaagcaaagtgtctcgcaaacttgaaaatagaaggatgagcaaaggaatattatcaaatgccaacaaaaaggaaagtagaggccaataatcttagaataaaacaaggttgaatttagaacaaaaagcattaaacaagaaacataaagacaattgtgtgataagatgtatcattcacaaggaagatctaatagtcattaagtgtttctgtatcaacgtagcctgaaaagttaagcaaaaactaccaaaaagataaggaaaaatagaaagactttaattataggaggcttaacagacaaaatagacccaaaagatgacatagatggcctaaataacataagtaagtagtaaagttacatatatcaatctatccctgaaaactaaaaatatgtcatcctttcagatgtccataaaacgtttcccagaactgactatactttagaccacacagaaaacctaaataaactccccaaatcagaaatcacactgatattgtcctctaatcactatgagtcaaaaaggaatccatgtgaatgtatagaatatttaaaattaatgataatgattataaccacattacatatcctatgggctcaactaaagcatttgctcaaaagaaaatttgtatacgtaagtacttaaattaatgaacaaaaaataaaggaaatcagtgcatatgtcttctactcacgaaattaaatataagaaaaataaagttaacctcaggaaaatataaggtagctatgataataaaagcagaaaataggaaaaaagaataaatctttaagttagctctttatgaaaaatcaataaatcattagtaaacaaaccaaaatggttgccaataagttattttctaggaaaatataaaattaccaggcatgaccccagatggagagaaaacaacaatctaaggaaatgaattagtatagaagaaatacagaatgtggagaaaaagcaaacctcttgaaagaaaacaccagtcctggaatatttcacagattacttctaccaaacctataaggaaaaaataggtccaatattatttaaaccaagtgaaagcatccaggttatttttctgaagctagcatgcatcatgcatattctgataaatagagcacacaaaaaagcaaactaaggaccaatattgcttatgaatatcagtgtaaataatcctaattaaaatattagaaaacaaatctaagagctcacaaagacaagaatttgctatgttcaaatgggatttagtcttaaaaaagtaagactatttcaaaattcacaactgtattaatttaattcataaaatattgtcaaaattaagaatcactttatcatctccataaatacttgaacaggtgtttgataaaattctctaatcttgatgaaaaactcataataaaatgctattttattatacagacagagacatacacacatacatataccaatacatacttagtaacatggtcccaaagctactgatacaactgctgaagaaagtgtcattaatgtcggctacaaggaaagataccttaatcaatagcattaattaacattattgctccagagagcctagctagcctaagtaaacaaaagaaaaaaataagcagagtaattttaaccaggagttaaaattatcatatatgcagatgatatgattatgtactgtaaaacacaaagaatcacatggaaaaaatagtataaacaataaggaaatacacttaggtgattgagtacaaaaatactactcatgttaatctttccacaaacagaaactggttagaaaatataactgaagagatcccatttacaataagaataaatttaacaagaaatgtgcccaaattacacaaataaaatttttaaatgctactgagaaacatgaaaaatgacttaaacaaatggaaaggcatactctgtttaacataaagatgtcttatctaaattaagttatacaggtaatgcaatgcaataaaaaaaaaaacaatagaatctacaggggtagattctaaagttcaagaacaaataaggaagcccaacccaaaagtttctgacaaaggaaaattaagaaagggggattagccctatcaaatattaaaatgtattgtagtccgggtacctgaggtcaggagttcgtgacctgcctggccaatatggtaaaaccctgtctctactaaatatacaaatattagctgggtgtggtagtgggcacctgtaatcccagctacttgggaggcttaggcaggagaattgcttgaacctgggaggcggaggttgcagtgagcccagcggcgccactgcactccagcctgggtgacagagtgagactccatctcaaaaaaaaaaaaaaaaaaaaaaaaaaaaaaaaaaaaaaaaactattgtaaaactacagaagttaaaatatatatgtctccatatctttttttatttttaatttttatggccacatagtaggtgtatatatttatggggtacttgagatattttgatacagacatacaatatgtaatcatcacattagggtaaatagagtatccatcacttcaagcactcattacctctttgtgttacaaacattccaactgtactctctcgttattctaaaatgtattacaaattgtcactgactgcagtcaccctgttgtgctatcaaatactagatattattcatttatatctctatatcctaacaaccaggaagctctatgtaagtgtctagaaatagaccaaactacatatgacaaattttttatttacatatcaataaaaaaatcagtctattcaaaaatgttattgaaacaactgaatacctctttagaaaaaaattaacaagcacaaacaccataaacaaaatcagaaaatgatatactgagaaaaatcatttacaaaggactattcttttttttttaatttaagttctagggtacatgtgcacaacgtgcatgtttgttacatatgtatacatgtgccatgttggtgtgctgcacacattaactcgccatttacattaggtatatctcctaatgctatccctcccccatccccctaccccacaacaggcccagtgtgtgatgttccccaccctgtgtccaagtgtactcattgttcaattcccacctatgagtgagaacatgcggtgtttggttttctgtccttgcgatagtttgctgagaatgatggtttccagcttcatccatgtccctacaaaggacatgaactcatccttttttatggctgcatagtattccatggtgtatatgtgccacattttcttaatccagtctatcatggatggacatttgggttggttccaagtctttgctattgtgaatagtgccgcaataaacatacgtgtgcatgtgtctttatagcagcatgatttataatcctttgggtatatatccagtaatgggatggctgggtcaaatggtatttctagttctagatccttgaggaattaccacactgtcttccacaatggctgaactagtttacagccccacaaacagtgtaaaagtgttcctatttctccacatgctctccagcacctgttgttccctgactttttaatggtcgccattttaactggtgtgagatggtatctcattgtggttttgatttgcatttctctgatggccagtgatgatgagcattttttcatgtgtgttggctgcataaatgtcttctttcgagaagtatctgttcatatccttcacccactttttgatgggttgtttgattttttcttgtaaatttgtttaagttctttgtagattctggatattagccctttgtcagatgggtacattgcaaacgttttctcccattctgtatgttgcctgttcactctgatggtagtttcttttactgtgcagaagctctttagtttaattagatcccatttctcaattttggcttttgttgccgttgcttttggtgttttagtcatgaagtccttgcccatgcctatgtcctgaatggtattgcctaggttttcttctagggtttttttggttttaggtcttacatttaagtctttaatccgtcttgaattaatttttgtataaggtgtgaggaagggatccagtttcagctttctacatatggctagccagttttcccagcaccatctattaaatagagaatcctttccccatttcttatttttgtcagttttgacaaaggactattcttcttaacatgttaaaaatctcttgaataaaattaaaaaacaacccagtggaaatagatagggcaaataatataaataggtacttcccaaaaagaaagaaacatgatgtaaaccattgaaaaaatgcacagtctcactcacaataaatgtatattaagactactgagagatgctgatttaaaaaaaaaagcctgccagatttcacattgacaaggatcaaaaagtttaatcacacattgttggcaacactgtagggaaataaggtaccctcatacatctttggtggacccatgaattggtacaatgttgattaggagcaaattgccagtatttatcatgcaacttgcatgtatctcctgactcagaaatttcacttctaggaattcctcctacattacacttgtgcaattgtgtgtacttgcacttgtgtgaatgatgtatgtacatgaatatgctttgtcatattgtttgtgagaaccaaagattacaaaccaccaaatgctggccaatatacattcattaccacaaaggtctggtcaatttagagaaagaaatcctatgtccacgaaggatataatctctaagaaaacaaagtgctgacagcatcatagagtatgttaccattattgtaaaatggcaatagtaataattattatataaatatatgcttgtgtatgaataaaatgccctgaaagtatactgatagagtttggatatttgtccctgcgcaaatcacatgatgaaatgtaattcccagtgttggaggtgtttgggtcatgggggcagaccccttatgtcttggtgctgtccttgcaatagtgagtgagtgctcacaagatctggttgtttaagtgtgtggtaccacacactcctccttgcttctgctcctaccacatgaaatacctgctacccgtttgccttctgcggtgactgtaagcttcctgaggcctccccagaagcagatgccagcactgtgcttcctgtacagcctgaagaaccatgaaccagttaaacctcttttcttataaatcacccagtctcaggtatttttttctttcttttgagatggagtctcgctctgtcccccagactggagtgcagtgacgtgatcttggttcggctcactgcaagctccacctcccgggctcacgccattgtcctgcctcagcctgccgagtcgctgggactacaggcgcccgccaccatgcccggctaattttttgtatttttaatagagatggggtttcactgtgttagccaggatggtctcaatctcctgacctcgtgatctgcccacctcggcctcccaaagtgctgggattacaggtgtgagccgttgcgcccggccaggtatttctttatagcaatgaaagagtggcctaacacgtatacattagaacctgattacagtagatgcctcttgggaggggacttaaatggccagggttggtgataaaaagtattttttaatgtatccccttttttatctgttaatttttttatgtgtatatgtattacctattcaaaaagttaatcaattttaaattaacttagatcccaattcaaactccacatctgctacctccagctttgtgacctagagcaaactgcaggccagctgccttctctgtggagcagggactgtcagaactcccccatcccagggtgtgatcagagctacatgagataatcatgggaaagtacctggaaattacatgtaattgcttagtaaatgccctccgcttctttccccccagaattaaagtaagctgcatctaactattacaacttaataaggtgcattattgtgctttgctgtgtttttaattttcttgtcatacctgaatggtttaaacatctggcttccttaaggcataattaagtaaaagagagagcagcgtacatcaccagtcaggtgtacttctttccctgttgtaaaagtgatgctttttattcagagccaagtctagatattcaccagtccttggcacgactagaaaaagatttgaaggactaaagctgctagagcataattatgtattggctgtggacttgagatgcctgggttctgtccctcctgactgtgacttagcagccgtttgtcactggagatgttttatgacttctgcaggcttccacagtatcacttgtgaaatgggaataactatttaatagctcacagaggtgctgtattaggttctccagagaaacagaataggatttacgttatatataacaataggatatagcctagatatatagatatatatatataaggatttattgtgggaatttgttcacgtgtttgtagaggctgagaagtgccacatatgccatctccaagctagagaagcaggaaagccagtggtaaaattcagcatgagtccacaggcccaagaaccagcagctctgatgtcccagggcaggagaaaagctggatgtcccaggtcaagggaaggagggaatttacccctcctccttctttttgttctatctgaaccctcaatggattggaagatgcttgcccacaccagtgagggtaatctttactcaatctactgattcaaatgctgttctctttcagaaacacactcacagtcatacccagaaataatgttttaccagctatctgggcaccccataacccagtcaagttgacacataaaattaaccatcacagacactgactagaatgcataaagtccatctagaaaagcacccagtacataataagcactcaacaaatatttttggaaaagtatcaaacactctgtgcaaggagcaagaaatggttcctactttcacggtctacacaaattaatagggagatgaaacaatggcccaaatcactagatcaccaagccatttaggagaagaaactgaagtgaagggggtaggcatgactcataaagagtaatttcctttccctctctaaggccccaccagtgaactggtggccacgttgactaactggagacaggataccaaggaggacagacatcattgtgaggtcccattctacgtaccccaaaccaacagagtcctctggaaggcctgagagctgttaggaacaagacgaaatgggtgtgagattgaagaagtcacaaaatgcagacattttaagctattctcccaaaatacattaaaaatcttactgagaaaaatgtgaaatatatacaatactcacttgcatatactatttcttattttattttatttatttattttttgagacagagtttcactgttgttgcccaggctagagtgcaatggcacgatcttggctcactgcaacctctgccaccctagttcaagcgattctcctgcttcatcctcccaaattgctgggattacaggtgcccaccaccacacctggctaattttttatattttttagtagagatggcgtttcaccatgttggtcaggctggtctcaaactcttgacctcaggtgatccacccacctcagcctcccaaagtgctgggattacaggcgtgagccactgtgcccaaccaacactatttgttattttagatgttgggaagttttcatgaaaattctcttgtccattctcatttacatgcacacacatacatatgcacatgcatgaacacatgcttcacggcgcttcttattaatccttattgggtaaaatcttattgagggacaataaaccagataaaatctccaaccactccctggtgccaagtctcttgggcccctcacactccaggtgggcaaggcagcatgccagtggacacagcatcacctgctcagagggagtggttgtggaaagcacagaggcaggcggcctggtggccaaggtccacaccacatcctcccaggtgggcactgtcctgagtaggcttaaactggcattgtctgtccagtaagtccttttctaaggaaagcaggtatcaactaattagcaacatgcaagtgttttcattttaggaaaagagaagaactctggaattatggggcctggtaaaggttcatttaagcgtcaagatcaagttggctaaacccatagtgtggaagcactctttgcgtagggtgagccaggtggagcagctgtgtgacagatcttggaggcagtctaagggcaatgagcacctggagaacaaagagggaggggctgcccacctgaggaggaagggacatgtgcaactgtctcctagatggggccctgagaactgccgggagacatcacagggcagcccctctccccacctctggctacacagtctcctgcccttctctactcagtgaattctgaggtcaaaggctactgtgccaaactttcaagtagagtgaagcctcctccgtggtgaactataaacttggatggcatcatgtccatttttgtgttcttcacagcacccaacagcaggttcacagtcaacgttagtgagggaccgagattgtagaagcaaatatttctccagcatcaggggtgttgcctcactaggatctaccattgggatcccaacccaggatgatggtttgaaaccttccggtccagttctcccccatttgtcagtctttgtccttgacaattaatgctgtaaatgcatgtactaaatgcccactgagtgtgtgtaacacacaagccggtgatatcagagtggcaccggacagggagcaacacttctgcaaaggagcaggtattccaagtccttctcatctttcctgagcatctgtcatttgggtggacctcactgcacccttcagctattagcagtgactgtaaatggagaagaagttctcgagaaccagcagcaccctgaacactcattaactgagaaaaattggagactcaaggaggcccaataccctcttactgaatacccaccttccttgtgccagggaggtcatagggaggttgaaaaatcaagggttttgccatgtgtctgagtttgattcctccaaaagggcattaacttttcatattacctctgcagagtgggatttaaaatctgtgttagtgacacgatatttcatttcagatccacagggcccacatttaaaattaatattgcatgcttgtcagaatgaattccaaaccctctcacagcaggccccttgtgggacctagagaaggagtggccaattcattatcgtaacactgggatgagggttccatcccagcttttgactgacacctgcagagattttttttttctgagacattttaagtttttggtgtgccccatcttcccagacaagctgcacgtttctgtcactctgtgctgtttccaaagcccagtggtctgcagggtacctttgaggggcctcctctgatccagttaatcagttcctcattgacaacatagacagagcatctggcccaggccagagagggctttcggccgagtccctctggaggatcagtctgtagagggatgtgactaaggcagcagattccgccaggattctgttagacacagaggacacaaggtcacctggccaaaagtggaggtcaggaagactcaagatctgggtccacctgtttcattttctcttagcatctgccctggcctgctgtcgtaaatcatcatcaccgagcttaaaaccaccctgtcgttcaaaaaaaaaaaaaaaaaatgagctatttggtttttgaacactttccttacagtgcgtagcagtttgttagagaggtgggcaggcattaggattttgtttataaccttggaataaactaagccaacagactgtattcttgcagggttaatgtcccctgctttacagtatgggaatgcccaacgaagtttttattatagagggtggaatatggtgcagtattcagtggagacaattgccccgggagtgcagcgcagaaagccacagctgcatctccacttggtgtcggccgggagctgcctcacctggggctccagggtccctttgagaccgcagttccatagcccgtgggtactgtccttgtgtcatcatcctctctctctctctctccattccagtcattcactctctccccctctttttctctgactgcctccaggcactttctttagcacagagctctggtgatacctcccactggccttgggcacccttcttcaaggccactcaccctgcatggaggagaggaagggaaggagtggccaattcattttcgtaacaaacacccaattttgtttttctccgtggactatccagatgcatgcttcttttacagttcatgtctgcgatactttgtcccttagagaaaaaagctgtatacaaatgtgaaattattccaattatctaatctctgttgcattcctcagccctgcaaagagttaaatgatgtgtaaaatcacctgttagcccgcattagacagggctgtatttacacacccagaggtggcctgtgaattatttaaccgaagggactcttggctcagcatctggctagacactgttgagcccaagttccttaggaggtgcagcctgtggccccagagcttcctcttggctggggaaaccgtctgacagacacggtgggctgctgccagaaccaggtctccttgagaacaacttgaactaagctcctcccagctccagatggttcacaaactagagaggagttttgcagagtcctgaacgctttgccaaaaaagagcgttggccatcttccaggccaggcggtaggtttgcctgcatgctgtgaatgccaggattattgttggggttttagagagtccatttcataacacccccagttcccatctgaatttggaaccaatgagagaaaaagggaaagcagtgagatggatggagatcaaaacatcacttttgtcaccaactgacctctcagagaacagggggagagtgacactggatgtcccaactaggaaccccagagtagagacacacttccatgaccagtgctggaaacccatctgcctcatgccaggaggcaggatcttgggtccctgtaccctggtgcagggaacggaaaggagccataccttctgcaagcacccagctcctcacaggaagccagggccaattcttccacctctccttgtctcatctcacttttcaggtgagcttcctttctctcctaccaaggagagggtgggggctgtggcaagagatggaggcatctggggaaaagccttcctcggggaaaacagcattccatatatctcccagggagatgggacctgcatatatttggaggaagaagtcatagagattgcaagagctggagaggattttagaagccactggaatcctctcattttactgaaggaaacagaggcacacgggtgcagcgaaaccctcatggttatatagctagtcaggggcagggctgaatttgtgtggcagtctgcagtttaaagccggtccctcatggtatggagaacacagcagtgggcatttcacacgcataatctcaccacagggggccaggctgcctcttggtctatgggactccaccccactgtgggtttcagggcaggttcccactcctacctcatctatcccttcttgggaatgggagatgcttggaggatgcacagtaattgaaatgctattcctggcaaatgatcatttccgggggaaaatgtgaatatcatgatatcaagtcaaataaagctgttaggttgaggctttgtccttgagctttttagactctgaacaggcagttgggaaggcagtcagctcctgcctgagtcactgggcaggacagccagcccagggaaagatgagggaagtgggggacctgcgttggtatctcactgggaggatgctgtggcctccccattcgatggagatccttgtcaggcctgcttttgcaaatgctcagaactccaggcagctctctggccctcttctttctgtcctctccatgcagctcccactgctgtatttactcggttggcactttccgctgtcagaatcacatttctcccagccactcactgtgttgcagaatctgtgtattgtcttttcttcagctggtgttttgggcttaagccctgaaatgctttgttctgggccccactacagcacccatactgtgtgctagagaaaacaggaaagggccctcaccatcacacccatgaccttggggaggccagcacctttgttgtcatacttcccaaaaccctccatcccctccctgccagaggagctagcacaatctagatgcccactggctgaggtttatttccagcactgcaaggtaacaggtacacacatacgcacaccagatttccattcccattaaatctctgcatccccaaatgagctacctgttggcaaaagctttttatctgtcagaagttctcaagtggaagttgtctctctctctttgctgcacgtgtgttaccacaaatgcggattgtgccggcctttctccatctcacccacaacctccccttaaacctccatctccaacacccccgagtcttcaatgcctcaggagaattctgaagccagcatataattgctgtccagaaagaggccccgtgggaacggaaaggattttgtgtgtgctcacccctacatttaatggggccatccttccccataaggctcagtgctgcaaagccaggagcccacccccaaggctcatgccaaaccccaattatctggagggcaactggccctgggagctgggccaagcacagcccctcctagctgcggaaagagccttcctatatgtctcgtttgacgcctacaaaaacctggggaagctggcagggcagggggtggggaggttaagcccatagggtggacaagccacagggctctgctccctcccttccccctcatttcttcacccctcccccatgaaaccatcaatcaccttgatggcaggagggaggggtgcttggctgaattgacttgaaaacactcagaaacccaaattgcacccacagaggcactcagaattcagggagatgagggatgtccgcctgaaacacttttttgcagtaatgtgttccgtgatggaagtcatctaattcattcatgaggggactgagacctcagaggaaagtggtgtccctgaaactagcaagggtcagaactacttgcagagaagccactaggaaggctttccagatgagactctccccctactcccactaatattagagggactcccctccctccagcatctccccacagggtctggctgcctcaggcttcccttggctctcagagatgcccttccactcaactgctacccacatgcttctacctgctgcacacaccctttctgtctgcagcctctgatatggtttggctgtgtccacacccaaatctcatcttgaattgtacctcctataattcccttgtgtcgtgaaagggacccagtgggaggtaattgaatcatgggggggcaggtctttcctgtactgttctcatgatagtgaataagtcttaggaggtcttctgcacaagctctctcttgcctgccaccatgtgactttgctcctcgttcgccttcctccatgattgtgaggcttccccagccatatggaactgtgagtcaattaaacctctttcttttgtaaattatccagtctcaggtaggtctttcttagcagcgtgagaacagactaatacagcccctcccctaggctttccctccttagagttcatgttgcagaccacttttccttccttctccgctactgactgcccccatccctgtttgtccagggttctcctgttttctgggttccctgatgagagttagttccttttagggactaattcgtcctagggaggactagattaatagactaccaagtcccctttccaaactgacttgcattttaagatggaaaagtgactcccagggacagggcattggctcaacaggtgcttctacagcttggccgtgacagcctgtctctacatagaaagggccaggggctgcagtctttgcttggagctgtgtttgtagaacaagcacactgtttttaacgtggtttatggttttgtttaaatcaggagtgtcgaatcttttgtattccctgggccacaatggaagaagaagaattgtcttgggccacacataaaatatactaacactaatgacagctgatgagcttaatgttttaagaatgtttacaaacttgtattgggccacatgtggcctgtgggccactggctggacaagctcggtttaaattgataagatattcgggaagaagatctaatcactctcctgccagcctctaccctgctgctaaaatgctttcacaggatctaggtcactggctttgataatcaccacagcttgtggatgtcctcctaagtctagtgccggaagggaactcggtattcctcagtgtgaactggaagcagatgaaggaactccacctctcactcaggtcatcatgtttctgttaatgcatcctgagatcaaattcacctttttcttttgctgccatattatattacaatttttcagttgacttaattgcaaagtatcttctatttgggctactgagtcacttatctctcaaattgtgtgttgttctaactatatatctatgccataagtataagggtttacatttattccttactttatgtcatcttaaaacaaatgaaagactactctaatcatgccacttctcactcctgattctagaaaacagtgtctttcttgaccctcctagttttaaatctggactatgaatctggcattcattcttatcccctaacattagacagagtattggctttcagaaagctaagctttgaagtactatatgttgtgtggcttactggagatcagacaatatgcaagaagtcaaattagttagtttggctcatggaaagctgtctaatttggaaataattaggtgtcatctcctgagagagagagagagagagagagcgcgcatagggagaggcagtggggaagaggaagagagagaggacagaaagggaagatgagagaaaatagttttcattacatgttaagcagaaagagttggaaaaaaataatttctatgatctgcaaagtcatttcaggagtacattagcttgctagggctgccatagttaagtatcacaaagtgggtgggctaagtaacagacaattattaactacagttctggagaccagaagtctacgatcaagacagggttggttccttctcggggctgccaggaaaggatctgttcccagcctctctctctggcctgtagatgactttgccccctgtgtttcttcacagtatcttccctctgtgtgtgcctgtctgtgtctaaatttcccctttttataaggacatcagtcattttggattaagatccacactaacaacctcattttaactcgattacctctgtaaaggccctatttccaaatgagatcacattctgaggtactgaaagttaggacttcaatgtctcgatttggagtggggcacaattcagtccataacaaggggattcccaaagagttgtcataggaatatcacccatcaggcaaagctcctggaagcagatggagccaccattaggaaagtttcccatgagactgtggtgcttctgatgtggctcagctctggaactgactcccacccccatcacccatttcaacctctaacccccaccacctaaccaacaccccctcccctgtaaaagcctttcttcttaagtcaggggtaaactttccacattattatggtccgtgtttccaatgcagtggtttctcagatctgcatcgctcctctctacctcctggttccctgcaactccttaacccacaagcagaggaaggagaagagaaggaccctattgtttagagcagaggtgctgggttctccctctacttacaaccttgccctctctcatttctcctgatgaccaggtagggtagacagcaacatccccatccaaacatgagcagtgaggtgacctggccggttcgatgagtggtaggcagcacagccacaggccatctccctcctaaatggggctgggcccaggggttttcctaggccctgcctgactatgctgcaggctctgccttacacttgctcatcctcctgttgcagaagagctacagggagacaagctacaaaaaccttttaatctgtatgattaacagaagcaattggcaaatgaccctgctgctctcccaaggggaataaggggtttattttcagatgctggtatttatcccactgaatttcattgtgcagcctacagtccatcaaatgcttcccagagtcacccagggtttcttcttagattaaaatcagaattaaatcagatagatacatgctttatcaaatctcattttcttggggatgaaaaataagtttctctttcagtctgtgatttcaggaacaggaagcaaagaatttggaagtttaaaaacacctttgcctgagcctgcatagcttattttttctccaggcagatatgggcctccccttgacaaggtgctacctgtaggcaggaaagtcctgctgcttgtcctgccatgtaatggaacttgggccataaggtggataaagataaggctgctctgagaagctgtattagttttcacaatgctgataaagacatacccaagactgggtaatttataaagaaaaagaggtttaacagactcacggttccacgtggttggggaggcctcacaatcatggcagaaggcgaaaggcacatcttacatggtggcaggcaagagaaaatgagagccaagagagtgagagccaagcaaaagaggaaacccctttaaaataatcagatctcaggagacttattcactaccatgagaacagtaggggggaaacccatgattcaattatctctccactaggtcctcccgtaacatgtgggaattaagggagatacacttcaagataagatttgggtggggacacagccaaaccatatcagaagcacagaattagtgcagagttggttaatgaaataatcattttctacataggtaggggagttaaatgatcatattttgccttttaagagtatcatataggaactcttacaaacctatacaaactggggcttgttatgtgagaagtgacgttggtgatacctgcttggaaagcataggtctccaatcccagctgctgtcctctgggagctgcacaaaagaaggtctatcacatgcttctgaagggagctgtagaagcttctgtggttattcatttgctacagatagaagaagaaattaaaaccaattgtgaaggaaagggaaatgaacattattgaggagtgagtaactgtgtggcaggcactgccctgagagattttgcctgcatgctcacctaaattttagaaataggactagctttaaaaaaataaaaaataaatttgagaaataaactattatcctttagaattgataaaaagtagttcatggatattagagatattttggtaaatatcactgtaaagcataaagaaaagaataaaaagtacccatttgctatgatcagaatgttgtgtcccaccaaaattcatatgttgaaacccagcccccaatgtgatactgttaaggggtggggcccttggaggtgattaggtcattagtgttctacctccatgaatgagattagatttgaggaagcctgtttggctctgctggcttatcaggacacatggaaagtgccgtttaagaaagcagaacaagccctcaccagacaccaaatctgtcagtgacttgatcttgaacttaccagcctcctgaactgtgagtaataaatttctattgtttataagttaccccggcaaagatattttgctgatagtagtccaaaagaactaaagaactaaaatgccattgtaccttagcccattctgttgaatcctttggtggctggattgaagagctgggcagtggagagaccagccaatttagaaagactagggggtgcctggtcatgctgccttctatgtaaagagtgggaagtggggcaatgcagaggacattttttggtgcaggaacaccatgaggggaaggactccaagtcttcagatgagatgatggtctctgggcagtcagttacagagcaggaacagcactctgatgtcacttggaaaggcactcatgaaagcagcagagcctgagctggtgtgttcggaggcagcattaaaaatcagcaggaaaggcatgagacatgaaaccaaaaaagggatctttgctgctgggtctcaggcaacacaaggaagaggtttgtcctgggaccccctgtgaggttctaggacctcaggtgctgttgggatcaggcaggaatttcctgaagtcagccttgtggttgcacctccttctttgcggccctcctggggactgttcttcttttttagactcatttaaaatcctcaaggggcccctctgctataagaaagcaccaagggaagggccctgcctttccagtttcccagcacctagcatgcagtgagtgctcaaatataatttatatttggaatgagtgatgattctctctgcttcccctttgggactgaccttgatgctcatttctacctgattttgcttataaattgtgaggagagttctctacactacaatttatctcagtatccctccccagctggtggctctcatgtgctcactggagcagtctgggacatcaaacatgaacaatgacatagtgaaagaagaaaatgcctggggaagataatggcactatctggagcagggagcctgccatctaaggaaatggtaaaaagaaggaggctccttagggcaggtttcaaggggccagaggaagccccaaatgcgtagaatcacagccaggtgctcaggaggggcagcagaagcagccctcaggacgaagggtagtggtcatcgtgcaaggcagacaagggccctagggtgcaggcaggctgggaagatctccagagaatgaggtgggccatctgggggcatcactttgacctgtagacaaagtgaagggagaggggagggtctggtgatgacagcctcagatgcagactctttaagccttctcaaggctttccagtttttgcagctgctgaggaaacttcattctcacccttcttgttccatctgaaaatgcacttctctccagagctctgggagactgtgaaaggctctctcattgccctgaaatatttttttaaggaatgagtatgatcttttctattctctacttctgtcccatgcagagcagatgtagaggaccaggagtgattcagagatgagaactgaatcttccctccagaaagttatgttccagagggaaagaagcggaacttcagtaacagagaatatgaaattggtcctaagtagaggtatgtggctctcgtgactggagcagagggagaaagacttgattcaggttcttgcctcgcagccttggaatgggaaaaaggaataaaaaatatagaacatgggtattagttcattctcacactactataaagacatagctgggaatgtgttatttataaagaaaagaggtttaattgacttgcagttccacaggccgtacaggaagcatggctggggaggcctcaggaaacttacagtcatagtggaaggcaaagaggacgaagtcatgtcttacatatctgcagaaggaggaaaagagcacaaagatggaagtgctacacacttttaaacaaccagatttcatgaaaactgactcactttcatgagaacagcaaaggggaggtctgccttcatgattcactcacctcccacgaggcctctgctctaacactggggattacaattcaacatgagatttgggtggggacacagggccaaaccatagtaacatgtataatacatatgtatgcaagtactggaatatcaagtttcctggaggaagtagcttttgagcagggcctagaagcatgccaaggatttggatgtgtttgttgtgggtggatgaagtccatgaccagcaagcagactcaggagagttttgcagataagtgtgtccagaagcaaaacaggctgggaggagtggtggtgctggaaaggtggcagatgccgaatgatggaggaccttgaattccatagtagggaatttggcatttattttgtagctgtgggaagccatagcagtttttcaccaaagagataatttacatcaattattccaagccctcagattcactccagttgctagttcagttgtttggttcaaggaagcgtcagaaaggaaatgaaccagaaaggatgagtgatcctagagtccagggtgtccttggggtcagagggaggacaaggccttatgttccctgccttttccaggaggaagaaattgtagtaatattccaggacactggatggacttgtttttctttggaaacaaggttattgacctctctgccgcagtaagagaaaaatgatatatatgttagaacttgaatatttttgtagaaacttaatattaaaggccttatgttcaaatatgcagcatttcacagtgctggttgaattatttgggctaggttgccacatggtgttccatgtacaattctccttggtaggctgggttaaaaaatgtggctaggtaaaatgtgagatgagaaataaaaaaggatctttgttttttcatgcttgtgatacttaaataggctactgtgacccaattaagaagctcccagaggccaggtgtggtagcttatgcctgtaatcccagcactttgggaggccaaggcaggcagatcacttgagttcaggagtttgagaccagcctggccatcatggcgaaactccatatctcccaaaaatacaaaacttagtcgggcatggtggcacacacatgtaatcccagctacttggaaagctgaggcaggagaactgcttgaacccaggaggttgcagtgagccaagatcaggccactgtactctagcctgggtgacaaagtgagactgagactctgtcttaaaaaaaaaaaaaaactatccaggcgtggtggtggatgcctgtaatcccagctacttgggatgctgaggtgggagaattgcttgtacatgggaggtgaaagttgcagtgagccgaggtcaggccactgcactctagcctgtgcaacagaggctttgtctcaaaaaaaaaaaaaaaaaaaaaaaaagttcccagaaataacctctaagccacccatctaattggtcccagagagatcaaaaaaaatgcagcattgaaaatggcgtggaggcaatgacttagggtttatagacaggcatcttccctgtcgtcatccctgacatcttccccaagtgggctaccacaggtcctaggtgatgactggttaggccatgaagctgttcagagggacagagagctgcagagtttggggaaatccaccccctgcttccccagaaggagaagatgcatactaatctgttttggagacaatgcagaatactgattagccaaatatttgctggtgatggggatcactgtgtgtattcgttttctattgctgctataacaaattaccatacacttaatggtttagaacaacataaatccattcattatcttatagttctgaaggtcaggaatctgaaaagatctcactgggctaaaatcaagttgctagcaggactgtgtttctttctggaggctctaagggataatcttttttcttgccttttccagcttccaggagctgcctgcattccttggcttgtggccccttcctctattttcaaaatcagtaaagtcccatctatctgaccccttttccatcatcacatctgtctctaaccaactatagctgggaaaggtcttctgctttcaaggacccatgtgattcactgagcatacctggataaccagggtcatctcccatcttaagatccttagccttaatcacatctacaaagtcccttttgccatgtgaagtcacatattcacagattccagggattaggacatggatctcttttgggggaacatttttctgccttctatagtgtgtattaaactttgatgcttatggcatggccccgttttcgtatcttcttccactcagctaaagccttaggtgagcccgggccaccctggcagctgccctggccagctgatgtggtgatccatggagccagctctggttcatgccaataatctcatttatccagcagtctcacttggccttgaacaatttaccgttcccaaatatcagcatgtttttctgtaaaggagtgatggttcccaacaagaagaggttgacacactcaaattcaggtaatttgaggagattagaataaaaggattttaggtcttctgcggttgctagaatatttcattggccagtatctattgtcctcatccgcactgttgctggccatctgcggtcagagattcctcagtccagggcctgaccaaaaggacttgctccacttacattgcaaagcaaacaacagattcttaaacaagaaagatgatgccttctaaagcttggctattccagccaagctcaggggaaagacattttccctaaagtatcaacaagccatttgatctcagacttagaaggtcattcttgtctgcttttttctcccattagatgaaagaaaatgaaatgttttccgtaaaagtaatttatgaagcactccatatggcaatattaaaactgtaaaagtaagcctccaggggacaaaacaaataatgctgtgtcatccgtctgccctggtactgtccctgggtaatgtcaggcacagaacgttggggaactggctccccactcaactggtacttggatgcctttggagcttttccttgaacattgttgctaaggttcatgaaatcttcagatttttgttatggaatccattcgcaaagcaaaatgatcttaagtgtaaatactaaatttactgtaaattgcagacatcactacctccaagacccttttaatatattgagtcccactgaatgctggaatccaagataaagttctttaagaatatagcactcatgtcattcatgtattcattcgttcattgatgcagtcattcaagaaatatttactgagtacctattaggattcagtggtgagcaaaccactctaatgggtgatacaaatgcaaattagagcgatcgttgatatggagaaaagatagagggtttaataagagcttataacaggataagcactgggacaccatggacagattttaggtaggggagttaaatggtcatattttcccttttaagagtatcatataggctgcagtgtgggaaacagatcagagaggcttcagggcctgcccaaccatcctttacgagtgttgtttaacgcaaggtctcgtggtagacagtgttacatggttaaccccatttccattctcctcttgccctgcttccatgtggtatagaggctggaaaagttaaacaccttcttccccacctcctgtgcagctcagtgtagtcatgtgaccctgctctggcctgagacttgagcagtgatctgttgaggtcttctgggaaggaatatgcttttcctgataaaaggaatgagtgcagctgttccccctccccctccttcccacctttcacagagaagggatgactagagctgggcagccatcaggcaaccacaagggaaagaccaagatgttggtgttcatagaatagagcctctgcagcaatgtcagcaccacacacatatggactgcttgttatgtggaaaatatcagcccccatctttggagattggatttttttgttgtggttactttccatgaaaagcattctaaacagatacagtgattcaaacataggcttagccgaaaacaaattaataggcattttgatcattgtcatagttagcgggtggaatccccaaattccacttgtgccattgaaattgcagcctttgaatgggatgataaaagagggttggaaagaagaagggagccgtgatggttttcttccacaggcctgtggtggcattcctcagtgtttcacttccaacctccttggaacccatgcttatcttagcttcagcctccaacacagccttaactgtaagcctagttccctgagtcactctgaaatgtattagtccatgaggaaggagaacagattctgtcttctacctgttttcataactgtagaaatgaacacagtgcatggcacttggtaggtgctcagtgaatgtccactaagccagtacgtacacacaaatacatgcaaaagttgaaaatcgcaatgcattgtgtctttaaaaataaaaaagagaaatagcctgatcttttggaacacatatggggcagagcctgctcaatgaagcatgcacattttggattaagaaatatgattatcatttgtcagctctgatttctgcctctgggctgataagatggtgtccgaggagtcattttcactcctttgcagacaccaaaacagaaggggtctttgctgaaaggtagactctgacgtgacagtcattagtagctagaaacaggcaactgattgcaaagtcaagatgaagtgcttcagtaaaaagaaccttcatgcttgaggcatactctttgcttctttgttgaagttgtggtagatttttttaaaaaacaatcacaatatagtttgctatactttaagtttttaacatctccactggggaaaaattgaaggagctaagtaaattagctcattggatcatgaatttatagaaaaaaaattaatattgccctttgtcgtttctgttaggagtgtcacgggtcaaagcagagacaagaggcatggagaaggagcagtgtgagggcctctccgggtcatttctctgtctggcttctgatgctatctgcccaacacagtttctgaaaacatcagaaactccccagttttgcccaacatgcttcccctaccttgcacctcttagtgcagagacatgttctgtgagaatccacctggtaagacagacaacatggagaggaagatctcagagacctggcttcctttcctgcccttcccttgcagacagagttttactttgtgaagtctccagtttcagaatgagaaacctctgttaagcaaccaggcctatcactgtagggatgagaaaagtgaagtccagataggtgaagcaacttgtcccaggtcaacacagcatgtcagagaagctgaggccagccagtctcctgggttctcccccatgttcttcctactgcccctctgcggcttccatttgtaaagagaggattgcttctcctcactcctctcgcacactcttgaggctatttcagtgaattgtgtctatctttttatatttcccatttaaaagaaaacccactctatggcataatggtttccagtgtcctgctgtttggaagaatgttttacctgcctgtcagtgctgagctttgagctccttgaagaaggacattctcgtggctgtggcccatccaggcagaaccagcctagctggccaagtggtttctctgcatcgtttggctgtcagataagggccacctgcttattgattggcacagtgacgcttaagtccaaacatcctccctaatgacacagaacttcatattaaaggatgtcagggaattgattttgctcttctttaggaacaaaagatgtcagaagttagaaggaactgaacagtcaggaaaacgtaagtctctataccttcccatcaccccatccctgacccacaagccatgatcggccagtggaagataaatctaaccaatcccatgggacaaagggagagagccctgcacagcaagacagcagcagtcattgggcagaaataaatcatgagatggttgagaatctgattctctgggtcaatttctctgcatcctcctctgcccttttaggcctgtgctaaactttccctttgatgcaaatggtattaagtgccttgtgtctgaaaaggttgttggcaggctttggttgagaacataaagatgaatctttgttctcttgtctataaaatggggatataataatctacctcctgtgagaattcaataattttataagataaagctcttagagcagtgcctggcccagagtggatactcaactaatgttaactaagaaaatgaaaatgaaaatccaggaatagtctctgcctgcaaaatgttttgaatgtaaggagggagatgagacgctgtgtatatatgcctctgttctgtatttttaatcaactactaaggccatagagaacaaagagttacccctttttaaggtaaaataaattatactcattgtccagcaaggaagaaatgaattgaaaatcctagaggcagaaaagtgcagagtttggagactaccaggtggcactgagactaaaagctttatttgccatgttcagctcaagatttaatgggttgtatagtgtaaggggctaactccaggatctgctggaactcactctgggatccacagcaaacaaagcactaaccttggcatatggcgctgcgagaagtttcctaggatcagccaggctctgggccactcactgggttcatgcctctgaacattaccttccaggagctgcccccattactgaacctaatacgctactcagaagttttgtaaccaaggttttctaaaagtctgagaaatagaagatgaactttagatttgataaacagggctgtacactggagtcaggtagaggtgagtaggaatcctggccttgccacttactagctgtttgaccttggataaattgcttaacctttctaagcctcaatttcaatgtctttattaaataacttttatgaccgggaaatcaattaaataatttatttaaaatacttagggcagtattgatcatgaaatagatgttctgaaaatacttataatgattttgatcagttcctgagagcccacttgtaattttcattgggtctgtactcttgggacttctccagaaaccatgacaaggaattttagagagtattacccgatattgtagtggactgtgctcaagaatcaaatacaacaatgtcaaaaatttgtctgacacaacaaagaaatggactacctgaaatagtatatatagtccctaagagttttaaaatagatggtggatggtaataaattgaatttctgcgttcttagaaagggtgattcagagataccccaattctaagagtcactgacactgaatgtcaagtattttttgtggcttcagaaatttctgataaatgcattttttcagagtgttgttgtatcataactttgctgtagagcaaaccacttcaaacttagtgatctataaaaataaacatttatggccgggcgtggtggctcacgcctgtaatcccagcactttgggaggccaaggtgggcagatcacaaggtcaggagatcgagaccatcctggctaacatggtgaaaccctgtctctactaaaaatacaaaaaattagccaggcgtggtggcaggcgcctgtagtccccagctactcaggaagctgaggcaggagagtggcatgaacctgggaggtagagcttgcagtgagcctagatcacgccactgcactccagcctgggtgaagagtgagactccgtctcaaaaaatatatataaaataaaaaataaataaacttttattgcttgctcatgagtctataggccagcttaggtttggctgatctagcaatgggttcagtaccatttgctccagatgtctctcatcttccttgaaataacaactattctgaggcgtgttcttctcatggtaagagggcaagagaagggagtaactacagccatgcaggtacatagcaagtccctgttcatatcacattcaataacaccccagtagccaggcaaatcatatggccaaacccgaaagggaaaaggtagacactgctcactatgaggccaaggcaagtattcaggtgtatattaataccatgggggagtcaggaactggggggcaataattccttcttccacacctgtgatgttgcagactgttgctggagtgtagtcttctttctgttagttgaggggattgtttttttgatctagctgtaacccctgatgagtgatgtacctcttagtaaattgtgggcaaacataaggaaaaaggacctctttagtaaatgagccttctaagattcagtcgtgtggtgaaataactaaactgagtggaggacaaagaagtcacagaaccaatccttcaaatccagcccgcagcagcagaggtgtaaacagttactatctaatgtccactccggggtctacctgaattgaattgttggtttccttccaattctcaatgattttctggccattttcatagaaaccatcaatgtaactgatacttctggtttcaaataatatgctagatcaaaagcataaattaccttgaaaatgtgaccatttttctagctctccttggctatcaataaataatactcaaattgctctaaattgttggattgagtttaggagacaaaggccagcagtaactgagatgattaacatgaattgggataaaactccctcttcagttttcatctaacagaatgcaggtcttcagagaatgattgtcttttctagcataatactcatctacctcctgaagggctgggagcttagaattctttctcactctcagtacttcttagagaaacccagaagagtccagtgagaatggtttccctgtttggctgattttctgggaggcagaatggctcaggggttagatgccattctgggatctatggctggattcaaacttggctgcacacctgggtagctgtgtgaccctgcgaaagttgcaaaggttggttaacctctgcagttgtccctgatgttgatcacagatcttcagttcccctttcctcctgtcacccagaggactgagtccctggctcctttgtggttgggtggtgctatgtgaccagttctggccaaggattgtgagcaaacatgctctatgtaacttctggattacactatttaatacccagtgagaaactctccagaattctctcttgtccccctggcacattgaccagcaacatgcaaggtgatgtaactccaatgagtagggttcccttgttgacctacactagacatgtagcatgacagagaaataacctttgtgctaagccactgacatttggggggttatttgctgccataacttaatccaccctaccctgattgatgcacctcactatatctttgtttctttatgtgaaaaaatggagataatagtagaatctatttcatcaagtaattatgaggactaaacaggataatgtgtgtataatacttagaatagtacctagcacataataaatttttaatatattttagctatttatgatgatgatgatgatgttatgccgtgctctaactttgcctctaacaagttatctatttctatcaaacaagttattagtcatgtgtcttcaagaaaatcacttatcatcaagttgcaatcatagtatgttagaataagtgagctgtaagactaatttctagccttatgatgtgagcctctattaagaactcactcagagactccatcctggtgtttcaaagatatttctattggttaggaaaataaaacgtgataatactaaacattattttctccccttcagttgctctcccttccccaaacaaaaagatgtatccttattacagaattctttctgtatcctgttctgaagatttctgctcaggaaattactctggctcgtaaattattaactacaaattggttttccggtttaggcacctacaccctcatcagtccatccccattctctgttctgttttcaccagtaggatgtcaacagtccactatgatcttttttcctgatagcatggtcttaccaaaaggagaagttcctgtccttgaccaccttagtccaggctaaaatagctatccacataccaccactcatgaccactgagacctgttttccaacttcttcagatcagagctttccatatctggtttttctctcatgttactctagatgtatccttctctagtcccaaaggtagccctgtctgcaattcccaatagcagcatgttaatctatgttaacatattatattgaaccataagaaattgcctttgtggaaggggtgggggttgaatatagaaatttcatatggttcaacctatatgtaaacccaatttggaaaagaaggagactgtgatcacatacctattaaattacatgttggatcccatcaagaatcctaatgtatttcttcctccataccttgttgaactgggatcttgttccaggacatgacttatgctctgtatataaccttcagacctccctatacccagcacttggtagatagcagatactgatgctgtatttattgaccaactagatgggagctttttgtgatatctattgttgacatccatgtttatacatttgggctgtttaaaaaggtaccatttataattacattatgggagaaaataacacttcttttctttaacctctttcagattgaagacatcattacaaagatgcaagatgacaagacagggggtgtgcccatcagaacagtcaagagctttctctccaaaatccccagtgtcgtcacaggtaacaccctccttgcaaggtgttggtaacagtcagaactaccaaagagttataagtctagattgcggcctgaggggtgtctgaagatctgtgaatagtaaaaatgaaacattcagtgtgtttcttgactcaggtcccatcctagtcttagtttccaggaagaagctacttgttgcccatcattaagaatgaccttaccatgaccagcccttcaagtgcatgtagattgaggctgctgggaataaataaacccattaataaagtggcgcatcagcaactttgcctgtgggatacacacaagcacagaaatattaaagaaattaaacaggtttttaagaaagtgttatattcaaattctacaaaatgcttttattttcagttttttaactcagtgtacttgacctcctgaaagagaggttttaaactatttttcttcattccttatattgtgctttgtgtgctcatctttcttttaaaatattttattgtgaaatatattaaaacacatgggtagttcaaaaataataaaacacagtacatgtacctaccatcctgccttataaagaacattattatcaatatcttagagcccccttgggtacctactgtattgcatccacttccctaaacactatctgcttgtatactaatcaattcattgtttttcttcatagttttactacctaggtatgtatcttttgctatccaaacaagtaaccaaataaattaagataaaattttagatgattctcttaatctgcctatatgcttttcaaaattcgggaaccaaaggacttagttttcactatataccttttagaatggctaaaaataaaaatattgacagtaccaagtggtggtgagcatgtgaagcaactggaactctcacatattggtgatacgaatggaaaattgtgcagctactttgggaactagtttggcagtttcttacacagttaagcaatgcttaccatatgaaccagcaatcccactcctgggtattcacccaagagcaatgaaaacttgtgtttatacaaaaacttgtatgtaagggtttatagcaacttttattgaagtatactgaagaatatagcaactttattcatcatctccaaagactggaaacaacccaaatgtccttcagtgaacgggtaaatggataaacaaactgtagtctctccacaatcagcaacaaaaaccagggaactattgatactggtagcaacttggattaatctctaggtcatttttctgagtgaaagaagcagtctcaaaggttacatgctatgtgatttcaggtatacagcattgtatacatcacaaaaccgtagtgataaagattagatcagtggtttccagcaactggcatttgcagggcgagtgtgactgcaaaagacaacaggagggagttttatgagatgatgatgatgaacagatgaacagttctgtatactgattatggtgatggtaacatgactctatacataggccaaaattcatggaacaggccaggcatgatggctcatgcctgtaatcccagcactttaggaggctgaggtagggggatcacctgaggtcagggggttgagaccaccttggccaacatggcaaaaccccatctttactaaaaaatacaaaaattagccgggcgtagtggtgcgtgcctgtagtcccagctacttgggagactgaggcaggagaatcacttgaacctgggaggtagaggttgcagtgagctgagatcgtgccactgcactccagcctgggtaacagagcgagactctgtctcagcaacaacaacaacaacaacagaattcatggaacagcacacacacacacgcacacacagggtcaatattactgtatattaacctaaaaaataagtagacccagttgaagtaagtatcccagctcattattgagactgtcactctttgaactcaggtactgtcttactcagctcaggctgctagaacaaagcaccctacactgggtggcttataaagaacagaaattcatgtctcacagttctggaggctggaagtctgagatcaggtaccatcataggttctggtaagagcccattccaggttgtagactgctgacttcttcttgtatccttgtttggtggaaagaaagctagatagggggccgggtgccgtgactcatgcctataatcccagcactttgggaggctgaggtgggtggatcacctgaggtcaggagtttgagagcagcctggccaacatggcaaaaccctgtctctactaaaaatacaaaaaaaaaaaaaaaatagctgggtgtggtggcacgtgcttgtagtcccagctacttgggaggctgaggcaggaaaatcacttgaactgtggaggttgcagtgagcagaggtcacgccactgcactccagcatgggcaacagagtgagactccatctcaaaaaaaaaagtaagctaaatagctctctggcctctctgtaaagggtaataattccatttgtgaggggccctccttcataaactcccccaaaggactcctaatgccatcatgttggggattagatttcaatatatgaatttggaggagacacgttcagtccaaaatagagcccagatagatttgggtaatgaaggatacttgtattgttagtgttctctaattttaaaatttatgtaaatgaaattttactatatatattattcatgtataatatacagtataatatagactatgtatgtaattttactatattatttttcacattcctggattttgttcaataatgtttaagatgtttgtatctatttcacaggccacactgatctgttgtttttcttaccattgttgctggtttgggtatcaaatttatgctagcctcataaatgagccatgaagtatctctcttttcttgatatcctgcttttctttgaaaaataattgtccctttaatccaggttttaagtatgtaatttcaattattttttatttttaaaatttcctctggttctttttttttttttagacagagtcttgctcttgtcacccaggctggagtgcagtggcatgatctcagctcactgaaacccccacctcctgggttcaagcgattctcctgtctcagcctcctgagtagctgggattacaggcatccgccaccacacctggctaattttttgtatttttagtagagacagggtttcaccatgttgcccaggctggtctcgaactcttgaccttaggtgatccgcccaccttggcctcccaaagtactctggttctttttacaatatacttggtcattcatttttttaaatttattcatttagatatttattgagtgttcactattttctaagcattgttaaggacttgagattcagaagtaaatgaaacagataaaaagttctaccctcatggaatttatattctagtagaggaggaaataagtaaggaaaacttgcagaattttagattgtgataaaggccaaggagaaaaataaaatacacaaaaggatgggaagtgttggagtgttgcagctttggaataggtgctcaagaaagagctcctcgagaagatgacatttgagtaaagacggaaaggagatgagggattgaatcatatggatattgagggagagagcatgccagacagccagagctcagtgcccaaggcaagagagttcctggaacattgaggatctgtgaggaggagccagggcagctataatagagtcaagaaaataaggagagtggggatgaagccacgtgagaatggtgagcttgatcacttagcctcttatcactgcaggattttgcacatggcctgacatgctctgacttacctttcaatgagatcactctattatattcagaattccctgggggattgaggggttaggtgccagataggaggctattattaaaatggtgcctcagactaggtgatatggtttcactctgtgtccctacccaaatcgcatctcaaattataatccccacatggcaagggagggacctggtggtaggtgattagctcatggggaaggttctcccgtgctgttctcataatagcgagtgagttctcacaagatctgatggtttaaaagtgtggcacttccccctgctctctctctctcctgccgctatgtaagacatgccttttttcccctttaccttctgccaggattgtaagtttcctgaggcctccgcagccatgtaattaactgtgagtcaattaagcttctttcctttataaattacccagtctcagatcattctttataacagtgtgaaaatggactaatacactaagctatcagcactggagatgtgtgaagtagtcagattcggattcaagtctgaaggtagatgatatggtttggccaagtccccacccaaatctcatcttgaattgtataatagttcccataattcccacatatcatggaagggacctggtgggaggtaattgaatcatgggggcagttacctctatgctgttctcatgatggtgagtgagttctaatgagatctgatgatttcataaggggcttttccctgtctttgctctgcacttctccttgctgcttccatgtgaagacaatgtatttgcttcactttctgccatgattgtaagtttcctcagccgtgctgaactgtgagtcaattaaacatatgtcctttataaattacccaatcttgggtatgtctttattagcagcatgagaatggactaataccgtaaattgttactaggtagtggggcactgctgtaaagatacttgaaaatgtggaagcagccaggcgcggtggctcatgcctgtaatcccagcactttgggaggccatggcaggtggatcatttgaggtcgggagttcaagaccagcctggccaacatggtgaagccctgtctctactaaaagtacaaaaattagctcagtggtagtggcacgcacctgtaatcccagctacttgggaggctgaggcaggagaatcacttgagcccaggcagcagaggttgtggtgagctgagatcacaccactgcattccagtctgtgagaccctgtctcagaaaaaaaaaaaaaatagaaaatatggaagtgactttggaacatgggtgacaggcagaggaaggaacagtttgaagggctcagaagaagacaagaatatgggggaaagtttggaacttcctagagacttggagggcttagaagacaggaagatgtgggaaagtttagaacttcctagagacctgttgaatgactttgaccaaaatactgatagtgatatggacaataaagtccaggctgaggtagtctcagatggagatgagaaacttgttaggaactggagcaaagataaccctcgttatgctgtagcaaagtcaggtggcattttggccctgccctagagatttgtgaaactttgaacttgagagagatgatttaggatatctggcagaaaaacatttctaagtgcagagtgttcaagaggtgacatttgacatctctggacacaagagagcataaaagtttggaaaatttgcagcctgacgaaccagtagaaaagaaaaacacattttctggggagaaattcaagctggctgcagaaatttgcataagtaaggaggaaccaaatgttaattgccaagacagtggggaaaatgtctccagggcatgtcacagaccttcaaggcagcacctcccaccacaggcccagagacctaagaggaaaaaatgtttatttttcctcttaggtccagggccccactgctgtgtgcagcctagggacttaatgccctgtgtcccagctgctccagctatagttaaaaggggtcaaggtacagctcgggccatggcttcagagggtgcaagcctccagccttggcagcttccacatggtgtttgtcttctgggtgtgcagaagacaagaactgaggtttgggaacctccatcttgatttcaaaggatatatagaaacacctggatgtccaggcagaggtgtgctgcaggggcagagccctcatggagagcctctgctagaacagtgcagaagggaaatgtggggttggagtccccacacagagtccccactggggcactgcctagaggagctgtaagaagagggccactgtcctccagactccagaatggtaggtccacccccagcttgcactgtgcaactggaaaagctgcagacactaaacaccagctgtgcaagcagccaggaaggaggctgtaccctgcaaagctaccgggtcagagctgcccaagatagtgggagcccacctcttgcatcagcataacatgggtgtgagacatgaagtaaaaggagattatttcataactttaagatttaattagttacctattggatttcagacttgcatggggcctgtagcccctttgttttggtgaatttctcccatttagaacaggtatatttacccagtgcctgtacccacattgcatttaggaagtaactagcttgcttttgattttacaggctcataggtggaagggacttgcttagtctcagatgagattttggacttggacttttgggttaatgctggaatgaattaagattttgggggactgttgggaaggcatcattgtgttttgaaatgtgaggatatgagatttgggaggggctggggtagaatgatatggtttggacatgtccccacccaaatctcatcttgatttgtaattcccatagtccccatgagtcttgggaaggatgcagtgggaggtaattgaatcatgggttggttacctccatgctttcctcatgatagtgagtgagttctcatgagatctgatagttttataacgggcttttcctctacctcactcttcacatctccttgctgctgccatgtgaagaaggatgtgtttgctttcctttctgccatgattgtaagtttactgaggcctttccagccatgctgtactgtctgtcaattaaacctcttttctttatttcccagtttcatgtatgtctttattagcagcatgagaaccgactaatagagtagaacagatattattagcggatagatcagatatggaatgtgagaggaaaaaaaggaattagccatgatccacactttttggcttcagcaactggaaaaatggagttgctattaatttcaatgaggaatactataataggggtgccaggggttggggtggggggcagttgttagctgaagggtaagaaatcaaaacacaaattttaggtcaagttttagcgacctattagacattcagttggagatgacaagtaagtattccagtatgtggatttggattttaagggagtgtctgtgctgggttcataagccatcagcatgtagacagtatttagagccataggaataatgaggtcaccaagggagtgagtgtagatagaacacacagtccaattcctaaaacacagggtactccaatctatagatgtgagggagagaataagaaaacagcaaaagaaatagaacaagtggctggagacaaggaggaaaaatcaagaggatataatttcttggacaccaatttttctagaaagtgttttaaggaagagtagagtgacctactatagctatgctgagaagctaagggctgagaattgatcattgcctttagcaatgctgaattcattgctgaccttggtaagtgcacattctgtgaaacattgggagcaaaaatccttattgggtgtgtccaacctgagatgaggagagtgattcgaggtgctaagacagttaatcttggaaggagtttcccttgtaaaatgaagaaatgcagtcatatctagaggggtacgttaggtcagaacaggtagatttttaatttaataaaaagataatatgtttgtattatagaaatgactcagtgggggtgggggagatgatgtaggagaatgggaaaacttcaaggagttatatcaaagaataggtaagagaggattgaatttaacatgcatattggtgagtagtttcagctagaaacacatacaatttattcatagaaagaagaaaggaggcagccgggcacagtggctcaggcctctaatcccagcactttgggaggctgaggtaggcagatcacaaggtcaggaaatcaagaccatcctggctaacacggtgaaaccccgtctctactaaaaatacaaaaaaattagctgggtgtggtggcgggcacctgtagtcccagctactcgggaggctgaggcaggagaatggcatgaacccaggaggcagagcttgcagtgagccaagatcacgccactgcactccagcctgggtgacagagtgagactctgtctcaaacaaacaaacaaaacaaaacaaaaaaggaagaaaggaggcataatagatgcacagaggtacaaataagtgggcagatgtgatgggaggtggtggaagcttatagatcttctcattgtctctatgttcctagtaatctggaaaccaaaaatggtagagattttgcaagttcaaggagagatcataagttataaattagtcaactaggaaagtagagattgactggactagggaaatagaactttgattgtgactgatatggtttggctctgtgtccccactctgatttcatctcaaattgtaatccccataatccgcacatgtcgagggagatacctggtaagaggtgattggatcgtgggggtggtttcctccatgctattctcatgatagtgagcaagctctcacgaggtctgatggtttttataagtgtttgacagtttcttcttcacagactctcttgcctgctgccatttaagacatgcgtgcttcccttttcgccatgattgtaagtttcctgaggtctccctagccatacggaactgtgattcaatcaaacctctttttttttttttttttttcataaattacccagtcttgggtatatccttatagcagtgtgagaatgtactaatacagtgaccttcttaggatgattaatatttttgaatttaaagacaggtaatttttttccccatccacatttagctctgtggatttgggcatgcctcaggtagaaagtggacttaattgatgttatagcaagtttgaggttataatagatcaagacagaggcacagtaactaaaatgattgcccattacatttaattgagtaaggatgaaaacaagaacatgagatggatgaggaaccatgaagagtagtaattaccacaaattgtaagtcaagtggcaaagaaattttggagttttcagaggcaagagtaagagagctgaaaatatagtagatggtgattagatggtggcatgtttgaaattgagattctggaaagattgtgattattggcagggacaataatataagatataaccataggaacaaggcattgaaatgggataaagtgtaagatttttggaggagaggaggttaaggaactgagaggccatgatactggaagactgagctgtgtgaatattgaaatcactactgggggagtgttagagaaggtggttgtgagttaaaatctttatggaatgagaagcaaaggaccagggatcagcagatgactttcacaataagaggtacaggtggtttaatcagatggtatgggagtcaaagctgagtgtgttttagagaagagggaggggatgaaggtgatctgaaagcagcagttagtagcaggacagtcacttatctacctgtaaaccccatggtatataaagtgtgggagggaaaatagccaccacgtaagagggctgcagggaagcaggaccactggggaagaatgagaagatgaaaggaatattaactgattttatttatgattcatcatgagtccaagagggcaagtggaagggtttcaggaggagatggtgagtttatgacttgagtaataaatgcctgctgttgctatgtgccaggctctagagtagtcacagacgatataaagatgaacaaagacttgacccctgctcttaaaaagctattaatctagtgagagaaacagacacaggtagatcaatgatttatatgagctatgtgccataatagaagaatggacaaaatgctgtttgagtccaggagagagaatcatgaatttttattgggtatgtctagaatatttctctgagaaggtatatcagttatctatttctgtataacaaacccacaaactataattgcttacaactacagtgatttattgtttcttatgattatgattccatgaaccggcaatctgggcagttctgctggtctcagccatgaggccatagtcatctgatggctcaactgaggctggagggtctacagtggcctcactcatttgtttggccttggtgcttactcttaaactcttaactggggtctcagttcttctccatgtcaccttgtatctgccaataggttagattgggcttcttcacagcctcttggtcttagggttccaagcaggacaggataaaaactgcaagacctcttagggcctaggctccagaactcatacaatgtcaagtgtgccacgtcacgttcttcaaggcaaattacaaggcaaagtctggattgaagaggatggagaaaccaactccacctcctggtgtaggagtggcaacatcatgttgacattgggagacacgattcattggagggcattaccataacaatctaccacagacaataattgagaaccggaccttaaacataagtggaaacccaggaaaagtcattccacgtagagaaaatagaattttcatagcctcaaatacatgacaaacatgccaggtttcagtaagtataagcttgtttgtgtggttggagtttaaaacacatttatgtgtgtatgtatttgagaagaggagcatattggcagaacagccacaggaatgaaaaggatacaagaattacacctaataatatattataaaggaaagctgacttgtagactttgttccaaaggtggggctgcttttatctcaaaggtaacccatctaccctgctcagatggactgccgtcagaggttttaaatatgagggaattcacatccatgaagtggatggaagtttaagcaggaagaaatgaggagtgtggagactagttatggagtctagatgagggaatgtatgtgagaaataaggccatattaacgacaaccacagcatcaactgaaaccatggctgtacagccacgcatcattaaatacttataaaaaccccatgagatagaaaccgttattatctctaccaagtaatggaggaaactgctaattcaagagtaacttttccaaggtcacaccactagtaaatagcaggatctgttcctctgggccacccgtgtaaggatggtagcagtagggttcaaaagatcagaggaaacagtagaaggtatgattgacacaacctgctgacttgaaatagagcagagggtaactcatccaaaatggatacaccttaatatcatggattgaatacattcatttaactttttctcttctgaaaccccacaaaaattatagtaaaagatttttattttaaaagcatgatctaaaagttggaggcctctattacagtgatctaccatgggaaataaacatccttaaaaatcttgaaaagatagtccagtacaaagggcagtcagtgcctcactctcaagatgtgcagatgtgtgaaagactcatggagaatagtcttccaacacaggagacaatagccacaaaactcaagaatctgaaaaacaaatggatgagtggtaactgacaatagccctgaaacaatctaaccatcacttgtcagtggacaaggctaaaaaaaaaaaaaaaaaaaaaaaaaaactctatatttatatgatggagttctcaatgggctcagaaactggtaacatcagcagacttttctatctagttagaatacattttgccaacactctcacctacttaactactgcacagaccaatcactagctagtgtctattgtttagcaatatcagatcctgcacttggccagcacagctcaggctggtgttgaggtggttcctaagaccagtcaagccccaggacagaagacaaatctcatgcttacctctagttgctggcactagagtagagaattacatagagaaaaaacccaggtcactgagacccatgggtaccaaacttaaagttgaaacgcattaatacatggccaccctgttactgtggcaagagaagctgtatctacatgggacagtaatcagcccacacttcagcctttccaccagctcagcagcctccatcagactttctagccatttgagaaatagccagtttcccatcacaaaccagcagataccagcagatactccaacattggagcttccatttcaacagcaacagctgggggaataactttttctcttctctattgggaccccagttctttaataaaaattgaaagtaaagatgaaagaataatggacattataaggctggttaatcagcagtgtctttatttcttgcactgctacataacgtactgtccatacctacatgtgactttgctaaataaacagcaagtgatttcaatggaagaaggcaagaagatggagaccaatggcacgatgatgacagtctgctggtgaaagcttctttccaaagatgatattgatgaggaatgcatgagcatgtcccagtgcatccaagactctgtcactctcagaagctctgggaagctgcttgtcaccactttctcagcaacacagtgaaagtcagagaataatgttgataaaaagtagtatcttgctgcaaggcccgtctctacactgtcaagttaccacattgagttgaaaattttgccaacatatccagatcatcccaaaggcgaaaagagaagcaactgttaatgacctacaccaaataaatcaacaaacacatagcaatatgcggatgtgtacctttgtagtggatcaaatgagcctggacaagaaactctaaatggaaagttttagagcataaagagaacattctagaaaaagaatgtacttgccaaaaaagtcaaaactgagataaaggaaaaattgtagacctggggaatgtgaatttggaaaaataatttatgggtactgaggatagagataacaggggaggtatagctataagcagagcagaaaattgatatccagttttccagaattcacaggtgacatagaagggaaccattgtaccaagtgatacacaaagatcagagttgaagagatgtgatttcgtccacgagtccctttaaagctggctttgtggtgtgtttgtttacaaccttcctaaggtgtcgatgtctaccagttggaacagtgacacaagagatggtaggcatttcttgactttccatctcacaaattaaatttgtttggtgaattcctgaaggatccatacagagcctggactgaaagcacctgtttcgatcttatgtgctgaaagcaaaaccttttctcatcaaatgtttctcttctttgtctttctggctttcatatgtgtgatctaacttcattggttacatctttattaataataaatatctaataaaaatgttaataaatttaaataaatacattgaataaaaataacctatattcatctaacctgttttgggtaaaggaggttcctatacccaagataaggacttgaggaagttatgggtttgggagagaagacacaagatcagtcttgattatgctaagcttgaggttttgaagggttatttgggtagcactgtttaggagaaacttggaagtgaggagccaaagtcctggagaacattttatgtaagagatatgtatggatttgggagtcatcagagtctgagtgacccgggactccagggtcatgactgggaactataattttcacatcttcttctataagccatgtattagtctatctgctacccagccttgagataacatgctcacccaccccacatcttctatgattttgagtttgaaattttcccaccaatatgtaagggaaattatcttccctgctcagatcaggacaaactcataggtgaattcacaggtattgctgggatgaagagggagaaggaatgcctgttggttcacctgtgggttcgaaatgttgggattgggaaggttggcccagggagtaaatgcactgagttaggggatagatatgtttgggagaaggccaaacacaagagataaccattagaatataatctctgtcttagaaagtgaaaaattaagagctgtaaggggtgaggtttagcaaataaatatttctgagcaaaaatagagaattggagagagaaggaaatacggaagaaagaagaacccaacatcagatcaaagtccaaggctcattggctttttgcaggggaagtcacatacaaaccatctcatcttccagaagcttaagatttctgagcaaggtgcccacagaaagggtacttcagagccaccctaccaatcccttttcaggactacagaccaacctcctcagaccctctttgaatagtaagtaggtaacaaagatgatcactggagccaagatggtgagtcttcggagtttccaacctcagcgtgccagctctatccacgccccacctgccctgcaggtgatagacatatcctgggcagaatgcctgccagccccaggaaagcagccagattgtgcagctttgcccagctgtcatagacagtcattccaggataattctccatcacctgaatgtcatgaagaattttccagggactttggagatttatttcttccagaccaccctcagaaacacaaattcctagcatgtaagagccataagatgcatctagtctcacttattcttgcagtcaggaagattgagtaccagagacatgatgtaatgtcctcaaaaatcacagttaaggacagaaccaagactggaatctggattcctcactaccattgcaaactgttcccatgatctcatgcacaaaattatagactcttggattgcagcagtttcttaaaggtgtttgatgcgttctccctgaacatgagaatcacttgtgtaacttgttaaaaatagatttccaggacatccccatgggtctggactcgggatcctctattttcagcagcttctcatatttatctcctacagcctgtatgaatttgggaatgtgtaagacccctacagagtgctctctagcctctgttttaacaatctgcaatgatggatgtcatctctccttccatctttggacaactttgaccttgagaaacttttttttttgtaataaacctaccagcctcctcttgcttcactgcattagtcccaattctacctctgtatcacaaagaatagaggaatggatttgattaaaattatgcccacctagctcttccttatgaaattttcttgcacaaataattttcagaaaatatccaaggtatatacatgcatttttattttacttaacacatttttttatgaatacatttctgtcttttcattatccacaaatttatttttaatagctttatgtttacctaaacatttaaaagtattattcttacagtttcttggcaatacagtttggagtctaggctccaaacagcctatgtgacctgggttggtcactgtgtgaccttgagctagtcaccaacctctttgggcctcagttttctcacctgttaattgataggtttggattaaatgatatttgtagtccattctgactctgatcttctgagattcttcacaggatatgtataaaggcctgtctgaagttaattcttttcactttttctcacgatgttctaactgaatctacctctgagttaatttaggccaccagttttgtcttaagatgtgtgtctcagtctgtcttctgctgttgtaacagaatgccacagactgggcaaagaagagagaaatgtatttctcacagttttagggtctgggaagtccaaaagcatggtgccagcatctaatgagggatatcccatggcagtaggcagaaaatggaaggtgcatgtgtgtgaactggggatggggggtgcaaactcagcctttttattgggaacccactccttggatagctaacccactcctaggataactgcattaattcattctgtagttaatgcttctcactttttctcaagatgttctaactgaatctacctcatggaaccctcatgatctagtcattcattaatgatcccatctcttaatattgttactgtggtaattaaatttcaagatgagttttggaggggacatccaaaccattgcactgtggtacttccagattagaaaaccaaagaacaagaaacagcctctgttttaataacgtgcgatgatggatggcatcatcactcattccatctttggacaactttgacctttagaaactttttttataatgaacttccctgcctccctcttgcttcaattcattcatcccaattctatctctttctcacaaatagagaaatagatttcccaaattagtaattccctgagaattgcccaaagttaatcagtattcttagtctttgttactcttcttctgcttctgtatcactggaaggaagaactttaaaaatgcctcaaaatagagataatttgttggatgcatgtagagggctgaataatggccccccaaaatatcagcttctagttctttacatctgtaaacatttgttgataaagggtctttgaaggtatggttacattaagtatcttcatatgggtaggttattctagatcagggtgtctaatcttttgacttccctgggccacactggaagaagaattctcttgggccacacataaaatgcactaacactaacgatagctgatgaactagaaaaaaaaatcacacacacacacaaaaatctcataatgttttaagaaaattgactaatttgtgttaggctacattcaaagccatcctgagccacatgtggcccatgggccatgggttggacaagcttgtcctagattatctgggtgtgccctaaatacaatgacatgtatccttacaaatgagagtctgaggaaaatttagtatagaaagaagaggagaaggccatatggcctcagaggcagagattagaatgatgtggccagaagccaaggatgccagcagccaccagaagattccttagcacctccagagcaagtatggccctgccatcaccttgattgtggcctggtgaaaccaactgtggacttctggcctccagaactgtgagataataaatttctcttgttttaagccacaaagtttgtggtgatttgttgcagcagccatagaaaactaatacagtgccaaaattacactaagcacattatagtttaaagtagatgacacaatgattttttttagaaaaattgtgattcattaactgaaaaaagaaacaagcaaaaatttagttttcttccaaagttttatttgaaaaaatatagattataatattaattttgaaagcaaattatactaacatgaacttatgtagtagaattatttaataagcattcagcttaaattgcttaataaagttataaattgtatttgtccaggtctaatgtagtttaaaatatcttttggatatcataactaatcatattatttccacgttcgtgatggaattaaatcaattagttataaaataaaatttattcttaattagtatgccaaaatttatacatacataaaataatctcttaaaatattcacttcgaaaagtggtatatttatttcagtaatgcttccattgctttgattttttcagatttttttctccagtaagagcttttagaacttgtttaaatatcctcaacagaagcaaagccatgaattcataaccatatatacatttatataatcaaaattgatttggagattctgctttggagaatggtagactagcctactcagaccaactgtctgaatgagaacaattacaaaatctggtaaaaaaaaaaaaaattcacttgatgtcactggagagttaacaagagaataaagagttactgggccaagattcatgctaacataaacatccatagatatgatggtggccttgggtgctgtttttgccctggggacatttggtaatccaagagagcacctgtcagacgatgcctttattaaggcccatggacattatctcctatgccataggggttgtggatttgctagtttaaagaaaacacatgcaaagatgagagcttatttacctgactctggtattgactattaggttttaccatggtcagcagctgtgggctgtgtcaggtttgggtcagggagatgaggaacaaggaggctacatcttaaccgcacggggaggggacgttttaacaaggccaaaggtgatgaggtacatcagggtaaacatgtgttaggcctaaaaatggatgtcaaggcagcaactatattaaacaaatttatgatgggcagtgattactgtttacctctaaggggcagggagtatattgtgattgggacagtacctgcaagagactaccagagtgttgaaaaaaaaattttttaacatcaatcatggtaacatgattaaaataatgtaaactgttcccacagtatttcttcttagcacttttctgtttgtataatatttcacaataaaaatagctttccttttcctttttccttttgttttacaaaaagtaatttgaagtcagttcggtgaataaagtctgtaattaaagagggaaatgccaattgtggtttaaataaggtgtgactctgggtaaatgaagtcagttttcttgttgtccttaaaagctgtttcataagtttatttccaaagagcatttccaaaaacatttgtagcacagccaatactgatggaaggaagggtgtggcttttttagggccaactctgaaaatgacagtgcttaattaaatattgattatgctgtggttgccttaacaaatgtaacttcactgtaacatgttttatttaaatgtatgaatttttcttcttatgggattcactttagtaacaacctcttaaaatcctgtcaacttataactgtgaaagcaaaggcatatctctgatgctcctggcctttgtgtcattaaaatcttactctaaatgtcgcattaattcatcttttcaacatttttccttgtttgatttttttctcctggaagaaaaaatgctaagtggaatgaaggaaggaaaagacaggcagtttattaaaagtcaaaatataccatacaaacccctaattgtactctaaaatttctttttaaacgtttctattaaaaaattctgggccgggcatggtggctcatgcctataatcgcagcacttttggaggccaaggcgggcggatcacctgaggttgggagttcgagaccagcctgactaacatggagaaaccccgtctctactaaagatacaaaattagccagtcatggtggcgcatgcctgtaatcctagctgctcaggaggctgaagcaggagaattgcttgaacctgggaggcagaggttgcagtgagccgagatcgcaccattgcactccagcctgggcaacaagagtgaaactccatctcaaaagaaattaattaaataaaacattctgtttccaataagataaaatttgagaagagaatgaaatccagatttagtgtagctgacccgggatcactgactcttttttagagaaggaactgggaaactgcagtggacatcatgctctggagcaacagtgactatggatttcactgtatcatcggtcgcagcatggaattctatacactaaaatcgctggatgagatgctggtgggaagaccctaacaaaatcgtgtttctgacagaaagtgtatacacattatgagcaaggagaacattagttttcagcttagctccttgtgcagttgaatttgttactctgttctgaagacattggtgccagataaaagctttaaacacaaaacgttgttactgacatgttaatataattatgccacgtattatatatacaaaactttaaaagctaaatttagaagttattgctgtatcatttatataggctttgttctccttaaacacgttgactttaataaggcatgttttgtacaaataaagtctaattctaccatcagttgcagccacaggaaatttgaagtcatttttatataaaatttaaattccaacacttaattcaggttctatgacaccattttctagatccaagaaggaaatcattggctcaggattttctacagcgatctatcctgtatgttcctcagataatatgcccctagaatattattttttataagaattaatggcagaaacatttgagcttatcactgatggcatttgttgactatcaaaattgtctaaaacctcccacatttatccaggtataaaagtaaacttctaggttgggtgtagggtaggttgggagtcaaaagaggacactctatagagtcacagttcataggttttcctaaagaacactttctaaatctaaatttttcctcccactaagccaaatgaggagggctccagggaaatcactggtgatgattaggggtcctacaagaagcagggtgttaaccttctcactgattggattcttgctgagctgttgaacccatagctcatccttgcttctgctgccagagaggaaaatatggaaaagttcatgggccatttgccagagtttgtggatgtatatgaactgagactcttgaggctaagaggctgcatggggcagcccacaccaaaaggcaaatagggcccatattgtagtgtgatgcttaaggagaaatatatggaacactgacctccccacccccaggatccctgtgactcttggagggtcaagggagcatcatcatggagacagaagacagagaaagagaggaaaagaggaagccgagcccacccttttcctgtctaggtcctctagacaaagctgtgaagggaaaaaaaatagaagataaaatgggatttaaattttaaactggactaaattgcaagtgaccagaaagctaaagggtctgctcaagatgtcataagggaaaagtaaaattatttcccattggtacctcatcgagttcatattgttcaagaaactggatataatacctagtgacaaagagactaggacttctgttttgttcttgtcatacagccaaatattgttctggtcacacagccataacaatacccattggggcagaacactgaactggtaagaaagtaagggaaatttttagaggccttaaaatagaaagtgagaattcaggaaagtagactcgttttagattagtcttttctcagaggacatctgtccatcctgggtagtctagggcatgaattttaaaagcctatatgagtatcaagtaaaaaaattgagtagggtggcagtcagttcagagactcctgaagagcaatacgattattagatgagtagggggagaaggctttagagaaggagatgatggaaataatcgttttgtctttggctattaataggtgaaagacaggagaaaaagtctccctagaaaattcctaattccaaattctaagtctattcttgttggcgtgtctcactaaaccccatgtggcccaaaaattcaagcaaaaatttaaattgtctttttttttcccccactcagtaaagatttaatgatgaaaaaatgcaagttttataatacaaatatataaaattatgaaaacaatttttataacaatcatttgatagtctttttttaaaagactacagaaagtttaaaatataattttgtaattatagatataaacaatgaagttttataaaattaatcatttgatatttttaaaaaggctatccaaaggaatttaaaatcagaatgttgttgaaactgaacaccaactgtatctacatttatttctttttttaaaatactttaagttctagggtacatgtgcacaacatgcaggtttgttacatatgtatacatgtgccatgttggtgtgctgcacccattaactcgtcatttatattaggtatttctcctaatgctatccctcccccctccccccaccccacgacaggccgtggtgtgggatgttccccttcctgtgtccatgtgttctcattgttcaattcctacctatgagtgagaacatgtggtgtttggttttctgtccctgcaatagtttgctgagaatgatggtttccagcttcatccatgtccctacaaaggacggcattattcacaatagcaaagagttggagccaaccctaatgtccatcaatgatagactggattaagaaaatgtggcacatatacaccatggaatactatgcagccataaaaaatttaaactttctctatttcagtactgcccccagctaccaggaagaagcaaacacatctcctctctggagaagcacacattaaatacagaacaaaaaaatttccagataaaaacaaaagtcactggaaacataagaaaacaaaacaacataaggataagtcagcaaagagcacaaatggcagaatccaacacataaagattgcagacattgtaattatattcagattatagaataattattagatcatacgaaattgccatttttataggtcaaagctggtaactatctgcagttccatatgcttaacataatgtttttaaagaaataagagagtactggaagtatgttgaagaaaagaggattaaggattctcaaaaaggactagaagctttgataagtagccaaatggaatctctgcaaatgaaaaatataattgaaattagagacttaatagaaacattaaacagcagatttgacacagctaaacaaagagttgataaactagaagataaagcagataaaagtactcagaatgtatcacggaaaggcagaaacaaataatatgaaagagaggttaaaagacttgaagaagagagtgataaattctaacatctaaccaaattttgagaagtaaataacagagaaaatgggaagagcaattcttccccattgtctttattatttccttccaaatttaaagatctaatagttgacagtttttctgagtggattaaaagcatcgggttccaaaagccaaaaaaattccaagcaggataaaatgaaaacaaatctatatctagctacattgatgtcaaatttcagaacactaaacacaaaaagaatcttcaaaatgactagagagggccagctgaggagacttcacctgtgttccaagcctgagaaacagcaccatgggccacccctggcagacacgtccctaggctggctgagcagctgtgcacccatgtcctgggcctgagaaagagccccacagactgctcctggcaagcatgcccccaggccagctgagaaaccatgtgcccctagacagagtaacagccctgtggtcccaaccccagtgagccagaccccaagaaagctgacccactgtgtgcagacatatgcctccaatctgagcaacagctcagcaagcccacctctggaaaagttgcaccgctaccagcacaaactgtctaagcctaggccactgagacattcataaatatcgctagtatggattacagcttaagaaactactggagactatactactgtgtctacccagaagcaaagccaatgcactgcattgagcccacaccccaacacccacataaatgaataaatcttttcctattaaacctactccataaaattggaagaggtgactgtttcatcagatgtgtagaaatcaatgtagggacacaataaacatgaaaaagcaaggaaacagacctccaaaggaacacaataattccctagtaataaaccccaatcataaggaaataaatgaaatgacagaaaaagaattcaaaataataattctaaacaaattcagtgaaatataagaaaatatattcaatgaaatcatgaaaacaataagtcattattttaatgagaaattcaacagagatagatatcatttaaaatgaaccaaattctatggctgaagaactcaatgagtgaaataaaaaatacaattgagaacttcaacaccagactagaccaagcagaatttgttcttacttgaagacaggtattttgaaataatacaggcaaacaaatagatgaaattaaataaataataaaaaggaattaagtcaaaggatttatgggatatcattaagtgaacaaatatttgcattgtggacattctggaagaagagaagggaaaaggtgcagaaaacatatttaatgaaataatacgtgaaaactttccaagtcttgggagaaagatccaggaagctcaaagaaccccaaatagatataatccccacaggtcctctctgaggcacattttagtcaaattgtcaaaagtcaaagacaaacagcaaaagaaaagcttcaagtcacatataaggtaatctccatcagattgatagcagatttctcatcagaaaccatgtaggccaggaaagaatagaatgataaagtcaaagtagtgaaagaaaaaaaataaaacttgccattcaatattatgcccagcaaagccattctttagaaatgaaggagaaataaaaattttcgcagacaagcaaaaattaagaaaattcatcaccactagaccaaccttacaagaaacgcttaagagagtcttacatctagaagcgaaaagacaataaccactgtcatgaaagcatgcagaactataaaacttattgatggagccaatacacaaaggagaaagaaaaagaatcagaccatatcactacagaaaaacacccaactgcaaaaataagagaggaagtaaggaacaaaggatatacaaaacaagtaaaaagaaatcgataggatgataaaagtcctcaccgatcaataataaccttgaatgtaaatagattaaaatctccatttagatgtagactgactgaacagattaaaaatacaagatacaatatacagcccacaagaaactcatctcacctataaagacacaaatagactgaaagtgaagtgatggaaaaagatactccatgcaaacagaaaccaaaagcaagcagagtagctgtacttatatcagacaaaacacacttcaagacaaaagctacaaaaagagacaagggcattatatgatgacgaagagattaattcagcaagagaatataacaattgtaaacatatacacttaacactagggcacctagatatataaagcaaatattattagatctaaagggagagatagactacaatacaataatagttggggactttaacaccccactctcagccttcgacagatcatctacacagaaaatcaacaaagaaacatcagatttaaactgcactatagaccaaataatataaacctaacgacatttacagaatatttcacccaatagctgcagaatatgcattttttttcatcagcacgtggaacattctccaggcttgaccgtatattaggacacaaaacaaatctcaaaaagcttttcaaaatcaaaattatggccaggcatggtgtaatcccagcactataatcccagcactttgggaagacaatgcaggaggattgtttgagcccaagagtttgagaccagcctggacaacatagtgaggctttgtctctacaaaagattaaaaaattaaccacccgtggtgctgcacacctgtggtcccagctactcaggcggctgaggtgggaggctctcttgagcccaagagggttgcagtaaggatgcagtgagccatgatcatgcctctgcactccatcctgggcaatagagtgagactctatctccaaaaaaatattgaaattttatcaagtatttaatctgaccgcaatggaataaaactggatatcagtaacaagagggacatttgaaactatacaaatacacaaaaagtaacctgctcctgagtgaccagtgagtgaaggaaaaaatttaaagtgaaatttaaaaattccttgaaacaaatgtaaatagaaacacaacataccaaaacgtacgggacacagcaaaagctatattacaggcaagtttatagcaataaattcctaggttgaaaaactaaaaagatttcaaatcatcaacttgagatgcatctccagaaaccagaaaactgagaacaaaccaatccaaagttagtaggaaagaaatgataaagatcagagcagaaatgaacaatattgaaactgaaggaaaaaatacaaaagatcaatgaaataaaaagttggttttggaaaagaaaaacaaaattttaaaaacctttagctacacaatgaaaaaaagagaagactcaaataaatcagaaatgaaaaaggaaacatcacaatgaataccacagaaatacaaaggatcgttagagactataatgaacaactccatgccagtaaatttaaaaacctagaggaaataaattcctgaacacatacaacctatcaagattgaaccaagaagaaatagaaaacctgaataggtcaataacaagtaataagattaaatcagtaataaaaagtttcccaaaaaagaaaagcccagaattggatggcttcactgctgaaatctaccaaacccttgaagaaaattaatgctaatttttcttaaactattccaaaaatttgaagtagaggaaatttttcctaactcattctatgagaccagtgtaactaactagataaggatgcaaccaaaaaatgaaaaaggttatacaggttaatatccttaatgaacatagacacaaaaatcctcaacaaaatacaaaccaaatccaacaacacatcaaaaagataatacaccatgatcaagtaggatttatctcatgaatgcaaggatgattcaacatatgcaaatcaataaatataatacatcacatccatagaatgaaacacaaaagttatgtgattgtctccaaagatggagaaaaagcattcaatacaattcaacatcccatcatgataaaaactctcaattaagatggtatagaaggaaagtaccttaacataataaaggccacatatgataaacccacagctaacatggtactgaatggggaaatctttaaagctttttcactaagaactggaaaaagacaaggatgcccactcttaccattcttattcaacatagtaatggaagccctagccagagcaattggcaaaaaaataaataaagggcatccaaattggaaaggaggaaatcaaattgtctctgtttgcaggcacatgaacttatatgtagaaaaacctaaaggctatatcaaaaaactcttagaactgataagtgaattcagtaaagttgcaggttacaaaatcaacatacaaagatcagtagtgtttctgtacttgaacaatgaactaatgaaaaagaaatcaaaaaggcaatcctacttacaatagttacatttaaaaaaaacctaggaataaacttaaccacagaaatgaaagacctttgtaaggaaaactacaaaacactgatgaaagaagttgaagaggatacaaatggaaagacatctcatgctcatggataagaagaattaacattgttaaaatgaccatactacccaaaacaaactatggattcaatgcaatctctaccaaaataatgatattcttcacagaaatagaaagaatcataaaaatgtacatggaaccacaaaagaccatgaatagccaaggcaatcctcagcgaaaagaacatagttagaggtatcacactgctagacttcaaaatatactacaaagctgtagtaaccaaaacagcatggtactgttataagaatagacacagagaccaatagagcagaagagaacccagaaattaatccacatatctatagccaactgatttttgacaaagatgtgaagaacactcactgaggcaaaacaaaacagtatcttaaataaatggtccccaaaaaatcagatatccatatacagaagaatgaaactagacgctcatctctcatcctatactaaagccaactcaaaatggatcaaagacctaaatgcaaaatctgaaaatataaaactagtacaagaaaacataggagaaatgcttcaggacattggcctgggaaaagattttatgaataagaccccactggcacagactacaaaagcaaaaataaacaaatgggattatatcaaactaaaaagcttctgtacagtaaaggaaacaagaatgagaagacatcttacagaatgagagaaaatatattcaaacttttcatctgacaggaggtcaatatccagaatatgcaaggaactcaaatatcttgacagcaaaaaaaaaaaaccgaacaatccaattttaaaatgggcaaataatctaaacaggcatttctcaaaagaagacatacaagtgaccaaaaaatacatgaaacaagtgttcaacatcatgaatcatcagggaaatgccaatcaaaaccacaatgaggtatcattttaccccagtcaggatggctattatcataaagacaaaaataacaaatgctggcaagaatgcagagaaaagggaacttatgcactgttgatggggatgtaaactagtagagccactatggagaacagtatggaggttcctcaaaacactaaaaatagaactactatagcatccagcaattccactactggacatttatgcaaagggaaggaaatcagtatatcaaagggacatctacacccccatgcttattgcagcactattatatagccaagatatggaatcaacctagggtgtccaacaatagatggatgaacaaagaaaatgtggtatgaatatataggtatatgtgacggaatactattaggctaaggaaaagaataaaatcctgtcatttgtggcaacatggatggaactggaggatattatgctaagtgaaataaggcagataccacatgttgtcactcatatgtggaagctaaaaaatattgatctcatagaagtagaaagtagagcagaggatactagaggttgagaagggtagagagggggagagagttgttaaaggatacaaaattacagatagaagtaagttctagtgctctatagcactgtagaataactctaattaacaataatatatagtttcaaatagctagatggagaatattgaatgttttcaacacaaaaaaagataaatgtttgagatgatagactatgctaattactccaatctgatcactatgcattatatgtatcaaaacatcactatgtaccccataaatatgtacaatttttacatcaattttttaaataaaataaaacaactagaaataaaagacagattgcctatcaaaaaacgactgacagctaacttctatgtaaaaatggacgctacaaggcagtagaagaccatctttcatgtgctctgataaaataacaattagaattctacatgtaatgaaactatctttcaacaagagcaaaattatcatgcaaaagaagtgaaaggaatgtatcactaccctatctttaccaaagaaatgtctacaaaatatattttaggaagaagaaaaattatctcaggatgaaagtttgagatatcaaaaggaatgataaatactgtggtaagtggggcttaatctaaacaatcatggactgtataaagaaaaagcaataatatccactatgaggagttaataagaacccaagtgacttctaactactggaaaataagagcatgcaaattgggaaaggatataaacgtcctctattgttcggaaaaatggtaaagctacttagtagttttagactggtaagaacactcactggggcaaaaaaacagtgtcttaaaataaatgttgctgggaaaactggatatccagatgcagaagaatggcttcttaaaaagccattcttctgcatagctttttaagttgaaattaattaaagtcatgtagaatattaaaatttagtcacctgcattaataaaatttaaaacttatgctcatcaaaagatctattaaagtaaaaagaagccacaattggaagaagatatttgcagcacacaccaacaaagcattagaatcatgaatatataaaagacttctaaaaattgagaaaacaacaaacaatgccatagaaaaatgagcaaaaccatgaacaaacatttcatagaagagaaaatatacatgaccaataagcatacaacagttgctcaatgtcattaataatcatgaaaatgcaaattaattaaaactacagtgagatatcattttaattcactaaactggaaaaaattagactctgaccatgccaggtatgcacaagtgtgtggaacaaagggaatgctaatcgaatgctggtggaagtgtgcattcgcaaaccacattggaaaacgttgtggtgatgcctatggaagttgaactcttacatatttatgacttggcatctccactccaaggaatatattatagactagagaaacaattgtgcaagtgattgaagacactcatcttagcagcattgttcgtagcagcaaaattctggaataatccaggcatgacgtttggctctagaatggaaagagaaagcacattatagtcatatggtagaattatacaaatgaattagctataggctttaacaaggatacaattcaaaaacaatattcctgagaataagcacaggatatctcatgatcccaattatgtaaagtttaaaatcaggcaaaagtaagcattgtattatttagtgattcatgcatatttggttaaatggtaaaaatacatacttgaaaaggaggactaacttttgtggggaaagtagacaacaagaaatgtttaggtgtggaggtactcggtatcaatctcaaagtatactcataatgttttcttctttttactgggtggtgggtacctttattattttagaatacatctttatacttttacatatatgcttatgttgcattttgcaattaaaattttttcaagagtttacagttatataaacatatatactatatttacagccatgaaaaaattgtacatatatatatatatatatatatatatatatatatatacacacaaacacactagtatgtgtgtggatgggagagggagaaagattgattttaaaggaatataaaataaaggtgtatcacgaggtgggactaaatgaacacatttacttgcagaagatgaatttgactttactgtgcttttttggattgtgccgactcataaatctaactgggcttttagtagacaggagacgattgaacattattccatcttatgtattttcaaacagactgtattattttgggtgttgtgtgtctcacccacactgtcaagattctgtaaacctgcaacgtgatccattcggctgcgctctagttattatccaattatcatccattctgcttattaacaggcataaacagacagtatttctgcatggagctgataccctccattatgggtcaccggtcccgttcttaagtaggattgtgaaggaaaaaagcagagaacttcatcttcagtactaatttctctcacttaattccttctgttttactctttctcaagaatgggcatttatcctctactggtgaagaaagggcagagttgtaggagccatctacggtaaatgcaggctttcaaagggtggggggggacggtagagattttaaacgtaataataaaactgaacaaaatttgatctgctgtatgttatcactatgcaattctaaacagtgttagcatgaaaatattcctcccctagaaattattttgttgatctaagagtactgaattgctacagttacttttgcattgtaataatatatctgtaagcttcaaatcagcatattatattctacatggacgttaactcagagaaccaagagttgcacagggactgccagcacactcagtgacacacacacgttttgatcgtataataagtgcctaacagggtggaactgggcacagggcatgtctcagacctgtatggtacttttaaaaaaataagttaaaataaacactggggcatggtgatggaaaagatgaaaaaacagaacgtaagttatttcaatgttgtcactcggtgtggccacttggagtttatatttgcattttactgttgcatttgaaaattgttaaagtgaaagtgacaagtgcaagacacactctttttgtttggtaaatatacatttcagtccacacatgagaatagttattgaatgttagaagtatcttttaaaatgaaatgtatgttttttcctatcttttggttttaaaagtgaaagaaaaagaaattttagaaaatttaaccttatgttacttactagtataatttagtggttgcctaaattgtactgtttgcatacgtttcagttttattaaagatcacttattggctgttgtcagtaaagagaggatgttaaaaatgatgtgttctgagtgtcaaatccataggtgtactctgtgatcctcttttccgatcagttccccgagtgtcagtaggaaatctaaacagctaaggaccaagcacaggaggagatataaccaatggacttttaactgaggggacacggtttgcatattttttttatttttattttttattttttgagacagagtctcactctgtcacccaggctggagtgcagtggtgcaatcttgtctcactgcaatctccgcctcccggattcaagtaattctcctgcctcagcctcctgactagctgggattacaggcttccgccaccacacccagctaatttttgtattttttagtagagatggggtttcaccatcttggccaggctggtctcgaactcctgacctcctgatccacccatctcagcctcccaaagtgctgggattacaggcgtgagccatggtgcctggccggtttgcatatttgtaacggtgtctttagcacctgcccgtcatctttcctaaacttggtctgcttgagaacacaccttgcttgccatgtcgtttataggataattttccatgaatggaattatttgaatctcaaagattttgtcaaaaaatatattcaaagcttgggtgtaatagacattacacctgaaattacatcctttgcggttatctcaatgtactttaaaatgtttagacattatgctaaaaatatgttaaaagggggcgtcattttttcaatttctcttagggatcacacaaggaagaaaagtttttcaagactgctgatgtaaaatagtgttatcagacagtgttcacatttggagggattgttggtagccaagtctccttggtgtttcttgtgaaagaattcttgagaaagaaatatcaggcaattggggtatattccttaaacatatagtagggaatggggctggtgaatcagttctgaatgcctgttttcttctttaaaattccagccaatgatatgaagcccaggtatgtgggggccttttgatgacagtgagggtgagactaaggaagctgacctgccctgcccagggacacaaggctggctagcaacagagccaggacattagtcagtgtgtctggctctgaagcccccatgggggacactgtctcccatctcctttctcctgtgtttagccttgactttcaccttcaatgtcatgccagacaaagagttgctatggggcaagtgggaaaggcaaaactttttctgaactgctctttaatttgtcaatatagcccaaatctagttgcaatctggtacacttttagtcatgaacgagggtggaagaaagctaatatcacatgttgacctttcattttgccaccaagaagctctccttgaatattctgaaggagaacacgttcttgctgggggctggataaaccttaaaaatttcatgcccctgaatgagcatttcccctcatcacggacttgtccctggggctttcttaggcatgggcaggatgtggattgaaggaagaaacccagtgtcatgggcagcaaaggttgaatgtcttctgtgtctagtcctaacactgacttggagcccattcctcatcattttatcttactttctcccatctgaaaatatttacaaaatcatgtttgatgtcaaaatactaaatactatttggggggccgggtgtggtggctcacatctgtaatcctagcaatttgggaggctgaggcgggcagactgccagagctcaggagttcgagaccagcctggacaacacggtgaaaccctctctctactaaaatacaaaaaattagccaggcatggttttgcatgcttgtagtcccagttactcaggaggctgaggcaggagaatcacttgaaccctgaaggcggatgttgcagtgagccaagattgtgccactgcactccagcctgagcgacagagcgagactccatctcaaaataataataatagtatttggaggattttcccagagcatttgggaagcatttgtacacaaatgagtctgtgagcaaagggccaaggcaaggggcaggagctcagatgcaggctgtgttgatggggctcaaatccagagccccatgatccctatcccgtgctccactgcaccatcctattatcctattttgcattttatttttacattcctataaataaaaagtgcaatcaaataacttgaaatatggtattgcttttgtgcttaaaaataatctcagaaatacagcaaacatgccattcacttgaaattctaaaaaagggcaaaactatgttgacagaaaacagatcaatgatttcctggggtgctgggggtagcagtgggtaggaagagaattagctgtgaaagggcacttggaaactttttcagatgagagaactgctgtatcctgatggtgagggtggtttacacagctgtatacggttaccaacactcatcaaactgtgtgcttaaaacactgactatgcaatacctttatgcttatgtctttttataatttaaatagggagaaaaaatatgtattttgtaatatacatattaatacacattataagatatatataaatatcaataaataataccttatttggaaatagggtttttgcagatgtatataattaggcccaccctaaatccaatggctggtttccttataaaaaaaagggagagggggctgggcgcggtggctggcgcgcctaatcccagcactttgggaggccaaggtgggcggatcaccaggtcaggagatggagaccatcctggctaacacagcaaaaccccatctctactaaaaatacaaaaaattagccaggtatggtggcgggcgcctgtagtcccagctacctgggaggctgaggcaggagaatggcgtgaacccaggaggcagagcttgcagtgagccgagatcgcaccactggactccagcctgggtgacagagcgagactccatctcaaacaaaaaaaaaaaaggagagggatatttgagatacacagacacagagttatatattgtacattttacaaagaaaaaaatgtacatatatatgtatacctatatacgtatgacatccctttctattctgtcttccacaaatgtgagtataagtcttcacagtgggaagtaggaatgatcagagatggagtattagtttgccagcactgccgtaacaaggtcccacagaccagatggtttaaacaacaggaatttattatctcacagttctggaggctcagaatccaagatcatggtgggggcagggttggtttcttcggagacttctctccttggcttgtagatggccgccttctcactgagtctccacatcctcttccttctgtgtgtgtctgcatccaaacttcctcttcttgtggggacaccagtcatactggattcaggcataccctgatgacctcattttaacttattttcttctttgaggaccctatctctaaatccagtcacattctgaggtacatgggattaggactccacatatgaatttttggggggacacaattccacccataacagatggagaatagtgcttgaggtctttactaatttactcaccttggctctatttgaggttttctgccaggagcaggtattttataatttaaagtatacatatgggaaaacacacacacatacacatatatatatacacatatacacatatatatacacatatgtgtgtgcatatttcaaacaaggcagagatcatctgtgacccaaatatgtgctgatgagatcaatggactgtgctacttattggtcccataacatatcacttgtaacctctatctatgaccttccacgtcagtgcaataactaatacagccatcatacacagctgtgcaagagttaacattttattcttctgtgactgaacttctgtttcgagtcccccttttctcagagttgcatctcagttggtggggctgggggtgtctgtggtctcaggcagggaaggcaggcagctcttctggacctggccagagtacatggtcatttctccaggatggtctcccttagacagcctcattccctacctggccactcacatgtgttattgctgcaccctctgtcctgaccctcaggcttcttaagtttgactctgaagccgcactctctgggtttgaatcccagctctactcactatgggctctgtaccttggccacttcactttactttacttctttgtgctttgattacctcatctataaattagagctattcataatagtatctacttcatgtggctgttgggaggattaaatgagttagtatgtgaaaacatttgaaagcgtgtctgccccatagtaaaagctgtatactgtaagtgattcccattattagtagtagtagtagtattgttactgtgatgtcacatgcctcattggtgttttattttggggagcacataaagtactccatttgcctctcttagctgcaagagagaaattctcctgggttgtctcgggtccatgtgctggacccatatttctgctcctgcatcatgctgggaatacagattgtggagctggggtgcagggaggtgtatgactttgccagcttcctgtatttcccttgagaagtggagcggtgctaattgtccctgtcccggatgttccatcaactgtgtggtcccataccaacccctcaggggtgtctgcccaacccccaccccagctttctttccttctttacttagcatctactcctcaggagactgctttgcccagtatgccctaagataataaatgaccttctgagagtcaaatgccaggactcactcttggtctgtttgtcctcacccggctgctcccttgggggtaggccaggacacacactgggtgagaagcgtggtggaggaaaattatctgagttaatttatcaaaatacattattccccagtgacactagggaaaccttacagaggccccgccagcatcaaagagcaaggttctgtttcccatgttccgttacccgatccccagggcctgaaacagagtccagggaatatttggaaactaatcgtcatgagtggtagcatcctaagcagtaccattgtttacctcctaagatcccccaataattgtggttggctatttgttttctagtcatttagacacacacacaaaaattgtttttcaaatgagaaggggaatccacaacaaaaaactgtggctagcttattttcgagtttgaatgctttgtgtaaattaataaagttgaagtctatcccatgtgtataaaaatcttggagttatgttcattaatgagtctattgaattagttttcataaattcttctgattcaattgcatattcttaaattaacaacaaaagtccaacttgtatcattaaagactcaaaacagatggtgggaacagtaaagtgtaggaaagtgggaaaaatccttaaaaaataaacggttctttaaaataaatgaataccaaataaaacagaaaagtataaagagctatagttctttttttttttttttttttttaactgagacagagtctcgctctgtcacccaggatggagtgcagtggtgcgatctcagctcactgcaacctccgcttcccgggttgaagcgattttcctgtctcagcctcctgagtagctgggattacagatgcatgccaccacgcccagttaatttttgtatttttagtagagacggggttttgccatgttggccaggctggtcttgaactcctgacctcaggtgatctgcccacctcggcctcccaaagtgctgggattacaggcatgagccactgcacccggccgggagccatagttcttggtggaaagcaaagcttttcacatcagctagtgtagtgtctgaaaaagtcctcattatagatgggacaaaaagatttagtgggaagaagaaagagaacattgagacagttatgaaaagttttaattgtaaattttaattctcatgtgaaatgaaaattttgggatactttcacacacacacacacaaatgttatcctcagattaaaatatttatgtgggaaatgtttagaggtaaaatgtttagaggggaaaaaaccacttaccatgattgctgccagaaagggtaaaccttagaatcataatactgcagaatttaatgatcctttgtgagcttctggttcaacactcgttttacaagcaaagaaatggaggctcagagagattggttaggtgagccctgcaaggactcatggctaaatagtggtgaaatcagaagctaaagccaggttttctggcttttattccaggactgagatgtagtgacctgactctcgtaagtttctggcttcttccttttggagccacaggtaagcaccagtctagaaccttccactcagacttcatgctccagggttgtgaccagagcttacaagggtgttgtcctgggctggaagcagagactgtgaaactcaaatatacttaggcaaatgcaagcatatgaataaatcaccgaaatcaggacaaacagcttttcttagataaattgcccttggaaagaaaggtgaaaactaagccataatgcatgaatgtgttaattgtttttctcttctacagacactaatttattctgaagggaatgcttcatttccaaattctccttctactttaaagaaattcaaacttcaagaaaaaaattcaacaccatattgtgattgcttcaatagttaagaatttcggctgtcacgactgaaaaaaatcattagcaaaaactggccgtggaaaagggaagtctgtctagttcatgacaagcatccatcatcgtatgtgagttagtaatttctcacctctcatttgagagaggcaaggtacctgtgtgccattggggtgggctttccccgcagtgacagatccggatagatcaccagcctggctaagctccaagccttaaattcctttacttctcacccctgggccatttccgccacttttcctccatctcctttatccatttaacatctgttacatatatgtatatacacacacactttaagttctagggtacacatgcacaacgtgcaggtttgttacataggtttatatgtgccatgttggtttgctgcacccatcaactcgtcatttacattagttatttctcttaatactatctctcccctaggcctccaccccctgacaggccctggtgtgtgatgttcccctctctgtgtccttctgttctcattgttcaactcccacttatgagtgagaacatgcggtgtttcgttttctgtccttgtgatagtttgctgagaatgttagtttccagcttcatccatgtccctgcaaagggaatgaactcatccttttttatggctgcatagtattccatggtgtatatgtgccacattttctttatccagtctattattgacgtttaacatcttttatttatttttatgttttactttttgagacagggtctctgtcacccagactggagtacagtggtgcaatctcggctcactgtagcctctgtctcctaggttcaagtgattcttgtgcctcagcctctccagaggagactttgacaaatatatatatacacatacatacacaaatatatatatatatatttgtcacaaggatttgaccttatgcaattatgtttgctggttaagcagcctctgtgaggctgttgtctttacatctgaccatgagatgttggagcttgaagtccaagaggcaggtggtcagcagaggaagatggatatgaagtcgggagagcagggatgggctgggacccacaggcacacacagaacccatgaagacccaccggaactcaggtcagttatcgctgcctctctgggtgctatagttgtcctacaggatatgccggctcccatcatcacagacatacacacgcacctggcccaagagtcacagaagctgaaggaaaattcagggaaggtagagcagttgtgacttggctactgccccacccagcaacatgagccacagataaaacaggtgtgagctacagaatggctgccgcttccctgcctcctctgaatctcacatgtaagcatctcttgtggcccactctaacaagaaacattcaggaaaggagatctgggggagggggagcctctccaagctgacactttgcaagccacccagtctacaatgtggagaatggttgcaaagccttccacacttcttcctgccaatcctcaccctggtctccagggtcaagtgtgcactttctggggatgcagcctctccaccccacacacaagttgtaccgggaaaaactgagatttccagcaggcagagattgagaagcagcagctaataacattacaaggccatttggcagcagcgcaaaccttcaccattacaattagagcaagtggaggtaaaagagactctcttaatggccaaatcaaataaaaagtgacaggcttctgaagattatgttgaaccctgtatggcatgttaatgaaacaaagggtcagataccatttcatctgtggcttatctgcttagatagaagggatgtttttctgcctagtcctacctgaggatttccaagccacccctatgcatgaagatctgacacatttttgtccgcacttttctcagagtgttggggaaccaggactgagccagcagcgaaatattctgtgatgtaaggtggaatttagaataaaggtattttggtgatcaagcagctcaatggtccttaaccttgactgtaaccttgactgaatcacatgcaaagctttatagcctttctgatgtccaagctgcccagagatttttagggtgcacccaaggcatcaccagttagtaacgcatcccaggtgattccaaggtacaaccagagtctagaaccagggatctagtctaatccttttttcagataatgaagctaagtcatagagaagttaggtgtgttggccagtagtaaatacaaacagtagaacccaagtctcccaactcttaaacttatcaccttccactatatgccctgccatatctgctattgagaagagtgagaaacacacattaaaactgcatactctactgtgttccaagaatgggatgactttgaaatgcatgctatttgtagaatataggtagtgagactgatgcctggtcattcgcctacagccttaacacctcctggaagtctgattctttcagtttaccttgcccatagtgtgagacagagaaggaaaatagacgagtctcagaatgcattgttcagtggaatgcattttggaatgatcctacaaattacaggaaagctttaatcgccaataattaggtgtcttaaaaatggagttgtcttctggcgtatgctgacattatcagtccaagatagacttgagccaggagcctctgtgacagtatgctttagaaagagtgagagagggagcatgtgtaagctaagaaaacctttgtaaataagcaaagtcttattcaacctacagtctgtcctcagagctatcatttatcaggggaacccacccctgataattcaacatgagtccttttctattttccgtaagcgtcggccggtctgagaaacaaagggaaagagtacaaagagataaatttttaaagctgggtgtccgggggagacatcacatgtcggcaggttctgtgatgccccctaagccacaaaaccagcaggtttttactagtgattttcaaaaggggagggagtgtacaaatatggtgtgggtcacagagatcacatgcttcacaaggtaataaaatatgacaaggcaaatggaggtggggcgagatcacaggcccggggcgaaattaaaattgctaatgaagtttcaggcacgctttgtcattgataacatcttatcaaccgtaaaagacagacattcctagagcggccattttagagacctcccactaagaatgcactctctttctcagggatgttccttgctgagaaaaagacttcagcaatatttctcctatttgctcttgaaagaagagaaagatggctctgttccgcctggctctcaggctaccagacctaatggttatctcccttgttccttgaacattgctgttatcctgttcttttttcaaggtgcccagatttcctattgtttaaacaatttgtgcagttaacgcaatcattacagggtcctgaggtgacatacatcctcagcttacgaagatgacaggattaagagattaaagtaaagacaggcgtaagaaatcacaagaatattgattggggaagtgataagtgtccatgaaatcttcacagtttatgttcagagattgcagtaaagacaggcataagaaattataaaagtattaatttggggaactaattagcgtccatgaaatcttcacaatttatgttctgccatggcttcaaccggtccctccgtttggggtccctgacttcctgcaacaataattatttattttaaaagaaacaaaatcaaattattagacatttcaatctgtggtagtaacatgatattctggcatctactttcattatcacctttattaaaataaatttaaagaaaaatggcagtatgtttctgtgaagaccacgagtactcattttaaaggactcaagagttgcagaaaagtaaaaagaaaagagtaaaatcattttctaaatctcaccttccagaaataacgatgttgagcattaagtggacttcatttcatactctttcaaagattatgtaggcatatatatgtgtgtgtatatacatatatatggatacatccttagagaagttggctggctagatagacacactataaaaatggaatcatactctaatgccatttttaatttaaaaaatacatattcagatccactgtacttatatacagaagtaaatgaaactaaagtaacacgagaggaattctgaccctcatataattttttttactatccaacataattattttttttattatactttaagttttagggtacatgtgcacaacatgcaggtttgttacatatgtatacatgtgccatgttggtgtgctgcacccattaactcgtcatttaacattaggtatatctcctaatgctatccctccccttccccccaccccacaacaggccccggtgtgtgatgttccccgtcctgtgtccatgtgttctcattgttcaattcccacctatgagtgagaacatgtggtgtttggtttttttcccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgccgcaataaacatacgtgagcatgtgtctttatggcagcatgatttataatcctttgggtatatacccagtaatgggatggctgggtcaaatgatatttccagttctagatccctgaggaatcgccacaccaacttccacaatggttgaactagtttacagtcccaccaacagtgtaaaagcattcctatttctccacatcctctccagcacctgttgtttcctgactttttaatgattttcattctaactggtgtgagatggatggtatctcattgtggttttgatttgcatttctctgatggccagtgatgatgagcatttttcccatgtgttttttggctgcataaatgtcttcttttgagaagtgtctgttcatatccttcacccactttttgatggggttgtttgtttttttcctgtaaatttgttggagttcattgtagattctggatattagccctagccctttgtcagatgagtaggttgcaaaaattttcttccattctgtaggttgcctgttcactctgatggtggtttcttttgctgtgcagaagctctttagtctgattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaggaagggatccagtttcagctttctacatatgtctagccagttttcccaacaccatttattaaatagggaatcctttccccatttcttctttttgtcaggtttgtcaaagatcagatagttgtagatgtgcggcattatttctaagagctctgtccttttccattggtctatatctctgttttggtaccagtaccatgctgttttggttactgtggccttgtagtatagttagaagtcaggtagcatgatgcctccagctttgttcttttggcttaggattgacttggcaatgcgggctctttttttggttccatatgaaccttaaagtagttttttccaattctgtgaagaaagtcattggtagcttgatggggatggcattgaatctataaattaccttgggcataaattaccttggccattttcacgatatcgattcttcctagccttgagcatggaatgttcttccatttgtatcctcttttatttcatttagtagtggtttgtagttctccttggagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgcccgtttccaaagggaatgcttccagtttttgtccattcagtatgatattggctgtgggtttgtcatacatagctcttattattttgagatacatcccatcaatacctaatttattgagagttttttagcatgaagcgttgttgaattttgtcaaaggccttttctacatcttttgagataatcatgtggtttttgtctttggttctgtttatatgctggattacgtttattgattttcgtatgttgaaccagccttgcatcccagggatgaagcccacttgattatggtggataagctttttgatgtgctgctggattcggtttgccagtattttaccgagaatttttgcatcggtgttcatcaaggatattggtctaatattctctttttatgtggtgtctctgccaggctttggtatcaggatgacgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagagtgtatgtgttgaggaatttatccatttcttcttgattttctagtttatttgcatagaggtgtttatagtattctctgatggtagtttgtatttctgtgggatcagtggtgatatcccctttatcattttttattacatctatttgattcttctctcttttcttctttattagtcttgctagtggtctatcaattttgttgatcttttcaaaaaaccagctcctggattcattgattttttgaagagttttttgtgtctctatttccttcagttctgttctgatcttagtcatttcttgccttctgctagcttttgaatgtgtttgctcttgcttctctagttcttttaattgtgatgttagggtgtcaattttagacctttcatgctttctcttgtgggcatttagtgctataaatttccctctacacactgctttgaatgtgtcccagagattctggtatgttgtgtttttgttcttgttggtttcaaaaaacatctttatttctcccttcatttcgttatgtacccagtagccattcagcagcaggttgttcagtttccatgtagttgagcggttttgagtgaatttcttaatcctgagttctagtttgattgcactgtggtgtgagagacagtttgttataatttctattcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccaagtctctttgtaggtcactaagggcttgctttatgaatctgggtgctcctgtattgggtgcatatatatttaggatagttagttcttcttgttgtattgatcccctttaccattatgtaatggccttctttgtctcttttgatctttgttgatttaaagtctgttttatctgagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattagagcatttggcccatttacatttaaggttagtattgttatgtgtgaatttgatcctgtccttatgatgttagctggttattttgctcgttagttgatgcagtttcttcctagcatcaatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttgaaatgaatgaaatgaagcatgaagagaagtttagagaaaaaagaataaaaagaaacaaacaaagcctccaagaaatatgggactatgtgtaaagcccaaatctacatctaattgatgtacctgaaagtgactgggagaatggaaccaagttggaaaacactctgcaggatattatccaagagaacttccccaatctagcaaggcaggccaacattcaaattcaggcaatacagagaatgccacaaagatactcctcaagaagagcaactccaagacacatcattgtctgattcaccgaagttgaaatgaaggaaaaaatgttaaggcagccagagagaaaggtcgggttacccacaaagggaagcccatcagactaacagctgatctcttggcagaaactctctaagccagaagagagtgggggccaatattcaacattcttaaagaaaagaattttcaacatactgattttttacagatgccttatcaaaagagattatgaaagctattggaattgtaatacttttattaattaatggttcacttttatatagtatcagtgaacttcgagcaatgaaagaagatgattttaatgcttccttcatttctctatcacccacctcctgatttttatagatcattatcattcattcattcaaccagtgtttatttagagaatactttgtgtaaggcaccttcaaggtgctgagcctagagctataagctatcgatggaacagacaagattctcacacataatggggcttgcattttaatagaaagaaaaaataaatcactattttgacattgcgctgattctgttcagtaaccataagcctcataattgttcagtattgtttctatatttgaattctttctatgcatatacataagtagaagtctggcagactagagagatagccagactcacttttataaaaatgggatgatactataaattcacttccgtcgctgacagcccatcctccacctaccttcttatctctgatcctccctagcagccctatccaggtttccctggttagaaggagaagctcggtcttttccagattcacagggaaaggttcccaagcaggaggagtgaggaggagccaggtggcagggccaggccaggccaagcctttctccactgcttctctgcagaatttccttggctgctggttttggaagtgtgtgacattaggttatgtccatttccttggttggtggctgctgataaaaattttgactggtttcactattttgatgctataattcttcatttttttttaggcattgctaagttagataaatcttatgttcagtcttttctatcttatctttaccccaagtctacctccttaaaatacttttatgagcacaaatccctgatgtaaaatcaagccataatgtgtttcctggagtaggggcggacaaatatgttaactaaattctttttgcgtgcttcatgttggatcaattcttaaggaataattttgactgagcctcttttaagcttttccaggcctggcttgttttcctgaaaagcttcaaagcagagaggagaatctttgtcagttagctgggtgagtggttcacaagcctcactgttgtgacacactccgtcatttgtgagggcatcacagccattttgttaatagaaatacagagccaaaagtcaaacatgattttatatgtgtgagatgttgcccgagggaaagggcaaagaatgagaagagctggactgggcaactctcatgtgaccccaggtccctttcaaagttgagtttctctagcaagtttgggatttccaaatgtttctactgagaaaaaaaaaaaaaggaaacgtgcaattaaattagaaaactacacagctcttactgaagagctgaaattttaaaaagatgcttaaaataaagcaaggaagataaggagaaagaaacataaagcatccaaacctgaaagaataacattcagataggctaacactcagaaaagattggagtcttgccaaacatcctgaggtcagccgccaccacagcaaaaagactgtttgatttggagtgacaagaaagatgatgtgatctcagaggaaacagatggctcactaaagatatttgaggatattttaataaaaagaagattttaaaaggtgtgagtaggatacagggaaagtgacaaaagatggagcaagttggaacctgatgggagtaatctggggggaaggaacccatagcagaagtggtggctctcaatggtggagcccagccaatccgtgggatcgggcaggaagggagctgacccactgtctgctccacgacctcctggtgctgcctccccttggctgaacccagccagaaggcaaagagagacccattggtccattccgtccaagatctctctcagggctcagagcagcgtacagaaaggtagtgtttctggaggaacaaatagaagatatccagcagtaagggcaaggaggcacagaagtacttcctgcttcaaggggttgagtggctatggtagttgatgttgagaaggcagatgaagtaaaagcaacttcgcatatatctttcctatcaaagacaatggtctaactggaaagaaaacaataaacagggttgtgactaaaaactgggcaaatgatctaaacagacatttctcaaaagtaaacatacaaatggccaagaggtatatgaaaaaaatgttcaacatcaccatcatcagggaaatgcaaataaaaaccacagtgagatattatctcaccccagttagaacggctatgatcaaaaagacaaaaaataacaaatgctgacaaggatgcaaaaaaaacccacttatactgtgttggtaggaacgtaagttagtacagccactatggagaatagtatggcggttcctccaaaaaactaaaatagaactaccatacaacccagcaatcctactactaggtttctgtattgttttgttttatattttttgtttttttggttttttttttttttttttttttttgagaaggagtcttgctctgttgcctagtctagagtgcaatggcatgatcttggctcactgcaacctccatctcctgggttcaagtgattctcctgcctcaacctccccagtagctgggattacaggtgtgtgccaccacacccagctaatctttttagttgagatggggtttcgccatgttagccaggctggtcttgaacccctgatctcaagtcatctgcccactttggcctcccaaagtgctaggattacagataagagctaccatgcccagccccattactaggcatttatccaaaggaaaggaaaccagcatatcagaggaatacctgcaccccatgtttatcacagcactattcacaatcgctaagatattgaatcaacctaagtgtccatcgacagatgaatggataaagaaagtgtggtatatttatacaatggaatactattcagccatttaaaaataaaactctgtcattcatggcaacatggatgagcctggaggacattacgttaagtgaagtaacccaggcacagaaagacaaataccatatgatctcattcacatacagaagctgaaaaacagttgatctcatagaagtagagagtacaattgtagttattagaaactgagaagggtaggaggggaggagatggagaggttggttcaaggttacaaaattatagccagatcagaggaatatgttctagtgttctatagcactgttgggtgactacagttaaaaatttttgtatattttcaaatagctagaatagaagattttgaatgttcccaacgtaaagaattgaaaactctttgaggtgatggatgtgttaattaccgtgatttatcattacacattgtatctatcaaaataccactctataccctataaagatgtataattattatgttcaattaaaaataatgtaaggaataaacaatattgaaagcaaaagaaaaaatcccaaagtggtcaaagcaataagccaatacttaactcctttaagcccatctgcaggcctaaatgaatcttacctgagagtgctgaaagaaaattatgtttaatttccagaaagggtcaaaagagtacattattgaacctgtaataaagttactgaaattaaaaggaatgttaaagatctcaggtttcttgatttcaggaagctatttgatggagcctttcaaagtttggttggtaatgaatatgctggagaaacaccggccatacaagaaggtttccctgacctgggatggacagtcatgcacagtgtttactagtgttgctcgcatggcatgaggaggaaagggcacaggacccttctttttgacccactcctattcaagtttctatgaaggtcttgaatgaagataggaggtgtaggtcaaagtcgtggttatgactgtttcaaagtcagaaaggagaatcggttctgtggatcttacaagctcctttaagatgcctcaggctatgaagctgtgggagagctggaaattctggatggatgggataatatttcctgaagcttgagggaaggtgtttgctgaagtttgtccaatgtgctctgtatgaagccagaacccaatgtcccatctgccttgttccagcactgcctcggattccagatcctgagaaccaccctttaccccagggaaacccctgatgccaccttctctgctgccaaccattatgtggtgtgagctgtccccaggttgcaagtctctgccagcagccctgcatgcttcaagactctctgtgtggccccacagggcaagcacaacaaagaggtcaaatgacagaatttcaaaagatttcaactgatgaaccaaattaaaggacatgttaggtattggaattttccaatttacagagctagtttgtcctagcattggccagaatgaaggctgaaagagtggcagggctgccaccatggttactgcagcaggtggaattcgagtgcctgaattgagggaagtgggggtcctcctgcatcccgagatagcgagagcacctcagaagtgctggcttaggtggtggcacccactgtaagagaacgatgacaaatctcagtttctccctaggagagtgcccagcagggtgatgagccaggaagatctgtcaggatgaagagtagtgagaggaagggggaaccctggagaagagaagaacttaaagggattcacaagaagttgaggagggcagagctgaatgagacaaggttgcagggaaacagactttttaagatcagtgtaagggaaaaaaaaatccttgacaatcagaattgtttcaaaacagagtcagcagcttcttgagactgggtcgctgtgctaagaacgtaaagggggagctgggtggcaccagcaaagtggcaggaatgtgtccctgcagggtctttgctgccttccgaatcctctcctttgtgatcctgtaatttgtgagagagcctggagggtagcatggaaaagagagaggagaggacctgacagcagtatttccatcttgtcccctaacaattgcctaggcagtctcctctcagcagggaagcaaactggtcaccaaataataataattatccccctacatttccttaattatttaaacttctgaaaggacatcaaacacagcaaagagtcaatgacttgctttcagaagtgattcagactgtagctccacccataacagtgtcaccttgagcagtcacatatgccttaacatccttctttctaaagcaattccatcttcccaggttgattgttgagcgtttagacatgatgacatatataatctttatatatgtatatttacaagtatatgtttatggataaattttgactgcctgtaacccatgtggccttgtgtcatcacacataagttcactgaagctcccaacaaccagacttttggggaagtacaaacctccacattagcactaggtctccttgcctgcccctctgctggaagaatccctggcaggggccttctttggtgatgggattgaattttctatttcctgaaatgtaatcagctttcagtttcaatggtggtcacccccttgtaccttcttttaaagattggaacgctgtattggtttctcagggctgctgtggtcttcatagaagatgacccgcgtatttccaaggtttcctccaggattgctggggctgtctgcgtccagatgttaaggttactgtagacaataaatgggagagggtgaaggaaggaggatgtttagagaaaattatccagtcacctggaggaaaggctcttagctgcaaaagaggaaataagggccaggcacagtggctcatgcctgtaatcccagcactttgggaggccgaggcaggcagatcatgaggtcaggagatcaagaccatcctggccaacatagtgaaacccatctctactaaaaatacaaaaatcagccgggcgcagtggcacacgcctgtagtcccagctacttgggaggctgaggcaggagaattgcttgaacccgggaggcagaggttgcagtgagatgagatcgtgccactgcactgcagcctggtgacagagtgagactccatctcaaaaaaaaaaataagaaactgctatttagcacaacatcaaataagcagtttgttgcttatgtctgaacacttctgtgaaaacaggcaaaggcagtcgtgtgtaggttctggtgaccaggaactggagctgcacagaggtgtagaggctcccaaagctcgtcaattgtttatgaagggagtaaaggctggaagtcagggggtgggtgtcagtttctgccactagctaccagatttctcctaaagatgggaaagctccctttatagagctggagtgcaattttgtgttttctttgtgtttggcaatgtctgttactgacttgcaatagatatgcaacagtataggtatgttcatcttagtattttggggacaaaactcccaaaccagccaccacacaaatgtatttataggtaccagtaggcacctttggactcggagggaagtcagcctccttaaagccgtattcagtaaggagaatgaagggtaggcatggctgcagcttgggttgtgcccaccatgtggatatccagccatgatctcaatagtcaggttggtccacattgtccagatatctccatgtaacattaactcagactttatgaaaataaccggtgagaataaccaaagccacattgggtaatgaaaactgtatgtacaattttctttagttacattgatgttgttacatactgttcataattaattacattggtttgtaatgtatcatgtcctattgtattgtaggttctaataccaagaccctaggtgttcctctcttaaaagctggtgaccacctttaactcatgtggtaaaagaatgatagttctgggaggatctgcattctctctgtgtccatgcagcattgccccacactgcctgtgctgagctgcatgatcctcatagctacatcatagtctttgcttgtaggcttgtcgtttggagaaccgtcttggagtctttattggttgatgtcaatggaaagctctgcttccctctggatgtcctatggtattgctgttcctaatgtctttctaatgagtgctacgtgtctgtatgtgtgtataaagagatttatgtaaagaattggctcatgtgattacggaggctgagaaaccccaagatctgcatttgccactaagtactcagatatttggtcaaacatgattgtgagtgctgttgagtgctgtattttttaactgccacgtaatcccctcaaggtccgtgttattctagacagtaaaccgggagaggcttctaaagccccctttgtcaggaaatgttactttagaatctgaccttgtgtgaaacacagatgacagaacctctctagtgcaatgacattaaaatcctcccccagtacttgaagtgcaagggaaatagctcattgctattatggctggatcatctcatggcctctcaacagatcaagagcaccattactactgttgctttcttgacttgtgttttacttttattctaacatttgttgcagtctgtgttaaatagggaggtagaccaaactatgagaaggagccctatattggaaactgtatagccaactatgaaacctccaggcttactttgctttctcattacaggcggccttcccctctgctccactggagagagtcagagtaattggctcttgctttatatgaaggatatgctcccaaaaaagttgtatttaaatcaagttttaacaaaccgactcatgcttgtttatccacttataacacttactatttaaaggaaatgataaagagtccttttctgttgttacagcgtagttggcaaagctgtatcttctgaagactgacttgcactcagcagttttagatcaactcgagtctgtttatactaagatccacagacccctggtggttctcagatgacttgcaaattctactagtttttccaattgtgtgttttttgatgataacttaaaaattttttatgataatcttttcattgtttagtataataatgtacagataaaccctagatgatcaccttataactgagtgctgtcatgagatttcagtgcctttgttctcagtcctgtaggtaaccaagacttcatctaaaatcacatcacttgactttaaatgtttgcaagacacatctgactgtcattgggttgataaaatctgtcttgtcctcattttgtgttgtgtgggactctatcatcaggtacaaaagcaaaactcctttgccatgagcgttcacagttgaatgacttttttatagaccaagagtttagtttcttagagtatatattgaatcaatttggcatcatggaaatggcatagtacattagaggcacatactatgttaactgtcacaatctaatgataaagaacagaaaaggacatattacataatcggtgcatttctgttaaagtcatggcaagcttattgaactagttttatagcaatttggcaggataaaaatgatgggaggatggagtcatcatagggtgcctgccctgtagcatggacacctgggacacaccttgctggatgatgtcttctttgggttccatcttaatacatgacaactggaaataattctgtagcagaaagtagagtgtaaaatagaaaatgactcttattctgatgaatcaaagtttttaagccatatatgtcggagtacacttgaattacttctgtaaaaactagcacattatataaaaatcataataaaaacagagattccagtgaggggtccctcttgttcagagtcgaaagattcaagtcaacaaaaatggaacctgtaagttagtctttttgccactgttaaaagaaaaacactggacacaatacttttaacagagtttatgtgagcattagaggattcatgaattgggcagcacccagaaccagaaaaggttcagagagctctacccagcagcatgggtagtgagctttaataggcggaacgtggaagtaagacaaagaaaacatatttgatttgttagagtagaaagtccctagttagaggttagttggaggtttctgatggtaacttctctagtttcattttactgttcacattgggctttggtttgcttacctaggaacttaaagtgctgggaatgcttcggcttaatgacctcccaattaaaatttttttaacatcacttttatttatgatctacaaagtggcaactgcctatttttttttaattttattattattatactttaagttttagggtacatgtgcacaatgtgcaggtttgttacatatgtatacatggccatgttggtgtgctgcacccattaactcatcatttagcattaggtatatctctcagtgctatccctcccctctcccccaaccccacaacagtcctcggtgtgtgatgttccccttcctgtgtccatgtgttctcattgttcagttcccacctgtgagtgagaacatgcagcgtttggttttttgttcttgcaatagtttgctgagaatgatggtttccagcttcatccatgtccctacaaagcacatgaactcatccttttttatggctgcatagtattccatgttgtatatgtgccacattttcttaatccagtctatcattgttggacatttggcttggttccaagtctttgctattgtgaatagtgccgcaataaacatacatgtgcatgtgtctttatagcagcatgatttataatcctttgagtatatacccagtaatgggatggctgggtcaaatggtatttctagttctacatccctgaggaatcgccacaccaacttccacaatggttgaactagtttacagtcccaccaacagtgtaaaagtgttcctatttctccacatcctctccagcacctgttgtttcctgactttttaatgattgccattctaactggtgtgggatggatggtatctcattgtggttttgatttgcatttctctgatggccagtgatgatgagcattttttcatgtgttctttggctgcataaatgtcttcttttgagaagtgtctgttcatatcctttgcccacttgttgatggggttgtttgtttttttcttgtaaatttgttggagttcattgtagattctggatattagccctttgtcagatgaataggttgcaaacattttctcccattctgtaggttgcctgttcactctgatggtggtttcttttgctgtgcagaagctctttagtttaattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaaggagggatccagtttcagctttctacatatggctagccagttttcccagcaccatttattaaatagggaatcctttccccatttcttctttttgtcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtaatgcgggctcttttttggttccatatgaactttaaagtagtttttttccaattctgtgaagaaagtcattggtagcttgatggggttggcattgaatctataaatcaccttgggcggtatggccattttcacgatattgattcttcctacccatgagcatggaatgttcttgcatttgtttgtatcctcttttatttcattgagtagtggtttgtagttctccttgaagaggtcattcatatcccttgtcagttggattcctaggtattttattctctttgaagcaattgtgaatgggagttcactcatgatttggctgtttgtctgttattggtgtataagaatgcttgtgatttttgcacattgagtttgtatcctgagactttgctgaagttgcttatcagcttaaggagatttggagctgagatgatggggttttctagatatacaatcatgtcatctgcaaacagggacaatttgacttcctcttttcctaaatgaataccctttatttccttctcctgcctgattgccctggccagaacttccaacactatgttgaataggagtggtgagagagggcatccctgtcttgtgccagttttcaaaggtaatgcttccagtttttgtccattcagtatgatattggctgtgggtttgtcatagatagctcttattattttgagatacatcccatcaatacctaatttattgaaagtttttagcatgaagcgttgttgaattttgtcaaaggccttttctgcatctattgagattatcatgcggtttttgtctttggttctgtttatatgctggattacgtttattgattttcgtatgttgaaccagccttgcctcccagggatgaagcccacctgatcatggtggataagctttttgatgtgttgctggattcggtttgccagtattttaccgagaatttttgcatcagtgttcatcaaggatattggtctaaaattctctttttatgtggtgtctctgccaggctttggtatcaggatgacgctggcctcataaaatgagttaggaaggattccgtctttttctattgactggaatggtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagggtgtatgtgtccaggaatttatccatttcttctagattttctatttatttgcatagaggcgtttatagtattctctgatggtagtttgtatttctgtgggatcagtggtgatatcccctttgtcattttttattgcgtctatttgattcttctctcttttcttctttattagtcttggtagcagtctatccattttgttgatcttttcaaaaaaccagctcctggattcatttatttttttgaagggttttttgtgtctctatctccttcagttctcctctgatcttagttatttcttgccttctgctagcttttgaatgtgtttgctcttgcttctctagttcttttaattgtgatgttagggtgtcaattttagacctttcgtgctttctcttgtgggcatttagtgctataaatttccctctacacactgctttgaatgtgtcccagagattctggtatgttgtgtctttgttctctttggtttcaaagaacatctttatgtctgccttcattttgttatgtacccagtagtcattcaggagcaggttgttcagtttccatgtagttgagcagttttgagtgagtttcttaatcctgagttctagtttgattgcactgtggtgtgagagacagtttgttataatttctattcttttacatttgctgaggagtgctttacttccaactatgtggtcaattttgaaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccattattattgtgtgggagtctaagtctctttgtaggtcactaagggcttgctttatgaatctgggtgctcctgtattaggtgcatatatatttaggatagttagttcttcttgttgaattgatccctttagcattatgtaatagccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattggagcatttagcccatttacatttaaggttaatattgttatgtgtgaatttgatcctgttattatgatgttagctggttgttttgctcattggttgatgcagtttcttcctagccttgatggtctttacaatttggcatgtttttgcagtggctggtactgcggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggtccccactctcttctggcttgtagagtttctgctgagagatcagctgttagtctgatgggctttcctttgtgggtaacccgacctttctctctggctgctcttaacattttttccttcatttcaactttggtgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccctgtcactttcaggtacaccaatcagacgtagatttgggcttttcacatactcccgtatttcttggagactttgtttgtttttattcttttttctctaaacttctcttctcgcttcatttcattcatttcgtctttcattgatgatatcctttcttccagttgatcacatcgactactgaggcttgtgcattcgtcacatagttctcgtgccgtggttttcagctccatcaggtcctttaaggacttctctgcattggttattctagttagtcattcttttaatttcttttcaaggtttttaacttctttgccattggttcgaacttcctcctttagctggtagtttgatcttctgaagcctccttctctcaactcgtcaaagtcattctccgtccagctgtgttccgttgctggtgaggagctgcattcctttggaggaggagaggtgctctgatttttagagtttccattttttctgctctttttttcccccatctttgtggttttatctacctttggtctttgatgatggtgatgtttttggtgtggatgtcctttctgtttgttagtttttcttctatcagtcaggaccctcagctgcaggtctgttggagtttgctggaggtccactccagagcctgtttacctgcgtatcagcagtggtggctgcagaacagcagatattggtgaaccgcaagtgctgctgcctgatcgttcctctggaagttttgtctcaggggagtacctggttgtgtgaggtgtcagtctgcccctactgggggggtgcctcccagttaggctactcgggggtcagggacccacttgaggaggcagtctgcccagactgcgtgctgagagaaccactgctctcttcaaagctgtcagacagggacatttaagtctgcagaggttactgctgccttttgtttgtctgtgccctgcccgcagaggtggaggctgcagaggcaggcaggcctccttgagctgtggtgggttccacccagtttgagcttcctggccactttgtttacctcctaaagcctgggcaatggcgggtgcccctcctccagcctcactgccgccttgcagtttgatctcagactgctgtgctagcaatgagcgaagctccgtgggcataggactctccaagccaggtgcaggatataatctcctggtgtgccatttgttaagcccgttggaaaagggcagtattagggtggaagtgacccaattttctgggttccgtctgtcacccctttctttgactaggaagggaatttcctgaccccttgcgcttcctggatgaggcgatgcctcgccctgctttggctcacgcacggtgcgctgcacccactgtcctgcacccactgtccagcactacccagtgagatgaacccggtacctcagttggaaatgcacaaatcacccatcttctgcgctggtcatgctgggagctgtagactggagctgttcctattcggccatcttggctccacccccccggcaactgcctattgttttacctgatatgcacaacattggccattagtgttaccaaagcaacatccatcacaagaattaatgcttcttgatttgaattttactcctctctgtctctgtttatgtgcattcatttgattgtacacttgtataagaactaaaagcataaaaagtttattcctacatctggcacagctcacgtctgtaatcccagcacttcgggaggccaaggcgggcagatcatgaggtcaggagttcaagaccagcctgaccaacgtggtgaaaccccaactctactaaaaatacaaaaattagccaggtggggtgttgcgtgcctgtaatcccagcttctcaggaggctgaggcaagagaattgcttgaacccgggaggcggaggttgcagtgagccaagatcgcactgcaccccagcctgggtgacagaatgagactctgtctcaaaaaaaaaaaaaaaaaagtttattcctagttttacatttgtagcattgaaattaaaagaatctaaataaataacagagcactgtgagaatttgttgtttaacagagctctatatgcattacacaatttcaaggaacattgatctgaatgttcctatccctcatggaccttgagccctgacaaaagttaataaagatgggtctccttttcttcttgtcccctgctttcagctctgaatgagaaaagttttgcaaatatgtcggtactttgtattaagcctaaaacttataaagtatcagatttgtaagttgactgtattaactttaatttctcaaagtgttctcagttaattaggttaacctaaaactaaaactataaagtgattcctcccctaccaagaaaaaaaaaattaagctgaaatcctctgtttagagtttcaggcctttgggctggactccacaacccttctcaggaagtagcagtagacacctgaccttaggctgtagtgctaatataacctgtgtcagtagctgccccattgcaaacaaggaaatgatcctctgaagtcaaactcaggaaggaacaagaacctgtctctctgagctctctaaagagtgtggttaagagtatgagcattgacaacagactgcctaggttcagataccacctctgatgccagttatgtgattttgggccagtttcttaatctctcaatgtctcaacaacatgagtctaataatagcatatatacccctataaccatggcatgaggattagacaggttgattggtgtgtataaaacacttggaacagggcctggcacagggtatgccttagtagatgttagcactgcatcacgactgctactatgattaccgtccctgtcactgttgctgctgccaccacaggcaggtcagtggaacgtcacccttcagggatttatcagcgccactccctaagcatgccacctgcatgaagggcagacatgaaattgtgccgccagcgttctggtttcttcagcgctccctgccagctgagctgtgtgaaaagcactcagctatgaaaaaatgagaaagattgattgaaatgttggtgaggtcattgtcaaatattctctgtcaactgaatgactgcaaatagggagatgactgcccccccaccaagtcagcctaggagggttcagtccttcatttattcattcacacatcactccttcactgtgccagccagccatgacaattaagtgcatttgggaggaggtggcagctgagctggaaagggggtttggcattatgctgggaaggtgtaaaaagccaggctgaagatttgggccgtctttttttttcccccagatagtggggagctggatttggagacaagaaacctttgtagaccctctggcactctctattgacagatcactgctaggaggcagtgtgactcggagaaccgcatgggctccgccaccagctctgggttccgcactcattagccagatgaccttgggctcattatttagcaagcctgcacttctgtttcctcacctacaaaatatgcataaaatagcagtacatacctcacggagttgttctggggcttaaatgagttcatctgtgcaaacatttagacgaagtgcttgacataatcagagctatgtaggtgctgttaattcttctttgccccactggtccccaggttccatatctgtaacaagaagcaactggaccacataatttcacatccttttatacccaagtttttgatcaagagagctcaggctgtactttaagcttaatgtgacagtgatttatagcatagcttgggggcgatctgaacacttgggggcagaaaaacaagttaggctttccctgtttccatcattctcccacctttcctccatctgcctgtccccacctggacatacatgccaaaagccacggcccattttactagatctaggtagtatgggaaaagaccatgaagcggacacatcatctgtactgccagtgtctctcttcaaaataaactttttttttttttgagcctgaatctcactctgttgcccaggttggagtacaatggcatgatctcaactcactgcaacctccacctcccgggttcaagcaattctcctgcctcagcttcccaagtagctgggataacaggcacctgccactacagccggctaatttttgtatttttagtagagatggggtttcaccatgctagccagactggtctcaaactcctgacctcaagcaatccacttaccttggcctcccaaagtgctaggattacaggcatgagccaccgcgcccggcccgcttcaaaataaacttctttaccaggaaataggattaagaggaggtagaaggaaattagagtaggatcagaaagatagaaaaaggagttttctctgaaacaataggacagccagatacaggctgagcaggcccaatgatggatagagaggcacatccactgctgagctctaacctagagagagaatgtctcaaaactccttgcatggaaggtgcctggaaatgtatttattctcctgttgtttattctcacctctcttcattcctttttctttcttctgtccttgaatcgcagcagataaaaagacaaatctgctgagaggatgcatgtcacaagtggtcagatgaattacagccatagcaccatatagataagaggcaaggctggcgcctgggcaggtctgagagggtccaggaggacacacaccatatcaaattgtgcaatttagcaaatggctggtggcagactgaaatgatagttaatctgttttccatgcactaaaggcttttgccaaactaagatttgctgtgaagacccaaagctggagcccacccagggagcgggctgccttggatgcgtttcccagccttctacagtggatgccagtaaaactaactagagacatgaatgggcaccaggataaacacaaggggatattttgttcttaccattagagaaggatactgctaactggcaagaagtcccatggttgttatcttttgattagtagtagtaaaaatactatttaaagctagtagcattttttgagagcttgctttacactgggtactttttcaagtgtcttacaagtattcgctcattttatctgcacggcagctgtatgaagagaatactgtcattatcttcactgcataggtgagcaatggaggcacagagaagttcagcaacttgtccaagctctcatagctgggaagtggcagagccaggctttgaactcaggcagtctgactcagagtccaagactgccggcctgaattgtaggagagagacagtgcgggtataccaggaaccaaatcctatcggctgaacatcagtgtttaagtcgagcccagatgctctgcacaaaatacaatgtgtctgtgcacatgtgactgttaatcagccatttccttggttcctgctttgtgctggccactgagctggaccctgtgggatggataaatcaatgtcagtcatgcccctggagacctggctgttgcaaaaaggctcctgaaatcatcataacccaaaagagaaaagggcaggtgctgaagagaagtataggtaaagagcagcaaaatcataaaggaggggagactctttgcctctgtggtatcagggaatgcttctcagagcgggtggcgtttgccctgagacttgaagtaggaatttaaaaacatagaaatgcagtggaacgggaagaaggacattctaggtggagagaagtagagcaaaatggtccaatctgcccccctaagggtgtgagacagagaagtggatgggaaggccaggaaggctgtcgccatgtgggccgaacatggggagggaggtgtttgtcagaatcagaatggactcagagggaagctgagctaaaagcttcaatttacagatgaaagaagaaagaatttggatatgtgactcactcagtgtaccaagttcgtggcagaagtaagtctcaaaccccaggcttgcctccaattttctttgcactgatctcctggcataaacatgtggctaacaagggtctcacaatgccaggagggtgttacgtttttataacctgttctatttgagggtctccaaaattacatatttgaagttaatattagccagatgctaactgtctgcaggcaagaataagcacccactttacattgggagaagctagagatttgggaatcaggatttgctgcagatactttgaggaatctaggcctctaatccacagtctcctaaattctggaacttctggcttaattacactttttaataaccagtcatcattgctgcataatttgtgaggtctggtatagtatgattcctgttcccttcagctaaccctgcccccacccccatcctttaataaacgtaaaacttttctttcctgtgaattcatttttttcccttttatcttttggacctttgcaattaacatattaatatttaattcatattacctgaaggtccaagaacacttttaaactcatgaaaaaccttcactagtaatttagctgctaccaaggtatccctgagccctcattatttgcctctggaaaatgccgtaaacgacatctaacaggcttcagctctgtacctctacaaataagaaattaagcagtattcagaacgccattgattattaatttaaaagaaatcaaaaatcaatatcacattcctgtaacctggcagtttttcttaactgaaggcagttgcctgcagaagccttgtggctttccagagcaacggcgccccttcgtggtgataatgtgaactgcaccccaggcgtgattgaaaataaggcagaaaggaatgccggcctcgagcaaggacaccggttcatgcccaaatcacttctgctttcagccaacagactgtttctgccaaaagatggacgcagctagattttttttttttttgtaccgataatctgtcttaaaacttggagaggatctcttttcccctgtgaagtcaggaaaatgacagcaagcagcatggattggttcgaataattttcaccagaaatgtggggtgaggggaagggatgggactggagtcagagcagtgatctggcgggatggggtgatgagccatacggagatgaggtgtggcgccacgggctgggagtcagggattatagagtgagggtggggtaggatcttcctggtcatcaaaactatgagaaatgtaattatttacattttaaactaagccaaagactgtattgaaatgtcttacacccagaacagagaagtggtatcaccaaagttcagaattcccagctctaacgtgatgcctttggggactgcctccccaccccaggctgacctaacacacccctttgagaaaagaggatttagtttctcctgactgtgaattgaatatgtgggatgtgcccctccaggagcttctaaaatcacctctgctttgaccttgaggggccgtggtagaggggagacagcaccggcttagaaaccccacggctcggctctagtcccagcatcagtggagcaccaaggggagaaagtattcatcactgaggtattttatgatatgtatattgttcctgggcagttgcaccccttatcgcctgcaccctgtgtacagctccccattcctcctcccttggaggccactgtgctatgtaacttgctgtgggctgcaagaaagactgggctcccgtttcctcttctgaaaggcaggaatcatgctcccggctgacctcacagaatcattccacagattaaatggcgatatggcttgtctgtgttcacactcaaatccacatgttgtgggagggacctggtgggtggtaattgaatcatgcgggcaggtctttcccatgctgttcttgtgatacagaacaaacctcatgagatatgatggtatcataatggggggaggttcccctgcacaagctctccctttgcctgctgccatctatgtaagacatgacttgcacctccttgccttctgccatgattgtgaggcctccccagccacgtggaactgtaagtccattaaacctctttcttttgtaaattgcccagtcttaggtatgtctttatcagcagcatgaaaatggactaatacaaatgggatgtaaaaataaaattcttatatacttagaacggcaatatgagctttacatctgagttatgctataatatcaatcaacatatataataatataaagtagtatatttattataagttataataacagagtgagatagcttagtaatttcttgttagtatctgcaatcttggggaaaacaaatctagagaaataagtccaaactggagctgcagagtcaagtgggcgagagaaagaagtctcgctttttttgttttccaggaaagctcaggtccagttcagcaggccagcccaagagactgggagagccctatgtactcaggagagcagcctcacccctcgtccttgtccaagattggggagtgggtgcccacagcttgtatgtgtccccatgagagtgggtgtcattatgaggagcatcaaagggccaagcacagtggtgacagatgtgggggaatttgccattctgagggcagaggaggtcaaacacaagtggactcgcttattaagcccagaaagagaactgggagaggaaggccaagtgaggatggaggcggagatccagggcccatctgcaagtcaaggagcaccgaggatgctcagcagcagagccaggagagggcatggagcggactcgcttgcagagcctgtagaaagaaccaactctgccgacactttgatttttaacttctggccttcagaactgggagagaataaatttccattgttttaacccacaaaggaagaaaaagactatcaagagtagaagggcctgacaggtggccacacggcaggtgagtcagagagttgagtcacgtgggaggtagtttagaaaaggatttgtgaagagggccatcccctagcagcgtgttgaatatagtgaggaatatgagatggaaaagaatctttttagagaacatgggtgccagacatagccacagacaaagtcgtgaaatagacagaaatttgtcccatttatggagactgtggttttccacccatatgtccccccaccccatgtcatgtttacctggccctcaggctcacgctgatggccctgggctgcttttttcccctcaaaagctgatgtctggtctctaattataagatacaagatgagatggaaataattgttaacaatgtattcattcaacaatggattgtgtaaaaaaaaatgtggtacacatacaccatggaatactacacagccatgaaaaggataaagtcgtattcttcacagcaacaggaatggagctggaggccattatcctaagcaaattaaagcagaggcacaaaactcaatactatgtgttctcacttataagtgggagctaaacattgggtcctcatggacacgaagataatagtaactgacactgaagactactagagggggtagggtgggagggggacgaggggtgaaaaacaaccagcaggtcctttgctcagtacttgagtgacgggatcatttgtctatcaaacctcagcgacatgcaatttatacatataacaaacctgcacatgtacccccgagcctaaaataaaagtcaaaacaaaatattcattcccaaatcatttactacatacaaatcgttaagtcaggatccctgctgtgacactagggattatagaagtgttgaaagcttcattctcatccagtcattcattcagtgcctggctggggttgtgataagcaaaagcaaacccatccctctccacatgtagcttccagtctcgtggtggcatttcctcagaggatgaagccatccaggtagcatagcaggcatgaggtggttccagtaaatggaggtgggacagtctccttgggctgccaccctgcttggggctattcctggtagggcctggagctctgcctagagaagcccacatgccctctcctggagtcacaagggcaggccaagtattctgtcctattccagtctttgctagaatgtgtcaagtgctgtgggcttgagtccttggcaatttttgcatgggacttagtttgggggtaagttttctggaaacttgaaatgtttcacttaaaaagaaaaatgcaggattcaaagaagtaaagagtaacaaataaatagaggcttttttagttcaggggtcagcaaactgagggcattgcagctgttctggaattaatgcgtgtccgggcaagggtcagtaattctgagatgccgttctgttgctttcaggccttttttggtgaaaactcttaaaggaggtataattcttcccttgctgggagtctttgtttcagaggggttgtaaaaaaagattcccagaggataaatcatatctgtattaacttcctaatgaaatgaaaaattatatcattgctgattattcctccttggctgatatggaaaaaaatactattaatactttttagtgtgattttaatcctttgcattcacggatatttgcattagtattttctggacatcatcttgtttatatggattttattcattgtaagatgccatcagatccaggcatctgagttctgggggggcaatgctataatccctgcccagaaccaaaactttccctgtgcagatggtctttcaatagagtggaatgtgtttggggtttctgcatatttcagtttacaaacccttcagtgatggttgtcttcatcctgagtttggctccatgcttcagaagatgcaacagtgctgagaacggtgcctgacatgcaggaaacattcagtaagtgtttgctgaatgaatgaataaattaattcaacaacagctaatgaaagcacatcccttaaaaagtctcggcaatattgcgagcataataccaaaggcagaaaccataaaagaaagaattgatggattggaaggggaaaatctttttttttgagacagagtctcactgtgtcacccaggctagagtgtagtggtacaatcttgactcactgcaacctccacctcccgagttcaggcaattctcatgcctcagcctcccaagtagctgggactacagatacacattgccacacccagctaatttttgtaattttagtagagacggggtttcaccatgttgcccaggctggtctcaaattcctgacctcaaatgacccacccacctcagcctcccaaagtgctgggattataggcgtgagccaccgcagccggccagaaggggaaaatcttataacatgaatttcagataaactgttacatccttaatacttaacgaattcctgttaatcagtatacaaatattagtacccaaatagaataaataccgatggccaataaatgtattagaaacatttgaatctcacttataaaaacatagttattttcctaaatggggtatcattttttcccaatcagattggcaaaaataaacaagaatacaaatccagcctagcacatgtacgtactttcaaagggaggataatttggttcaacatgttttgaaagctggttgtatggtatgttttgaaaccttgaaaatgacccagaaattttccttctagagatttatcttaaggaaattataggaggcataaaaagtttcacctgcttattgctttgtggcttatcattgcaaaaagaaaatggaaaactacttcttcagctaaaggaagtgatacgctatcgtactagaatattaaaaatgaagaaggtagggaaaagagaaagagaatctaagcggtaaaattgtttgacctttattttcttctttttgcttagctatattttctaaagtttttgttaaaataaactcttttaacaaaaaaattctaaaaactcatagctgcttagatgataatataattataatatttatgttaatttttgttgcgaacgtatgtttatgttgaacttaccaagtgatctaagctatattactaagttcttttcataagcctctgagttcatgtatattaagcccttaacataattcttagagttaagcagagcaggtggcgttattcttccatgaccgcactgagactcagaaaagttacatgacttattcaatatcacataattaataaagagtaagactggccacaaagtccaggatgccacacacatagctgagtgcttcttcctctatcatagaaacaaaaatctggatgaccattaggccgttgttggcctgcaaaggtgtagagcaaactattttatggtattgagagcacttatcttggcattactccatctgattgtttgtgtcaagtaggaaagatacatttattattcccattttgtagatggagaagctgaggctcagagaggttgagtgacattcccaaggttgtacacagtaagtggtaaagttaggatttaaacagttttagtccgaatcccttgctctgtctacttcagtttggcataataaattcttaacttccttaacagtttgtcccatcatattcctaaagttttatgatttgatgaagtctctcttaagctccttttccacatgggtggcatgggttagcaagattttgagggctgatcttgtgtgacagattgtatttccaaagatgtctggaataatatcttgtgtcccacatactgttgtggaactatcacctctccatcccaaaaggtggaacagaagcaacactatgaaactgccaaggctaaatcataaacattcaatgcacttctgccttgctctcttgggatgtttgtgcttagaatccagctgccctgctgtgaggaagcccaagcaactctgtggaaaggaccacatggaaaggaacagaagtgcccagctcacatccctggctgagctcctggccatcagcctaatttgctggccatgtgagtcatcttgaaagtactgtaggttcaaggtttactttctgaggtttcagttatccatggtcaaccgtggcccaaaaataggtgaatatagcacaataagatattgtaagagagagactatataacttttatttacataacttttcttacagtatattgctatgatttttctcttattagttgttgttaatctcttatgactaagttataaataaaactttatcataggtatgtatgtatagaaaaaacatagtatatgtaggattcagtactatccgctgttgtaggtatccactgggagtcttggaacatatcccttgtggataaacagagactactgtagatcctcctgctcctaattagcctaccctaactgatgttgcattgagcaaagtgaggtgagccgaccaacctctgcccaaattgcagatttctgtgtaagataagtgattattctgttgggggtagtttgttatactcattttccctcctaaccccaaattaggtggcagggatggaggagtcttgcttatcatctctctatttttgttaactcctcctcgttcagggtagactttggcacctggatcacaaccttattctccaccccaaacctgccattatccttggtgacaccattatccatgaaggggacccatttgatatgttagcttctcagttccctgtcttctaccccaaagtccttcaaattcaaagtatcttactctttttgttttaaaattgcttggagtagtagagaggactctagtggaatatacaagccaaaataatcaggaatttttacatgagagaaaggaggaatgtcgtgaagggcatcaaaaagcaagaaagatgctcattttcccttccaaccccaatttaggtggcagaggtgggagcaggtgaaaagaacaaagggcattggaaaagaccacctggaagtcagtgaagaccaagcggtaaagggatccttagcttaggcaaaggctagatggggacttatctcaccaatggagccagagaacagatgttccagatgtgtgtgtggaagtgggaagaggactgattaaggaaagaagaagctcaaagcaatatagagatgagacagagaaataacaggattccagaggcacttggattttactcaccaaggatgagggggaattagttggtctcaacatttctaacggcaaagttacaggtcacctaatacatatttatgtattagttggatcagaggatggatggatggatgagtgggtgggtggatggtagatggcagtggatgaacagatgaatgaatggacagatgtgaggatttctctgtgggagattcagttcgcccaggagtgatggtgtttctgagagagccctagcagcatttgttatctcctaggctctctctgaatgttcgaagcagtgagtggcaaagaggaggctcagccctctctggattgatctgttactggggtgtacaggcattcagtgcagagttctcttcatcaatggtcaaataacttctgttacccacttgtgatggctcctgtagcctctggttcgactccatgtaacaactgaagagcagccttgctgcaacagataggaagcaggtcttatctctgatttgagaatagaaggcccggtgggtacaacctgtagcactttcaatcctgtagaaatatagatagtgatgctgttggtaaaaaggaatccaccctttccaaactttttcctaagtcagtggttgtcaactggatgaggtcttgctcaagcacaagtgtctggacccctcctctagaaggagtgattctgcaaggctgagcaagcctgagaatgtgcatttctcacctgtaatcctagcactttgggaggccaaggcgggtggattgtctgagctcaggagttcaagaccagcctaggcaacatggtgaaaccctgtctctactaaaatacaaaaaaagtttccaggtgtagtggcacacacttatagtcccagctactcaggaggctgaggcacaagaattgcttgaacccaggaggcagaggttgtagtgagccaagatcatgccactgcactcaagcctgggtggcagagcaagactctgtctcagataaaaaaagggatgtgcatttctaataaattcccaagtgatattgatactgctctaggaccacactttgggaatcacttccatcctgcatggctaggtttaaattaggcattcttaacttcatatgtggcagggtgagtggatgttgagggccccaggtatattcttgaaaaacaaaaagaagtcagtgatcagttaattcattctagtctcctgctgagactgttgtctggcttatgaaggccaggatttttgccacctgaggcatttggagaagcctatgaaggagagtagaggagaggttggggacaacagaatgaagccagccagaaaaagagactgggcatagggggaatgggaatttgaggagaaacatatcattcatcagaacttaaatctgcatttttagagaagatattataatgtgcttacgtggcctccagatgtgcacaggtgccataggatagaagtagcccagggaagccttgtcatagatgggctacataaataggaaggcttgcagcagtgttaaaagacagctgatatgattaggctttgtgtccccacccaaatctcatcttggcttataatccctgtaatcccgttgtgacaagggagagaccaggaggtaactgaatcatgggagcggtttcctccatgctgttctcatgatagtgagttctcatgagatctgatggttttacaaagggctcttccccactttgctctgcacttctccttcctgccgccttgtgaagaaggtaccttgcttctctttcaccttctgccacgattgtaagtttcctgaggcctccgcagccatgctgaactgtgagtcaattaaacctttttcctttataaattaaccagtctctggcagttctttacagcagtatgaaaatggactaatacaacaccctccatgcaacctggagaaaatgcaaagtacatatagctctcaaacttcaggaaggggatccatatatgcagacagccattctttaaaataacctttccattctcccatccacttcgctcacacgtgatagatagtctgtattatctcttctctaacatctccacccaaaactaaacaaaacattaaaaccctccagtcattatttaacttgcctctttcttcacctcacttccagtttctccccgattcacattcacaaaagcccaagaatgttatggctgatcaaggactctcctttgagggtgggaagaaactgcaggggtcaggccagaattctcttctgcagacagaggagggggaaagacaggaaataagcatgcacaacgttcacctttgttggctgcacaacagcttgggatgtgcacccagccctaggtctccagctgagatgtcctcagttgtactcagcaaaattgccaccttttctgagttatgaaagccttctctcctagagccccagtatgttcctggcacctgcaggcttttgggttttggttttggggtttttttctgtgtggtgttgttgttgtgtttcttcaccagggcatgagtagacagatcctatgcaggcactttctttgtgatcttcaggatcatttgttttatcttgcctcccaaatgctgatcacccatgggcatgcttcttgagggttgcaaccatggctttaaaacccagaacagctggtgtctgtggtctgcagggcccagaaaatattatttaatccaggaaacattcctttgttctgctctgcttcattcagacctctcctgggtcttttccttcccctgctggctatcgatttccatccaactgaaggggtgaagttcagaagcccaggagacagcctgaataatgggtatgcaagtgttgcatcacacatgcagcaaacatttattaagcatgtatactatacagggctgcaaaagtccatatgtactaggatcttacagtacacttggaaacaacaaggaatctgggtatgaggattctttaggtggaccagatgcctgctctgtgtagcagcagaactcttcaatatggactgtaaccacctgctccaaaatcaccctggggaattgtgaataaaatgcagacttcaaggctcatcctatacttgatgagatagggccctgaaatctgctatcttaacaagcacccagttggtttggctcttcatttttctttttgagacagagtctcattccattgtccaggctggaatgcagtggtgcgatcttggctcactgcaacctctgcctcctatattcaagtgattctcatgcctcagcctcccaagtagctgggattacatgcatgcaccaccacactttattttgttttatttattttattttattttattttattttattttattttagtagacacgggatttcaccatgtttcccaggctggtctcatctcttggcctcaagtgaagtgcccacctcagggacatatattgtatggtactgtagagtgctttatacttatctttctcctaaccagatgttagctcttagaatctcatcctcctactttccaaggtccctgcacccatcaccaggcccccaagggatatggacagggagagccctctggccaaattctcgctggatctcccagtggccgttcagcttggaccgccttttctcctcttattccagtgatagtccaggatatctttttgccttttttcccttaagacttccctggtcttggtatttgggattttctcattttgaatctgggggtgaagaggggaatttaggggatattggtcacttgtcttctgtgtccaaatgtgagtgtcttgctttggattaggaaacccctaactaatgaatgttgttaggggctaagaccactccaacagtagaagctagaaatcttagatactaccttgcccatctctgggtgcagccaggacactgaatgtgattcaggctctgctgattagatgtgtccctgttagacattgacatagaccccaggagccagggttataagggacaggagtcctttgtcctctggcaagggtaatttcctcctcagaaccagtcctgggctatgttgatgggcgtggcccagttgccttgtaccaagtcagttttctagtcctgactagaaattgttagttctggcagctaacaattctacatgatccaaaaaagtgagggatatcatttaaggagggagggagacagcctctgccttggtgtctcaccttccaggagtaaagacgtgtcccaagtaatgggtagctccatgcacaagagaagagacagtggagaagataagacatgcaagaggaaggatcatggaagagagacccagaacatttgcttaaccagatctatttataagttttagtccttaatcagaaagcaatgtatctttcttagaacagtaacctcataatgcattcctgaggagcccagttagtccttgctcctgtccatcccacctccttcaggcggtagaacagaagaagggtcttcatctcaccccagctaaagcatctctgcttccagaaagtgtggatgagtgggagccataaacctgggaaataagccacatgctacccttttggttgttgtttattttaacaaaattctatgaccccaggaccatgtttctaagagtagccacttgaagcagaaggaaatatttagtcaaattctacaatcacagccaaatacagtctaatggcagccagcagacactgtggaaagagagtgtcacacaccattctaatgtggggagtaaggatgatgaagaatcagtcataggtccgtgttgtagctccgtctggggagtggaactcatagggtataagtgattatttcctattcatttccttagccctgaaccgtccaatgaccacacgcaacttgactggcaagaggtgtttagaatgttgagacacggtcagaaatgattggtggtttcatgtgatgcaaagaatttcccatactccgcctgttttctggatcacctgtccccagaaattgcctgaaaacaaatcacaggttgaaactagaaataacttccctctcctaggcagcttggagactggccaccctgtttcttggtttggtaagaatgttccagacacaaggaggggagcaacacacactggggcctgtcgggggttggggtatggggagggagagcattaggaaaaataactaatgcatgctgggcttaatacctaggtgatgggttgataggtgcagcaaaccaccatggcacacatttacctaagtaacgaaactgcacatcctgcacatgttaccccagaacttaaaatgaaaataaaaattaaaaaaaaaagaataatccagaaagtcaagaaaagcctaactaaaaaagtctttttaggcaagagagcatcgtaagtaggatgtagaggaagctcccctgcttaaaacctgttaatggtcttctgtagctttcaaattctagctcctcttgcctccacgactcaactccccagccctccttccgagtgtacaagatgactcaccctgagtccagagccaaactctcggtttgcatcccagctctttgccacttactacagaccatgtgaccttgggcaagtcacctaacctctctctgcctcactttcttaatctgaaaagggggggatgatgaccacccgtttcatcaggttgctgtgcatacaaatgggcgaatatgtgtaaactgctgagaacagtgcctagcaaatagtaagccctatgtaaatgtttgctgatgttgtgttccatgattccgtggctttgaagatgctgctctctcatcctgcaatgccaccttaccttacctagcaaattccaacgtgtccgttaacattcagctcaaggctgggcacagtgactgacatctgtcatccccaaactttgggaaactgaggcaggaggatctcttgagcccaggagtttgagatcagcctgggcaaggtagcaagctctcatctccacaaaaaaattaaaaaattatccagaggtggtggcatgcacctatagtctcagctactccaaacactgaggcaggaggatcgcttgacaccaggaatttgaggctacggtgagctctgctctcacctctgcactacagcctgggtgacagagcgagaccctgtctctaaaaagttttcatttttaattttttaaaaaatgtttttaatgtatctcaagccctacctccttcagcaaagtgttctgagcacccaggtctgatgtagggccttgtccatgcttcctgaaaatatatcttctgtagcattcaatgcactggaatgcctatgttagctgaaagttactgatcacaattccggtggcctggaggattggtgagcccagctgtgaagtttagaggcttgctatcttgcccaggctgatctcaacaagtaaacattagtttattcatctgtcttctccctggtttcaagcccctggagtgtagggccacatcttacttggcattgtatccagcagtcaacatagtcctagaatatagaaggccctcatgttgaatgaatagtaaaaccctcctgaaatccattaaattcatatgtttatttactcactcattctcttcctttgttcaaaaaacatctcttgagcctctgtgatgtaaaccaagtgctttttaaccagcagcttctctctgatgatctatctgcaatctctgtgtcagtcctcacatttaactaggacaaaaagagaacatagattcttagtagctttgctcatgacctgactttaacaagaaaaattttagagaccaaaagtctgactgatagctgagtgagttctttctttcaaactcaaagccctgtttgagcctctaaacttcacagctgggcttgcaaatcctccaggccaccgcatttgtgatcagtatctttcagctaacataggcattccagaagatgttctgccctaaacgtaattggaatcctttttgaatcagttgccacagtacttctgaagttttttatgctaacttcttgggtatatttcctcaagatggattcaagatgtggccagttctcttgtgagaagaatacatttctgttgtcctaagtgtagagaccctctagttcatgtaatagccctgcaaagcaatctgctattaccagtcccagcatccatttctccttccttccttagtaataaaaccctgctttggctgagcaccttgttgcccagaattaaacactgttttaccagcttccctgatgggtgtggtcaggttactaagatctggccaaagatgtgtgtatgagttttctatgctgctgcaaattactacaaacttagtggcttaaaacaacacacatttatcttataggtctggaggccagaaatctgagatggatcttagagactaaaatccaggtattggcaacagaggtgtattcctcctggaagttattgctttttctagcttctcgaggtcgcctgcatttcttgtctcgtggccctttcctctgtcttcaaagccagcagctctctggcatgtttgtgcttctcattctcattctctctctctctcccaccccgcccccgcccctgctgtgttatcacatctcctctctctgatccttctacctctctttcataagaacccttttgattagatagaacccacatggataatctctccatcttgaggtccttaatcacatctgtaaagtcccttttgccatgtaaggtatcatattcacagttctggggatcaggacatggacatcggggggacattattctattgtcatgtataagtagagtaagtaagtagagtatggcattttcagaaatgtgctcaaagggaggtgtctcaactgggaaggaccctctttgacccttctgcctttcctttctaaagctgagatatgatggctgatgctttagcagccattgtgaaccatgaggtggccttgcggatggaagtcaagcactaggatggtagaagagaaacattaagatataaattcctgatgatgccatggagccaccttttaccaaatacacttctatcttgtttaagctactgccatcttatttgtttttttttttctggaacatacagctggacctaatctcaatcccttaaaactatacatgactctcttcttaataaactgcaaggctggttctctcagcctactaccctgcctaaggaacagataggtagtaagcatggatatgaccattgctcagaaaatgtgttccaaaaacagacagtatgtttatcatttattgatcagttcagcctctggctctgcctatacactgagccatacaacctcaatattaatctgggctgttaacattcttccagagctttgatcatggtctacatcttactccccggagaatcaggtgggcagaaatgggctactgacctatcaatttctagtcctgattagctcaaaatgtggtcatttcctcttaacataaatgtatttaacaacctgaaatagcaaatagcaaggtaactttccactgacctgtcttactattaatatcagaagtcagaggtggacctaaaaagtaaccaaacaatcaaaaccaatgtctgtaaggaaaaccagcatcgttattagtgacaccaagattcaaatcattgatttagcaacactccttagtgtattcatcagatgtttattggaaatctatggtgtggcctctgcagtgagtcagagtgcagagttgaagagatgagggtccctcaccttaagaaccctcactgcattaatggagagacagaccaagaaatgcctttgtggtttcaagaagtgcctttgttctgtttcatttttttattgtcaacaatcatggccaggcatggtggctcatgcctgtaatcccagcactttgggaggccaaggtggggggaatcacctgaggtcaggagttccagaccagcttggccatcatggtgaaaccccgtctttactaaaaatacaaaaaaaaaaaaaaaaaaaaaaaattagccaggcatggtggcgggtgcctgtaatcccatctactcgggaggctgagacaggagaatcgcttgaacccaggaggcgggggttgcagtgagccgagatcatgccactgcactccagcctggactacagagtgagactccatctcaaaaaaaaaaaaaaaaaaaaaaggaaaaaaaaaatcacaacctagattctgtaagcacctacagcagctatcctttgctggggtttcctcattcagctctctcctcattcattatctgggtcctattgtattccctttattagttttagcaatgtttaaaattatttgctgcttgaaatctaatccattttgcaagtaaccagcacctgggggcaggggtagtgatgagaaaacagggctaaaaggaataaattcacaatgagttttatatttacaccatccttttcccattcacagggttttcccatttgggaacattcttagcgtgttctctgaacagaagaccgtttctcttggtctgaagttgatcaatgtgagaggaagatggcacattagaaagatgcctggctctgatgacattccaccccgcagtcttccagcacactgggatctggggcttgaagtcacttgtctggctgtgtgactgtatccacttggaagcagcgtcccctgctcctaagttgcacaagatacttcagggagtctgctgtgatttagtgatagacaagtcagaaaacaagtttaaacttgttattaatcagaagagaacacagacatttttagctgtctatctgacttggtcatagggcagagccatcagatgccatcagtggtggtcggtgtagatttttttgtgaatcaagacaggagcaggaaaaaggggggtggaaataacagacaggttccaggagggcctggtggagggttcagctgttggagctcatttttcttgctttttcccgagagaggggaatggactgccattgtcacaggttaagtcacagaagagtgaagctcaggtgacaggagacattccaaattgagaacagacatgccaggggtccctgttgccacctgctcacaagccaaggccttggttccgagcccctcttctctctctgcattttctccttgggtgacctcatccagcctcgctgcctgaagtgcattcctacacaccagtgactctcaaatactatctccagccagctctctccccacaaatccagattcaacagccactccatgtccctactcagatggctcctacagacctcaggcgaaacatggctagcacgcaagcccaggtgtcctccccatcctgttttctcatctcagttgatgtaagctccaccgtgcacccaactagttaagctagaaacctggagtcactcgagactcctctttttctcatgggcaagccccatccatcagagaggaccaggagccttgcctccaaacccatttgcttctcttgatttcaccatatcacctgtgcccaaccagccttccatttctctaacccagtggacacagttccaaactggtctccttgcttctactcctctccctttacaatccattctgcactcagcagctaacatcttttaaaaacataaactggaccccttaccacttgaagccttccaggactttctatttcttttaaaacctgacacagcccctgccttcctggtctcctctccactgtgttctgtgtggccaacctccaggcgtacgagcctgcctcttgccctctggacagatcaagcttgcttcctgccttggagatctggccttggctgttcctctgatggggaggctcttcctccaaagagtcacacgaccatctccttcttgttcctgagttctttattctcaatgaatgaagtttattgcactcccctccccaatctcagtagtccccagtgatcctctctcccaactcccattctagcttcattattgcgctgtttttccttggtttcatgcagtttccttgttcattgactcctccattacagagtaagcttagagaggtcagggaccacatctgtttctgtctcattccccacttcagcacagagaacgatatggggcacagtaggagctcgataaatgctttagtgaatgcataaacaaagtaagaaaccatgaggtgacccaaacctcggtttcttcagttataaaatgggcacatgggtgcaaaggctcaggtgtattgtaagggtgaaacgagaggtgatgcgtgtgaggcctttgtgagctctagatctctttgtagatgcaaagtatcagtgtagattgcagtaaccaggacatcagaagaaaaccctgctctttggaagcaaagtgtgccaaataacaaagcttagctctacaaggctatcgctaagcctatgcaataaatactttctctcctccacatctgagctggacattctccacttgtccctccagagccactctccacccttcttacctgcctctgtgcctcacgggctgtcactacagctgcctcagtaagctcccttgccctctgggtacaaggcttcaactgatgggtgacaccaacaggagatcagaggggaggagagggagaccaggtaacttattccctggcagaccttcatcagagagtagctgtgttctgctgaaggctgtggcttctgtctgtccaccttctcctagaaagaccacatcctgtgggttcctgtaactgttcctccttgctaccccattcgacctgaggttggaaacttcctctagttgttgctctagccgcaggctgctccacaatccctaacccacccaaacctttgtctaaagcaccttccttacaccctccccagctgtggcatttcggggccctgttagcatccacgtgatgctgctttctacaaatgtgtctatttgtggtgacagcacttgcgctttgctttcttccctttcttatcctacctgatatcccagccttctgcccctcagctacaagaccactccataaccatagaggaccaaaatcacctaggagcttgagagagaaaatgtatttgacatcttgaaaataatgcagtttgctcaggggatttatttctccctcccctgggctctgcgctcagaccctctttgcttctgtccgactactgcaagcaggcagttaagattatttctagcaaatggacttagagaagctgagcatatgagtgatgttgaaatttgacctacacttcttttttttttttttttttgagatggagtctcgctctgttgcccaggttggagtgcagtggcatgatctcggctcactgcagtctgcctcccgggttcaagcgattctcctgcctcagcctcccatgtagctgggattacaggtacatgccaccatgcccggctaatttttgtatttttagtatagacggggtttcaccatgttggccaggctggtctcaaactcctgacctcaggtgatctgcctgcctcggcctcccaaagtgctgggattataaacgtgaaccaccgcgcctggtgagctatgcttattacttagatttctagcagataacatatagttatttcctaaaactctgttcttaacctgagctgtttttgtcatttttcagggttttagggggtgggaacatattacaggagctattaggtgcatgagtgtgagttgcgggcatatgtgagggttgtgtgtcttgtgtctatgcacatgcgcaggtgtgtaagtgggtgtgaatatgtgtgagcgttgcatgcatgcatgagttgtatgtgtgttgcatctgtgcgtgtgtgcaggtgggtatgagttagtgtgagtgttgcctgcatgcgagttgggtgtctgttgcatctatgcatgtgtgcaggtatgtatgactgtgtgagtgtgtgcaggtacagcttctgtattaataagagacgggcaatcactgtgcactgatattgaggggtagggattagagggcaccttgtctatttgggaggtgaaggagggctggaatgagaggctgaaggggtacagaagaggaaggcagacccctgcaggcctcagggacctagcctccctcccttcagtgtcccttcctctccctgcaggaaccagaaaaagtgtggaggtctgaattgcagtctctaaaatctctcctcagtctcacatgactggcttcagttttctcaccagtcctgcaaagccaggccttgaccccttatctaaatatccaaagaaaaaaatggaattagggatcttagaaggaaagagtggggcaggaaatgcaccaccagggcagtgcagcttggtcactgccagctcccctcatgggcagagggctggcctcttgcagccgaccaggcactgagcgccatcccagggccctcgccagccctcagcagggccaggacacacaagcctttgacttcctcctgtcactgctgctgccattcctgttttgtggtcatcactccttccctgtcctcagactgcccagcactcaaggatgtcctgtggtggcatcagaccagaggcccctgaagaggagtgagttgggtgttttttgccgcgcccaaagcagctggctgtcccctgaaagatggcaagtggggaatgatgatggtgcaccatcgttctgcacaccaagcccttctggataggaggcccccagcagtggagggatgggggctgccaactggcattgcccagaggcccagctcctggtcacatagactgacctagcagtgcaccagctacccgaggcagcctgcaggaaaggtgcactcatagcgatgctggaatgccatgaggcccagccatggggttgagaactggaatggagggaaatgtttgcatcctgatgctgggaaacaggagatcagtcctcaccaacgctgagatgatttccctctggttcttaagctcggttctctttctgcttgatgcttgaatctctggtgtctggcagagagtctggtgtctggcatagtgctttgtatgtaggtcatgccagagcatgctggtgactttgcccttctaggactcttttccatttcatagggacttgctgtgaaaccccgtttgacctggatataaatgttagatgtcatggagtcctgttagcatggtgagctgcaggctgttctgcatgagtcctccttgagcctgcatctaatacccactgctcaatcaatctcttttcactgtttcccattgatcccaagtgtgtcctctgtgagccttttcttgacactgggtcacccagaattactcccctgtctgtgtccccatagcaccccacaaatagttcaatcatagcccttgtaacattctggtgcaccagtttaaggacagagccctgtcttattcatcattgctggtggatgaataaaaatgttcaagtcgtaataacggcaatgacaacaatgataaactcaccacttactgaccattggctgtgtgccacaggacataggactgaacatcttacaggtgttatcctcatgtccactctctcagactgcacttctatcgtattctacagaaactgaaggatggaaggtcacagagctggtgggaggggagcctggattcatacccaagccgtgtgcctcctggccactcctatgggtgaaggaaagcaaagggcttagctgtagctgggatggagaaagaggaatctcaggcttctcgtcatattttgcctcaagaactggaaattgatctgggagtagatcccacactgagggagaaggccccagaccaagaaaggatgggctcatctatttgattgaaaacagagaagcttggaagacccaaggtagggcaattcctgaaccgtccagggctggaaaacctgtagcaaaggcctggggagatggggcagaaaggctaaattataacttaggaatctccaccaggagatcagctccaagacagcttccagtttcggcagatggaagggatacttgatggaaaaggagggagggtaagtgtcagagactgctaaatgtctttacctacatttcctcatttcaaactctcacagaacagagtctgaggtagactctagggctggccccattttgcagatgggtaaactgaggttcagagcactatacccgtaagatctttgctcaagaacttgtatgtcccagaccatgcttgaaacctggtttactcacacaccctgctgtgcagacctcctccgttccaaagtggtggcagacttcagtgtgctttgcagactttcaatctcagcacatgctgtggaagtgctagcagtgttgctgtgctaaccctgtggttaggctgatcacagtcctggtgagtaactatggcctgcagccctggcatctgaaagatgaccccttgcctctcctgctgtcctcaagaaagccttagccccctagattattttcaatataaaatgttcatacactacttttcagattcaaatttgcacaaatgaagtgaccgttagacaccactggaaggtaataaaacccccaagcctgccagccatcaggtccctcccagccatcccagaaatatgctcagctgccctcgaaacatctgtcatgctctctggtgggtgctactgggcacctgacattagatcacttctctcccaaagctgcagctctgcttattcgattcttatttctgcctttggattgagtggaaggcagtcatcagtgacagccaccctcggggaacagaaacgatgtccacagtggcaacgatcctccatcttcctgcactgaggcctaatcaatgtagcccatacccagcctccatttaataagctgattgttgagctaaatcccgcacactctccccttgccctggacgcttttgattgacaaaactaatctctcctccacccccacgtctgctgctgcccacatcctcttgcaaatcatgtactcggctgctgacaattagatataagacttgggattcggatgtgggagggttatgaggttatgaatcaattgtgggggctcaggtgagataacaaaccaggggaacccatttcagacacctcgccacagccctcagagcctcctggttgatttatgagttggtaataacctcgctgggtctcctggcccctattatttttcataatgcacaggaaagctttaaatatcagagaatggggaagtgcacagtctgagtgggagggaggtgaggggggatggggcttgggggagaacagtggccaagggcttccccgcagctgattgtctctcctgccccatctccccaggccttcgctgcaggtcttctagtcctggacgtttcaggaattgctttatcttggctttttcaagcttctctgtttcattcaaatagatgagcccatcctttctcggtctggggtcttctccctcagcgtgggatctactcccagatcagtttccagttcttgaggcaaaatatcaggagaaacctgagattcctccttctccatcccagctacagctaagtccttcgctttccttctgtgggtcaccacggggtgccgttgtcatatacccatggaggccagcaagctgatctggccaacctgggagaagaccccaggttgatgacccctggtttaggagtgcatatggcaggatgcttgagggatcactgggcccaaaatcgtatttgctgtgtctggatgtaatgcctcccacctgttcaagaccacgtcagaatgactcagagacctgcctgttaagaagggaaaattatccgctggacaaaagccagtcaaaaagcaggctcaccctgcagtctggaagccagttgagcagcgaggacaggccaaaaaggtgggagggggccagtgagtgtctctcagcctggaggtaaagagctgaagactttacctttccttctgcctgctgtcctcttcccagtgacagccagtttttaataaggaaaaggaggaggctttgaattgctacctaatatttgtttaagtagtaatttgttgagatttctctgttttgttttgttttgttttgttttttgagacggagtctcatgctgtcgcccaggctggagtgtagtggtgcagtcggcttactacaacctccgcctcccaggttcaagcacttctcctgccttagtcatccaagtagctgggactacaggcacctgccaccatgcccagctaatttttgtatttttagtaaagacagggtttcaccatgttggccaggctggtctcgaactcctgacctcaggcaatccacctgccttggcctcccaaagtgctgggattacaggcaaaaagatgtgattttttttttttttttaacagtatcagtgggtgaaagaccctgaacctttcctctaaggcagtgtttgtaaactgcctatatgatgtctggtactagattgtgatgatgttttcaagggccacaaaacaattgaggaaaaatttaaaacatactgaatatacatgtgtgggtgtttatgtattatgatgtgtatttgaatacaactatcaacgaataagcattcattagaccccaactctgtaccagatgtttgtttactccatgccagggacagaactaacagggtccctgctctcttggagctacagtttagtgggcattatgggttgaattatgttctctcaaaaattcatatattgaagttctaaacactagaactccaaaatgtgaccttatttggaaatagagtcattgcagatgtaattagttaaggtgagataattagggtgggccctaatctggtatgactggtagtcttattaaagggaaatttgggccagtcatcgtggttcacacctgtaatcccagcactttgggaggccaaggcaggaggatcacttcagcccagaagttagagaccagcctgagtaacataaggagaccctgtctctacaaaaaatttaaaaattagccagcatggtggtacatgcctgtggtcccagccacttgggaagatcgggagaggcctgggacagattctccctcacagccctcaggaagaaccaacccgttcgacacctggatcttagctgtctggcctccagaaccatagacaataaattgctgttgtctaagccacccagtttgtgataccttgtcatggaagtcatagcaaactaatatagaagaggaaacagacatcgatcaaataattacattgtggctaattccaaactgagataaatgcttcaaggagaaagaaccttgttctcttgacgttgaaagccaaaggaccttgagccagtctggagggcaatgaaggccttcccgagggagttagggctgaaggatgtgtcagagtcagctagagctgtgttccccagcctttttggcaccagggaccagtttcatggaagacagtttttccacggaccagggttgtgggggatggtttcaggatgattcaagtgcattacatttattgtgtactttatttctattattacattataacatataaggaaataattatacaactcaccacaatgtagaattagtgggagccctgagcttgttttcctgtaactagacagtcgcacctggggggtgatgggagacaggaacagaacatcaggcattagattctcataaggagcgtgcaacctacctggcatgcacagttcacaatagggttcatgctcctgtgagaatctaatgccactgctgatctgacaggaggcagagctcaggcagtaatgtgagtgatggggaggggctgtaaatacagatgaagcttcacttgctcacccgccactcacctcctgttgtgaggcctggttcctaacaggccagggaccattacctgttgggaggctgaggacccctgagctagaggaagaggtgggaggaggaagggaaggcacgacaggcccagggagtagcagatgcaaagatcctgtggtgcaatggagactgttgcattctgggaagggaaaggcagtcccaaggcaggagaggtgggggaagaagaagagggtgttgggatggatgcaaccagagcaccccaaaccagaaagatgtttactccattaccttcaactgaattacagtggggtgagggcacctattttgctttctgccctcacttccgggaaatgcgcatcctggatcacagaaaagctgctgggcagaggtcccagtctctcagtgaggcctcaccagactagtagagttgtccagccacaatgccctcctcatttccccttctgtccaacaagctgtctatcggaagatcccagtctaaaagcaccagaagacattttgagtttctctaaggcctaaaatttaaaagctgataagtaacacaaggattccaagttactgctgtctctcccagccacgcagatgactgggttagacacttggctggtatgaggtccctgaaacatgggctctgtgagtagccaatgtgtattaatattaatgcttatgatatgtcaggcactctgcatgggttcattacccctcacagtcaagatgatgggtcccattattactgtcctgttttctttatttttgagacggagtttcgctcttgtttcccaggctgcagtgcagtggcacgatctcggctcactacaacctccacctcgcgggttgaagcaattctccctgcctcagcctcccaagtagctgggattacaagtgcccgccaccacaccaagctaatttttgtgtttttagtagagtcagggtttcaccatgttggccaggctggtctcaaaatcatgacctcaggtgatccacccacctcggcctcccgcagtgtactgttctcttttcatatgaggaaataaacgcacagggccagcagatgacttgctaacaaccagatcatttcagcaaaaccatgaaccaggcattgtgaagagagttttgtatacctggccttattcttaactagacagcacttcaccctagttgacgtatgaagaaatggagatcagggcaggtggtgggtaagggacctgcccaggttcccaccgtttgtaagtgatgtaccatgagttgctctcaagtgtgtctgactttataaatgctgcaccttatcatttcctatgcttggtaagcaagtgagtgtgaaatttgccacgcttttccttggaaaaactcaagcccattgaccaaacaatactacttgaaaatgacactgaacttttcatcactgtgtttctccacctgtgttcccttctgtcttactgccacctactcattgtgctcaccctccaaagcccagtttaacatttcctcttagttaagctttctctgctagctgatcattgcattttttttcaattaaggcataaaagaaaaaaaaaagacggtaaagattgtcctacttagaatatccttccattcatttgcaaaatggagataataatatgctatttacaacataggattagtatagcaggattattccagagcctggaatatagaaagtactcagtaaattattagttcaacagctaataatagtaccaattattattatcactaaattaatgcctctgtttcaggaaaaaaactgaatacatacagaatatcggttttctaattgttttttctttatactacttggaaagttatacagagttaagagacacagaatagtatagtggaaataatatttggcatgaaattgcctggattccatcagtagtagcctgtggtcttgagcctctctgggcctaatctttaaaatggatataataattatcatattggacacaattattgtcaagataacatgcgataacagggtcaagtgcccagctctggcctggtacaccatgggcactcaggaaatgtcactccgccttcataagcattggcctgtgcatgacatctatgtgataaggtggcctgaagctgtcctccccacccagaggtgcagcagaggcctggcaggaatgtgaaaatccaatggatcaagtcataaccttgactgaagagtatggtgagttcactcatggcaggaaccatctgatcattcatacggctccagaaacattttactcaaaagaaagtgtctttccccaacagtcaagattgataattagtttatgaattgcttcatttatcagtactatgatgtactgtataatccaccaggtttcaagttactggaattttgcaggtgatgggaaccagtctttttatcaactttgcataatctgatctgggctcagattgatagaatgctttgggaagaatcaggggagtgttttatactaggatctcctgcggttctgatgcgttaatgggaggaagctatccctgtcaaattctacaattttggaggagcttaaaacacctgaagacaaagccctgaattttatgagtgtctgcctgaaaccagaaacagaaaccccttacagcttactcaacagcgttaattcagcatggaaaggcaccaggaaaagatcactgcgtcttactcccaccaagtaaacaagctaacaaacacagaggagaggtgcaggttggcacccttaggccggactctgggtggacagccctgtcagagtctataaagggtcgctctgaggctccaggagtggcagatggccagagagtggccaactggaggcacactattgagcctcgggattgagcctcccactgtttacccctcaggaaaaagagagctttgagtctcctggccctttccccagagagcaggaaatggccagggcttgaggatagccagaggccgtccaaagttacccataccatctccactttggcctcagaggccagctctttcttctctctgtgctttttaaaataaaaacttatttttctagtgtaaaagtattatatgaatgttctatgaacttcaaataatacagaaatgtaaagaatagaaatttcccattatttgatgcctcccgctccccaaaataacctaaagttaacaatttaaatatatatccagaatttttcctctccatatttatatatatctatacatatataattaatagaacataaatattttacagtaaccctgttctcaagatgcttttccactgtagatgtttaataaatatttattgcatgaatgagccataatttatttattcagtcctctattagaggcctttggtttgttcccagtcatctaataaacatgattttagatataaaagacataattgaaatacatataacacatacagaaacataacccataactgcatatcataaatatatccttaaatatactaataaaacacgcatgcaatggagaggtgttttgggtgccgtctggtgtatatcctggatatccctggaatatatattgataaatcagcctcaaaaagaatgctttcagacagtgttttaggatctgtgggaacaaagggtggccatcctgcatttgttatgttgtttcaacatagcatttgttatgttgttttattaactttaagtccttggcaaagcagcttgactaagataagatccagaaaccagtcgtggtaacaaggcaacaattaatcttagatagaacagaaaaggaatccgcttcaaattctctttagaacaggaaggaaagggtgatcgtgggttagcaggaaggaaggaaagaggcaagaaaggaaagtgaaaaaagaatggaaatgctttctcctgctggtgatttggatgtttggactactcttgtcagatgctacagcgtaatcactgtaaatgttttaaaggacgcgatattatgacagatttccctttctgacttgttcctggggctgcacacacaatgatttactccctgccacgggctggaggcttggccactcctgggttggtccaaggaagcctggaatacccaatgcctgtgagagtgagcacgtccccctgtctctaggtgttgttgcttgtgctgaaatggagtctaccaagcattgccatggcatggaagggatggtggcggagtagatgccactgcagattgagtgcagtgtcccaggcagccaggggcagccgctcagcccttgcctggacctgaggactgttgcatcagtctccagatgagacagcagctgtcatggtggctgaaccagggaaaagaaactccactctgtggtctccatggggctagggaaaaaaggaaatgggtttttgtgattttcccttctttagaaacaaaagtgcttaaatgtgattctttagctctgtaaatgcaaaccacggcctggtggactggggagaacaattaggccaaaggctgagcacaggaagccaaaagcgggtggaaacccagacaacggtgctgagccgggggttggggtggttggggggagcggatatgatagcaaggaaggagtttcaatgtgaatgaatactaattagtgacatggatattaatgatgacagtaattaacaggggaaaggaagggctgtcattgtcccagggtgagtaatcaatcttggcaggtgataaataatggttcagcaagctcagcagaaagataatccgcaggcctgggggagaactcagctaatgcaggaaacctcacagtttctaggcaacccacagaaaagaactattttttttttcttttttgagacagcgtctcactctgtggccaggctggagtgtagtggcgcgatctcggctcactgcaacctccacctcccgtgttcaagcaattcccctgcctgagcctcccgagtagctgggactcaggcatgtggcaccacgcctggctaatgttttgtattttaatagagacggggtttcaccatgttggccaggatggtctcaaactcctgacctcgtgatccaccctcctcggtctccaaaagtgttgggattataggcatgagccactgcgcctggccagaactatttttcttttgaggaaaaaacagattagagtatctctcccacccccagcttgggactacagttcttatttgatttctgctttgttcttcatttcctgggacaaatgttgaacttgtataacttggaggaaagggacacacaggcacatgtacacacacacatattcattctctctctctctctctctctctctctctccaagaatacgaatgaatacgagtgtttttgatctaaagtttgactcacagatgctgtccaggagtagcaagagtgaggagaagcctagaagtgctgcctttgaggttggcgcggggaaactgcaaaattgcaaggctgtgtcggcagaactggggcacacaggaggatgaggatggccctgggggtcccactgtgcagggttacttcacctgccatggacccagagagaaacaaaatgtctaggctttctgtcctgtaccagtcccacttctggccaccagtcacatatctaagaaaactgatttctgggaagagggcaatcctcatgaagcccctctgctggatccccaggccttcagccaggaatccagcccaggagagttcttggcacatcccctccctctcaccaaagcctcagacccacggtaggactctgatatctaaaatgtctccccttgcaggctgtgttccatcaaacaatttagaggtgacaaagccacaccttcaatggtctgcactggtttaaagtgagatctttgggtggcaaaggtagattgaccagaaattcagaaccttccagaaaactgaactcctctactgccatgtacacagtgctgctctcagaacattgtttgcgggtcacattttcaaagagaggcagacagaagggaacttattcagaggattgggaacatatggtgaggaactccaggccacaccctgcaaggaagcagctgagggacccaggcctgttgcacttggagggaggacgtcgctggtatgccgcaggactgtctgaatagctgaagggctgtcgcacagagtggttaggttggggtttgtttttctatcatcaaatggcaaaactgaggccaaagggaggaagtcagagaggggcaagtttctgttcagataaatcaaggctgatttaactgggtcaggctgggtaggggggagtttgtgagtttccaggtactagggattctaaacacaggttacagcacctcttgtccagggtgttgtgaatgggacatgtattggctggggttggagtagacaagctttaaaagttccttcagggccgggcgcggtggctcatgcctgtaatcccagcactttgggaggccgaggcgggcggatcacgaggtcaggagatcgagaccatcccggctaaaacggtgaaaccccgtctctactaaaaatacaaaaaaattagccgggcgtagtggcaggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaagttccttcagactcttaagatttatattcgttaaggtaatactagataccaaaacagctaagtcccaaatttcaggggcttaacacaacaaagttcagtcctttcagtcctcaatcaagtcagagccccacatgggcgtaatgtccatggttggaaccgtggctccctgcctattgtggctctgcattcccccaggtctttggagtcccccacatccagccagtagatgggattgaaaggggcagagctaaggagagccatgtaggagtttttatggtccaggtctggaagtggcatatgccatttctacccatattctattggcagaactcagtccatatctaagtgcaggggaggctggaaatgtaatctagctatggcacagtgaggagaggaaagaggtcttggtgaatacatagacgtttctgccacaaatgcagggacacattcattcaggataggcctgtgccggaagagatgagagttttgcaagaacctatgaggtcacctgtgttggtcagcccttgtaattgatggtagggagctgatgaggcctccttcttcaagaaatggtctgggggccaggcatgataaagcttcacctagcacgtctcagggaagtcctctatagacacttcctagaaacatgaatataagctcatcctgcatcatcagaagtgagtgttttttggacaagaatggaattgtaactatggaagtgtactgaagaatggaaagggttggttaggacaaaaaaaagtgcccatattatcctgctctacagtgtggactgtttggaattaggattctcttaggtaaacatgtttcttctgccacagtgttaaacacccaggaggtcttcagctgaaattgctttatcgttgcaggtactgacattgtgcagtggcttatgaagaacctttccattgaggacccaggtacttgacctttgaccccacccttatctcccctggtatcagtaaacatcccataaccaagttccaaactagattcccctgccctcctgagaactggtcttgtaaatgtgaattccaagacgtggaatcactctatttacaaataaaattaatttattttctccactgaatatttgtctttaaatttaaatcatgctttgaggaaatgagcaactttttagaatgccaaagagcccaatacaataatgtgtgaaatgagttgaattctcattagctgcagcaattaaagataagttgtagcactgtcactgaacagccttctagagccagctcttaaaattagattgcctgatccacaattaagatgtttaattatttgctaagactccctctgttttctgcttctgcaagaagtgaaggaatgattttttttcaactttaattgcgcatttcaattaggaagaccttaccaggaaaacaacaacagaaccctggccaataaaacaatttcccagtctgttctcccaccagaaaataggcagtaaaatttattttcacagtgtaattaggaaatggggggggtgttccagaaaaataaaaattcaagataagtaaagcttattcccatgtgctgtcagttaatacttttccgaatttattacatactcctttgccttgattaactgagtattcttgatgcctgaaggtcacatttataaagatccactaatacactctgatgttcttaatggacattggcgtgattagacttacctgccccaaattaaatggccctgaaccacaatgctttttgaagatttttttgaagtgcccattctgcatccgtgaccttcagctgtgagtccctgctggaatcggtgtgtcagcttggcactcctgtattttaacccaacatttctaatctgttgactgcaaaacaatacagtttctatgcagttcaattatatacagttgttagaactctgagtgccagaaaagcagatcattcatagaagtggcccgagtcttttcacccccttgattagtggctactctcacaactagtgaaaattcttaattctagtcaagttcttgattcacagggaaaaaactataaatgctaaccctttgtaaaggatagaacccaaagcaactcactatgtgttgtccctgatgcagcctgtacttctgagtgtccgcttggaaagcctggactgaatcagcatctacctgtttagttacatttatctaaagtcagtatttcttgtgattataatgctaaactaaggaacgtgtttcctcatggccaccttttctcttccaagagcactggtttctttgcctcctaaaataatcgttgtatttctgacatatattttattattactattatgagaaccctaaattggcgagcagtatgtgagaatgagcttcaggaatcctccagccctggcgtgagaagcttctgtgaagggtcctgaatgatgagagttatttctatgaaaatctgttatactctgatgcccttgggaagacatcatggtataggggcctgtttgggcttctgagaagtggctgaggagaagctaagaaccatttgtcagctgggaatagtctaaggggggagatgaggcaaaccgaggccttgggaaacagtcagatccagcatctgcccctctctcccttctttttcccatcagtcgatttcctgtggttattttttggtttttgaggcaaggtctcactctgtcacccaggctagagtgcagtggcacgagcatagctcactgcagccttgacctccctggcccaagccatcttccacctcagtctcccgagtagctgggactataggctcctagcaccacatccagctaattttttgttttattttttgtagagatggggatctcactgtgttatccaggctggtcttgaactcctgacctcaaacaattcttctgctttggcctcccacagtgcttggattacaggtgtgagacactgcacctggccccattggccaacgtctaagcaaaaacatttttgctcagagaatgaagttagagtcttagctccaagactggtggcatgaaagtcaccttcctacaggattttgttctttcttctctggggaaggagcaactgctgatgatgaaacttctgttctagctggactcatggttcttgaagcatatggactttaaaaagcaaaccggccagacatggtagctcatgcctgtaatcgcagctctttgggaggctcagctgggaggactgcttgagcccaggagttcaagaccagcctgagcaagatggcaaaaccctacctctaccaaaaaaaataaaaaaaaaattagacagacgtggtggcatgtgcctgtggttccagctacttgggaggctggggcagaagtatcacttgagcccaggagttcaagtctgcaatgagctgtgatcatgccactgcactccagcctgggtgacaagagtcagacctgtctctaaaaaaaaaaaaaaaaaaaaaaaaatagcaaattggtcatcactaagcaagtaaaataaaactctattcattccaattccaccagttacatgtatgtttctttcaaaggagaataggtggttcttgatacgcaaaacattgcattgtattcaacttcttgaaaagtttgcaagtaaagccaaaacaaactactttaaaaagtcagagctcgtgaaattaataattgctagaggctccctgagcacattaacaatttccatgtccaaaaattagttttaacctgtaacagtacttttggatttgtgaaagattgtgtgtggtagaagcattgaggtttgttattttttcttagctctgctcaggataaatctaaattcttaacttttttttttttaattgagacagggtctcgctgtgttgctcaggcttgtctcaaactcctgagctcaagcaatccgcctgcctctggattacaggcgtgagccaccatgcccgacctatattctcaactttctatgtgcatctatttatggctggtgccaaaggaacgaaggaacagattgactgtggcaaaaatataagtatttctatcaggttagcctctctctgtcactgcccacttcagtgtccttcctctaattttcaaaggaagtgaggttttcctctctgtccataagagaagggtgacacccttctcattcctgatgggactgtcatattggggaacgcactgggagtcctacgtctctatgggcagcgaggctgcattcttactgctggggatgatgaaactggtatgaatcagagctgctagcacttacggagtatttgacctgtaccagacaatcacttcatgtgaaatatctcacttagttaaatacaggttcttctatgccagaacttatgcccttgaccctgaagccagactttcttctgaaggtcagggtgaggaggggttaagccatgtcagactctcagaggtgggattcagacaagtcccagacacatagttgccctttccagccattggcatctcccctcctcacccccacactgagcaagggcaattgtatcatcaacacagacatctgggggtgatgacagttgacttctggtctcccagcttaattttcagccaaataacctgctttctaattccttctctctctatgcactgttcttacagttgaagcaatacacttggggagccttatcgctgcccagggctacatctttccaatctcagaccatgttctcaccatgaaggatgatggcaccttttatcgtttccaggtaagcctgctggctcctcctcctgaagaaccttttcttcacaacatcatctgatcttaggttagaactacaaagaaaacctagggatatctgagggagtagccctcactcctcatcagcactgggaaagccaagagaacttttctctgggccactgggtgacccacttagagaatagtaaaaggctgtcattgagagcctaccatgccctgggcactgccttagtcccttgggctgctacaacaaaatacctaaactgggtatcttataaacaaacaaacaaaaaatttacttctcatggttgtggaggctggcaagtccaagaccaaggtgccagcagattcggtgtctggtgagggcctgctctctggctcatagatggcaccttctagctatatccccacatggcagacaggacctggggcttatatcagacctcttttataaaggcactaatctcacctgtgagggcttcaaaggccccacctcccaataccatcaccttggggattaggatttcaacatgtgaatttgaggaggatgcagacattcagaccatggtagacactttgtacagatttcctcatttattctgaagagcacactttagggggtaaatattacccattttacagaggagaaaactgaattgctcaaagaattaaagtgtcatttagtaaatcctggagcagccttcatctgaacctaagtgagcctgatagcacagaccttgatctttctactgtctcatgttgccttctcggagtgaagtttctatttgcgacctaatcaccctccccacccatttcacactccttctcccagatccttccgtagagggaatgagggcagaggatatgggcttgaatcaaggtctaaccaaagggtgtgggagaagagttcttcagactaggttaaagggaggaaaggaacatgggcttaggtgcccagtaagttatgccagcctgacttttgtacttagacctctattgtctcaggataagaatatattgccctgtgaacaaaacttaacatttttgcatttgttttgcttacttacattttgcttctcaatgcctaggttaaaatgttgactcaccttagctgaattagagaagaggagagaattgtggggtagcatcagcaagaaggagatgggggagagcctgccatcagggaggctcctccctgggtgtgggagggaagcgcaggcatggcgcgcccctgagcactaacacccatgctcctttgcaggctccgtacttctggccttcgaactgctgggaacctgaaaacactgactatggtgagaactgaagccactgggaactctcaacttcaacactgtgtgtcacttctgggggtgcagaagacaaatgcttggtgtgggccatggtggtacatggggaggagggtcctttctgcttagtcctttctcatattgttgctatataacaaatctcctgttccacataacagaggaaggcccagcttactgaaagatgtagtccttggaggggaagcaggagagggaagaaaaatcttatcaagggtggtcagtatgttcatcttggggccatggagaaccaggatcccacagcaacactatcagatggtgacttttaattgttctttccagggatagggcttcagggagggctggatcaaggggctacctcctcctggccctttctgttctcatagacttgtcaaaacttactaagaaccttttggtgttcttgacagttgcaatttagaaaagagacagagaccagggaggagtatacagaagtcactctggactaggaaaatagagtgggtgaagttgagagttctgtctctctagacagggacctacaagacttctgccagatattctcagtggagattatttaatattcctatatgccaattctctgaagaagttttattatcgctatgcttaagagaaagaacctgaggcccagaggggccacaccctcacactaccacattgtctgaatgctcccttgattataagcctcttgagggcagaggctggtccagcttatgcattctcatatctccagggcatagcctatgtctgaggcagaattagtgctcagtaaatatccactgacagttctggttctttattgaaggtgaccaacagacactcactagagggagcagaacttgaactcagatctgagtggctccaaaacccatacttctttcacggtcccatgtgtgacatgcctgaaggttgtagctgcagcactgcccctttgcatgcatccttgctgctgactcagctgctgtggcagtctcatctgtggctctccttgggactgggacactcaatgagacctgcagcttctttgcagaattgtttaagacaagaaggcagatgcagctgtggtgagtgggagggagatgtgcagctgggtggtgatcaggggagcctgtctgggagacccatgggataagatacaaccttggagtcacacgtttgagcaagaggaaaccaacaacagggagccaagctgaggatggaatacaagcgagttgtacctactaaggctggagttgttccatggtcaagtgtggaggacgtcagtcatgcagaagggcaggctctggggctgtctgcttggctatccacaggcaccactgtgggccctctgacactgtgctgcaccctaaccaatgtgataagtggatccaggaagacttccgactgcaagtgagagctgcatttgaccgctcataaaactagtgcttctggggctgaaaagactgctcatgaaagcccaactcagaatttgaataattatagctcagttccatgcagcaacgtgtgcccttgtgaatgtgaaaaccagtatttttccaggcagtggagagggtgggaggatggtaagaccagatacctgggcccaagtaagattaaaatatttacttccgtaaagcttagggcatcttatgctgcatactaaagggcatcatctccctgttctacaggtgttcttcattttataattttaattgtgcatcatgaacagggagagaaataatagtttgtttcaggctctcattaaacaaaaattattttaaattcctgtgcctcaatttatggcaaatcagagggagaaatcaaggttcaggatgcacaagtgttcaccagggaccaggcatggtggtgcatacctgtaatcccagtgactcgggaggctgagatgggaggatcacttgagcccaggagttcaaagctgcagtgagctatgattgtgccactgccctccagcctgggtgatagaggaagaccctgtctctaaaacaaagaaaaaccagtactccccagggtttccaaagcagtttagttagaaaatcaggatgtatttatgaagagagaatccagcacaatgagcccccaggatcaacccgttccactagctgggtgatcttggcaaattacttaacctctctgtgcctcagagacctcatattaaaattagagtagtaatggcacttgtctcctagtgttttgttaggattaaatgaaatgcatgtaaggttctctgagttaatacggagtggtggttggtatcactactggggtggggtcggtattattgccactgggatgttggttgatattattatgactgaggtgaccgtctcaccaggaagcatgtgaaactgaagctaagaattcaatatagtatgatttggactgatgaagtaccagaaactttcattcaattgacaaacgtttactggtccctactctgtcaaattctatgtcagagatttgaataagtcacagcctttccccgcaagcattccaggctgggagaggcagcatgatgcagggaagaaaggcatggtgaggatctggcttgagtattcaaaggttttatgtgatgaatgactgagaaggctgaatagcttgggaggggcaggtttataaaaaggccttggcagtcaagtagagacatttagaatggattcagcagtttggggaagctattgtgggtccccaacaatgaacacactttcccaagttttttccctacttgggaaaaaattggttcatctataagatgggggtaataacagaacccacctagtagggttattatgaggattaagtggactgtggaagattaagtaagggctgtgacttagtcaaatagttcctgatattcagtgggctcaatggaagcagtagctgctacgatggtgatttttccagcacctaaaacggtacttggcccataggagacactcagtacatttttgaatgagtgactgaatgaataaatggatcggtgaatgtcatagaggaaactctgcactggtcctcgattctaattccatctccatcactaactagcccttgggtccatcacttcatttctctgggcctttagtttccccatctgtaaatgaggggcctgtacttgatggttgccaaggttacctccagtctaaaattctttggttctaaaaagtcatcagaaagtatgaggaaaatagagaaataagtgagttataggttccctagtttaggagattgaggtacataatgatgttgctagtaaaggcagaaagtaaagaaaggggtcagtttcttcagtacattgaaactcgataagctcaatattttttaagaaatttaattgcacatataatacatgaatgtgttccctttatacaatttttaaatatgtcccagttttgtgtggtgacacatggtgaacttgagatggcagtggatttctctgagtgagatgtgagatataggtaagggtggaatgccagatgtaaggacaaggaaatagaaatttttcggtaagaaattaaatatccaagagaaaccaatatctgagcttaagacagttcttccagatgccctcttgtagggctggctattgtcaccagtagtcactagagtcggttggaagttagagcaagccctagtgagggcactctgggatgcagacaagccccagggagttctgtgccaagaacagccacatcccaccttcctcattgtggtgaaaagattccttgtgtgactttaggcacagggacattagctagtagcatgtgaccctgtgactcatggccatcaggagtggccccagctctgcattccatgcatgataactcacttcacaaccccgctgtcccattttgaccccgcttacccatttggacatttcttgggatgactctgcctgcataaaacccacagtcaaatccaggttagccttttctgagttttacatttggccagtgcaaaatcctgtccagggcagcattgtcaaagcagctgccacctccactgacctgcactgctcaaaggtaatcatgacctggcccagtcgagctggtgacatgtcaagcttcctgcctgaggttgtccctaattctgccaggggtccaagagactgaaggaggtactttgtgatagatcggacacccctttatcagacacagtgaagcactatagctgcttggttcattggaaaagttggtaagtagaaaatcatttttaaaacgacatatgcacaccttaagcacctcatgtaaaggtaagatatacaaaggaacactcatttgacagccttgtgaagtaggaccaaagtgttctctttgattatgagctgaataattttagtttcttaaatcaaccgcactcaaaataaactaccctgttttggtatctttaaagtgcatcaagaatgtaaagacatttttgtagtcttttgtatattggcccctcctagatttttattatttttcttactttttcctgttatctcacctgtatcaaattcaccagcaattgccttagctaactctccttcattaaattgttccaaaccattcaactgagttttcatagaagcaacactctctctcttttcacattaatttcattgagacgtgtgatatttagtgaacttgtgtgattaaaataacagatgtgcctgatataagcagatttgggaacaaccacaactgactcctatgagcacacaattcgccgggtggaagcagaagtgtgggcataccagagggtaggctgctagcttccaggctccaaaatgtcataggtatcagtaaatttttcagaacaaatgaaggaagttggttgatccagcaaagagttgactagagatctcttagtaaagagatcttgttgtccaacaacaaaatgatcacaggttctctctggccctccctcttgatcattctgttgttcatttatttatgccattcatctactgttttccctggattgttccacttggctctggagaaggaggaagacattgaagaaggaaaggtagggagaagaagtgatgatgaaggccatgtttgaggaagaaacagggaaaccaggggccaagaacctttccttagcctgagttgagagacctaaattgtcttccctttccatagcctttttactgcacctgacaagacaggctatggtgctagcaacagggatgaaagctgagcaggacatagcctctgcccttaaagagacttcagcctagagcaggggacagtctagtaaatacaggatttcagtgcaatggaatttagttccatggtcaaggacatgtagatgctatctgaaacaccaacttgggtcttcaaagattagtaagaggttgccagatagagggaaggagagaagagagaaagactttcctcaaaaaggacacatatgcaaaagaatgaagctgaaaagagtttggtggcctcacagtgcctgcatgagggagaagaagttgatgagataagcagtgagcagatcataaagaaccatatttgccatcctaacgagcccaaccttacttctgaggccattgaggactccaggcagagcttttaggcactggagtaatgtggtcatgtttgtgaaatatcactctgagtgtaggatgttcagggtgaagcagagtgaggaggaagaaggggagttgtcaggattggaatatggaggagtcctcatttgatcatgactatgaaaggatttatagaggtcaggggtcatgaggtccacttagaaaacatatttttcccaggacagtgctcatgaggtccacttagaaaacatatttttcccaggacagtgctgggcacatagcaagggtgggtgggcgggctgtctggatggatggatggatggatggatggatggatggatggatggatggatggttgggtggatgggtggatgggtggatggatggatggatggatggatggatggatggatgggtgaatgggtgaatggatggacagatggatggatgggcttataattccattgtgctgctggttttgtacatgttgtcatttcctttcttccctcagccatctatctctgtaagaggacaatgcaaaataaagcaaggctggaactggcagattatgaagcagtaagtatgattattttccaggatacatataagaagagagtaaaatcatatctgcagctccgtctaagtttattttttttttcttttgtcccccttttgtccctttcagacagtggaagggaagtatcttctatttctcctcccttgttctcagctcctctgaccatcacaataagatggtgtttttacataaataactcttaaaactcaacaataaaaaaataagcagctcaacttaaaaataggctaatgacttaacagatattttaccaaagaggacacaaggatgataaataaacccatgaaaagatgtccaatattattagccatttaggaaatgcagattaaatccgtggtgagatactgttacatacctattagaatggccaaaataaaaaatactgatgataccaagtgatggtgaggaagtagaacaactggaactctccgctttgctagtggtaatgcaaaatggtacagccactctagaaaatagcttggcagtttcttataaagttaaacatacacttaccatataaccaagcaatcccacttgtatatacataccctagagaaatcagaactcatgttcacacaaacacctataaactaatgttcatacaagcttaatctgtgataaccaaaagctgaaaacaacccaaatgcactttaacagttgaatggttaaactaactgtggtacatccatacaatagaatactactatgcagtaaaaaggaatgaactgttgatacacacaaccacttgaatgagtaccaagaacattatgttgggtgaaagaaaccaatctcaggccagccattccatttataggacattcttgaaaagataaaactatcatgatgaaaagcagatcaatgattgctagtggttatggatggggtagggaattgttggaaggtgatggaactgttctgtatcctgatcgtggtggtggttgtatgaatctatacatgtgttaaaatttacagacttgtacaaaaggaaaaaagtcaaatttactacataataacatttcaaattaaaattttaaattgcacctttatacccactctcctgtgcttagtagcagaggcagaatctaagggtaaaattcaattcagaaaataagacaagatgtgtgtcacatgaggtatctacttcccagctttcttaccttccttctctatctttcttcataagatgagacttcttgcaaaaattagaggccccaccaccaaacttgggtccattcccatttgacagagcccagaaaccaaagcacttgaaaactcatagatcatttaattttttttttaacttttggttgcaaaatttttcccccaaactgaactttacatgggtcacagagaatgggagaaactggctaaactttcttataccttctacttccctctccctatatgtcttccaaaggatgtgctgctgagccatgaatgactgaagggccagcagctatggaaggaggggcaacattaaggggagcagagaatccttccctggatagtccagcattaacagcatcttcagacccacccaccgccaaagcccttcctgcttttactgcctcagtctttcaaaacaagtgtgaggccccactctgccaggccttacctctcctaggttcatgttcccaagcctaccaagcctaccaagcctaccaagccagctgggccatcgctcccctctctacagcccaagtgtgaatgcgcatgccattggggagcaggacgtgtgcatggtccttcacctctttgatcccactggcattgtggacctgtgaatggggtgcagggggccagaagaggaagaagcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgcccagcaatcacagcacccctccttcaaaagactgctgttgtactctttgtgcgcccagtgcaagtagctttgacatgatgacattacctccttaacacaaccttgaggaaaggcccagacagtagaagcctggggcccctccctcctgtgtgtctcttccccatattttcaatgttttggaaaaaggtcccatacagaaatcagacagcatcaactcctgctgtatttgattcaatttctcttctcttgtcccttaatgttctgctctggtatttgtaaagaatatggcattgaggccaggtatggtggctcatgcctgtaatccccaaggtgggcagatcacgaggtcaggagatcgagaccatcctggctaacatgctgaaacccgtctctactaaaaatacaaaaaattagccaggcctagtggcacacgcctgtagatccagctactcaggaggctgaggcaggagaatcccttgaacctgggaggcggaggttgtgagccaagatcgtgccactgcactccagcctgggcaacagagcgagactccgtctcaaaaaaaaaaaaaagaatatggcattgagatgtgctctcaggttgaagttctgcacaaaaatgattcaaaaccaaaaaagcattttgcttccaaaatgcaataatttttttatgaattttctgattacatattctttttacaaaaacaaaaattcaaacagcaaagaaaggagagaatataacctgtgactccccctcacctaagttttttctatgcatacatttttttctttacaaaactatatcagaatcataacataaacattcttgtggcagctgcttctctttccccagtcattatactgtaggtatctcggggtctttaccatgtcagtaactataatctacgttattgtgtttaatggctgcctagaattctatgctatgactgtgtcacagttgattgacatttaggcattaccagttttgcttcctatgagcagtggaagagtcacaaagacagtttttagaagtactttcacaccaagcctgggtgataactgtgagctcatgtgtggtactctccaactgaagctccttttatattaataatccattaatgagggtaatcaattcgtgttggcatgagctctatgaaaatacatagcataatatgggctccggccttgcattcatcagaattaggaggatcattagggcgcctgtcaaactcccctcctcgccgcccatcctcatgttccattaggtaactctacagacttagagaaaatacttttctttttctctaacggcagccctcaatgacttttctttctgttttgggctttttctttcatgaacatcacaaacgtagacactccgtttggggcacttttttttttttttttgaaacagtttcattcttgttgcccaggctgcagtgcagtggcaggatctcggctcactgcaacctccccacctcccgggttcaagcgactctcctccctcagtctcccaaatagttgggattacaggcacctgccaccatgcccagctaatttctgtaattttagtagagatggggtttcaccctgttgaccaggctggtctggaactcctgacctcaggtgatccacctgccttggccttccaaaatgctgcgattacaggtgtgagtcaccacactcagcctcggccactttgaatcctgacattagaaaaagcatgaaagccaggtccctttggttttcctttcctgtgtccttcccagctccccactggaagaggagtcctgagaaatccagcctttggttttgctcctggagataccagcaggtggcaaagactcgttaattccccaataaccacagacaattttcccgattttcagcaacctttgaaacaagtgctgtgtgagttgcattcttgtaaaacaccttcatgaagagaggaatcaggtgaaccatagagacttcagacttaatgggtgtgtaaatgaatattaatagttcagctctgtacggagggtctggcgcaaagtcaaatgggatacatgtccaggggatttaaagcaggtcttgctattttgttggaagtaaccaaaattgatggatgccttataataagcataggtgtcgatgtgctaatttacgatgattaatgccgccttgttgattttcatttctcattaggaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaaggtgggattgtcaaagtgaagtttccagatggcgttagtatttctaatagggcctgagagcaactgagtagaaattaaagtcaggatggataagttttgtcttcataatcaatgcttctctaaagcaatttcagaaatgtgtgtttcagcagacaagggagatcctcccaaaggtagaactctggttataagaaggtgtacctatttccccaagagatttccagttattttctgtgttcaaaggctgaaatcccattttacccgttggactggagattttgtcttcatgggaaaacaggttggagttttaggaagaacaacaagtagcccctgtcttcttttccctgacaggggaggagtttagaaccaacagaaaaagaaggcacagaagtcagacagttggagtccaaaatatcagattattacattaattaaaagcaagagtaaggctgggcatggtggctcatgcctgtaatcccagcactttgtgagaccgaggtgggggtggatcacctgaggtcaggagttcgagaccaacctgactaacatggtgaaaccccgtctctactaaaaatacaaaattagctgggcatagtggtacatgcctgtaatcccagctactcaggaggctgaggcaggagaattgcttgaacccgggaagtggaggttgcagtgagctgagatcgtgacattgcactccagcctgggcaacaagagcaaaactccctctcaaaaaaaaaaaaaaaaaacaagattatagggcgtgacactggatatgtggccccaggtgaaaattaaatctgcccttcctgtacagaggtgtgtatctataggcctcctctccccagcatctccaccccaccccaccagggcataggtgacccctgtaagttttctgcatgcagagagcagctatcctgagcacaggctgacccagatgggggcccagagagggagagtctgaacttcttcaatttcttctttcaagtctaccaattagttaagtcatttttcctccacaaaggacaagagatgaaaggaagaaaaaagttggaagggtttttcccagatttttttctcctggatacatagtggacatttcttcctctctaaggaaacatgaggaatgggtactctatgttccccaccccacaaacatcgttgtcaaccagatccatttaattctgggaaacagaatgattggatctggatctcccctgtccctcccagggatgatgtctaggttagccaggatggttagttaacaggagaagtgggacaggagcaggaaagggatgctaagctgggagaatgggactatgtttcctctgggtaccacctgcatgtgagcagccgctgagtcttcagagcaacattcctgggcgatgttgcagcccgtggcctggagccgggtctcaggctgtgtgggtgtagactcatcacagctatggtcacagttggaagtgacctgaggccatctggtccagtggcctgtacactgccattgctgtgaacctccccccacagtctctgcctttctcctgtccatgatgccagccacctcctgaccacccagcagccccccggggataggcgggtaccaggcactgggtgcccccgaagaggtgcaggtgggagagtaggtaggatggaggctgggattcaactggactaaggcagaattatgcctgtgtactcagaagccactggaaagcaaagaggaacgctaatttgttcttccagaatcaaacagcatcacaagttataaacagaggggaaattgttacttcataaatacatggtatttctcgattaacttttttgattaactctgtgattacattataattgtgggccacctaagtacacagtaattatcacaaaaatcgcagggtgattatgggtttatttcagtccagtaaagtaaagcgttcccgagagagccgagacctaggagttacacggcaattaatctgagttgctttttacttgaaataaaatgaagtaatacatgcttttttaagaaaaaaaaaaaaagaaagaaaaagaaaaaacctcttatctatgctgcagatcagaacaataagaatctgtctttgtcacctgcaatttccctcttgcaatttgtgcctcccccagctgaggccagtgatatttgcctcctggatcttgtctcattctagggccattattctgcctttagaaagccagatggtgtaagtgacttataaaacacataattgcagcattttaaagacatttatttctactgattctaaatctaaagcaaactttcaaatttgaacatggaacactggcaagatggtggttacattccatcttataatttgtatatgcagtatcctttttgataagggggcatatcaatggataattcagtttttaataatccaaatcttaatacttcagatgaacagctgcattcttattcttcccttaggccaccatgttcattacacatgtatggcaatctgtaatctagcctaaaacaagttctcttaccatgtgtggaattcctgaggttttcggggggggaattatacacccctatttcacagctctgcagagagcaggcaccatgcaggtaccaatggccttgtgttcacttagcccctagcaacaggagcaaacgctggagcaagtgtcagaagggaaaacagaatacagagcttcttatttccttcctctctttactctttcaggattgaccggaaaaaagacaagacagaaaggaaaattttggatagtcaagaacgagccttttgggatgtccacaggcctgtggtgagaaagcgctactcaattctctagatttttttttcttaattgttcatttttatctctataaagaaaagaccgtctttagccaccaggtgtctcattcttaagaaaatcgctcagctttgtggaactggtttcgccattcatttatataatctcagtaaattttctggaatatatgtaagttccaccttttaaaaattattcattcggccgggcatggcggctcacgcctgtaatcccagcgctttgggaggccgaggtgggtggatcacgaggtcagtcgatcaagaccatcctggctaacacggtgaaaccccgtcgctactaaaaatacaaaaaaattagccgggcgtggtggcaggcacctgtagtcccagcgactcgggaggctgaggcaggagaatggtgtgaacccgggaggcggagcttgcagtgagccgagagcgcaccactgcactccagcctcggcaacagagcgagactccatctctggggaaaaaaaaaattattcattcctgaaaatatggaattgcaaatggagaagctatgggaattccaccaaaagacctttgtgtcccgaaggtttacattccccaaattaacaatttccatttccactgctattcaactctgaatcttcaactattctctgtcgaatacggttaattcttgttatccatggcagttatgttctataaagtctttgcaaacactgaattagcgcacattgaagcatcactcccgtgggaactaccaagctaggtccccgtgagcctgtggccacaacatttttatcagctgatcgatacataaccttttaaatgtgtttctgtataaagacagcttatgtaatatatatcattgattcattaacattaaactcatggccaacagcactgttgctcatgcctgcatgtttatttcctcctaaggcacatcagagaatggtgaacagcacttcagcactgtccttggggccattttaaacagcaaaatcaccaacaaaaagtacagaaatgcagaaaagttggcactaaattagccctaaatagaagggtctgaaacaaaaaggcaggacgtcaccttgttcaatttcagtgggaaacacacatatcaggctactcaaggtacaactactgagtaaggagttataaatgaaatttagcaagcaggcaaattcacaaatgcaaaatttgtaaataatgaggtttgactgtatttctgatttcacgttattaaaacaaatcttgcattttcctcatgaaatggaactaaaaaataaattattggtcttcttaaaatttgattaaaagcaaaaaataaataaatagctactcatcctgatatcgtggagtctttttcaaacggttaagtatgtaaaaaaaaattttaaggactgtgtctgaggcaatcttgccacttaaatagctaatttgctcttagaaactgtacactataccctctacatatcatccttagattatgaggtaagcttttctagatcgtatgggaactccacagaggaatgcatattatggcaaaatggaaaaaaaaatcatgcattgtctgtaatggaaaaagataaagattggtcctgatggtgtgacatgggctaaattggaagtgtaattttcacgtagtaatttatatgatgtgttttttttttctcagccaggctgtgtgaacacaacagaaatggatatccgaaaatgtcgacgtttgaagaatccacaaaaggttaaaaaggttcgctagtttagctgagttaaaaattcctgatgtgaatagcccttccagttctagtactattcaaatagtaatttgctacttgtaattctaccaccttttgtcatttgaaaccataaccatttcacaaatattgattgagcagctgatgcatgcttggcgctgtgctcgtgctaggatacagtggcaggtcctcatggagcccacagcctggcaggagtaaaacaagccaacaggcaacagggccatgaatgctgtgttaggagaggtacaggacagttgaggagcccaggaggggcagctaagccagacctggagtgggtgggggtggggggcttcccaagggcttcctgaaagagggtcaggtgttctgaagggtaagttgcagttgtcctggggaggtggcagggaggggaggaaacaaaaggagcaagaagtggcaaagctcacaggtgaaagcaagctttatacttagaagcaaataaaagtcttttttatggtttttttttttttttttttttttggatagagctggatcacccaaactcaaaccaccatcttgtccaactgtgaatgacccagtggtcacttgtgtttcactttactcaaaggagtagtggtcacagcatacccgagggtgccatgctcagactcccccacgattcatatgtcccaccctctccacagcaccagggacaatattgcaggacagcatgaccagactccgtaatattaatttccaaagagtgggccaggtacggtggctcacacttgtaatcccaacacttgggaggccgaggtgggcggatcacctgaggtcgggagttcaagaccagcttgaccaacatggagaaaccccgtctctactaaaaatacacaattagctgggcacagtggtgcatacctgtaatcccagcttcttgggaggctgaggcaggagaatcgcttgaacccaggaggcagaggttgcagtgagcagagatcgcgccattgtactccagcctgggcaacaagagcgagactccatctcaaaaaaaaattccaaagagtggagatgtgtccccaaacattcctatttcttgtgatgaccaattagctctctctcatgtatgcattaaaaaaaaatacacgcacacacacacacacacacacactagacatggcgtatgtatataaacttctttaatctacttacatattttgttcgtcactgacttaacaatatccactgtattatattttaaaatgttagtcctaaaatgtcctcatttcatcttcaagagccccataattctaacattacagaatttcatggagtcacatccaccttatctgagcccttctgcattttgatgattttgactacacattgcatgcccttcagtgtttcatttctttcccattgcaaagattgtgtttagtctttccgtaatacgaggaacagctttaaatgtagctatagctacggacatgtggaaaaacttaggccagaaaactgtttaacttgaaagggaaaccctgaaatgctgccatcccagttttgtaccagatgggaatctgctgaccaacggaaatgtagaggggatcttttgtgcatactctttggcagtggctcttgaactttctttattcagaatcatttggggcatttgataaaagtgcagatttccaaacccacccacaaagattctgatgcagtaagtccagggggcgaggggatactcagcaacgtgtcttttccaagcacacccaggtgattctttgcaggtggtctatggaccatatttggagaaacactgagatacaaggaggctattttcagcccaataaaagataggatttgggttatagtggtaccccaaagatgagatgacatgccttaagaggcagcattctcatcattgaagaaataaaagcagagaccaatctcttattgtcatgaggggattcacgaaattggatgagtcattggactagctgacccctaagccaccctccaattctgtgggtggatgatcctctgtgcttgcttcttctcctagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgccatttcagcattacttggttgaatgttattttctttcatgatgagcagcccaggtcaacagacaatggctaattatattacttccttctgatatttactggtaacaaagcaacctactgtttatattatgccttgctggttcctagagggcaaaacccaaaggagtaaactttgaggtgcttgcccttgacaagtttattatctgatgggtaagaggtaatggatatatgaaaaaaaaaagctatttggcggggctcggggctcggtggcccacacctgtaatcccagcactttgtgaggctgaggcaggtggatcatctgaggtaaggagtttgagaccaggctgaccaatatgatgaaaccccatctctactaaaaatagaaaaaagttagccgggcttggtggcgtgtgactataatcccagctactcgggaggctgagacagcagaatcacttgaatctgagaggtggaggttgcagtgagctgagatcatgccgctgcactccagcctaggcaacagaatgagactctgtctcaaaaaaaaaaaagaaaaaaagaaaaaaaaaccacacagaaaaaaagctatttgatgattccagtcaagcatgccaaggacatgggtgtgacgtgcctgtgaaaggtgggcagaggaggggtcactggggattgttcaaaacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagaggcacaagtaatttgctggagggcagagctgagggagttggagatgtctggccagaggaggtatttggatcttggtggaaatgcaggatttgggtttgtggagcgaggggaaaaaaataattttagtttggtcttaacatctgtgttctctattttcccagataacatttttgaacgcacagatcgacagacattgtttgaaaatgtccaaagtggctgaaaggtatgttttcctttaataatattactactttcttctaatttaacagggaagaaatgttacagggttatggttaacgaatgtgttcaatgccaagagttagactgtagttattccttagactggggtgcagaaaaacccacaggctccatgtgagtataactaagataacagacctcccttgagtgatgtcaagaaatgttccgttgctaaggctttacagggggtggccacgggaccttgtcaatcaaggaagaatgtcctttaaagctacataatgcacctttgccttcagcctctggattaattcaaatggaaattgctcccctttcagctataaaatgcccagattcactttataggggaaaagaaattatgtgtgtcctttgaggtgctggctgcatagacaggaggggactggatcatcgggaagtgttccgcctccacacgccatcaaccactgaactgcatcgaatcagctgtaaagaaaatatttggcccctccagcctggcttccacagcggtgtgtgtgcttcattctgcaccagtagctagttccactccgttaactcatgggagactcaattttatcaactaaatggtctgtttttttaactcttccgtgaagatgggagaccacatggggaatctatatggaataaatctaaccaggcagctcagtagtgaacatttattcatccatatgctaccgttaaagcaatgaccaattgcttaaggaatcaagagcttaagttgggtcttggtatttattggatgtcagataaactgagtcttttaagcccagctcctacagggggctggctgtgagagccatctataagcctgtaagcctttctctgctggctcctgggttgattcacatcttttttctagataaattacaacaaatggaaggtataaaaactccaaccccaaacaaagagtctgattgaataccctaccttcaggggctaaggacatccctggacttgggctcacgtctttattccagggtttctcgattgtggcactagtgacattctgagccagataattccttgttgtgttcttaatgtcctatgaattataggatagttagcagcattcctgacctctccccattagaggccagtagtcccccaccaccacagctgtgagaaccaaaaatgtctccagacattgccaaatgtcccctgggtggggtgaaagtcactcccattgagaatgactgacactcctgctttttctatgcaaatgtgctggaaagttgccctggctggagctcagcttacactgaggtactgatcactctggagtcgctgtttcagctagctgtgtaggctgcagaatcacctcatacctcctctctcatcatgtgtggcttctggccagagtaccaggctctgaaaatgctttttaggtctcactgtggttcctttgccccagaaaggtggctgtgagtgaaacagcagcatggcctcaactctcttggtgtcatccatggcctgtgaggaaccacgagcttctttctctgtgaactagggacagaaatggctgtcctagtatactttgagggtcggtgtgctagcaatgctcatgtctggccttggaaggtggaagagctctttagggtttgcaatttagaaagagcgtatatatgggagcatctgtttctttggatctatttgctcaggtccagtggttctaagtaccgtaatccaggtgagggagggggttaaaaaatggaaattcccaagcctcagccctagggattcagattcagtggttccagggttgagccaagaaatccacattctggataatcttcaagtggactgatctggtctttcaggatccggtgaagccattgcctgctactcaggctgacctgagagctcacatccaatttgttatatctttgggatgcagagaaagagcctgaacctgtcagcatgagggaggcagactccagggcaggtgtgcagagagtccaaggaatggaggaaaccaaggtggaggcggggagcccggcccatcctattgtttgtttgtttccttgctgtcagggaggggccccacctggtaccacctaattatgcttgagaggctgctcatattgaaggattattccaactggctactcctcggtgcccagctagaagctttcatgagtctctgcccggcagaggctggattttattcccagcagcaataactggcaacttttcaatgcgacacgagggtttttcattagagccacaaggaaacccccagataaggaggaggagggaaaggagacgcgtgttagctggagataaagcagctgggagccgggcctgtcagtggctctgtgaagatggggccagggaggaggtgctggcagctggtgagaagctgccagagatgcaggctgagctctctcaggtgggcacgcacatccacatccacatccccatcctgatctggcttccctgggcctgctccaggtgataagtggcaattccatatcccccaggaaaccgcatcccccaggaaaggtcttcatcatttttcacccagttctgtgagaactaatagtgaggagaggcaggagggctggggacagcgaggctgggctctgggatgtctacagtcagggttggactaaagggtgcatccagaccagcagggagggaaaaagggaactttgcaaactaaaggggcagaacagacagtttaggggatgggtctgaaaccgaccatcgaggtttgaaacctacccctgccatttcctgttttctaactgatgaagccagtggcttcttctctcggtgcctgtttttacctctttagaggggagatagtagttgtatttaaattataggattaatgagttcatgcatggcaaaagtatggtccagtccttgggactcagtctgcacactgggaatgtgaataataattattttccagcatgacacttaacttgtgctttggaagagagcagaattcaaggccatgagacagaatgaactggatatatggtgcttaaaggagcaaacaaagggcaggccaaggagggaggctgctaatgcaattctttcctgcaccctctgtctccccccagtctcccacacagagatctctgcaggctgcccaaggctgaccttgcactgcatgtctccttccactgcctcacacgccatcactaatctggggctttgcgggagaaaagacttgctcttctgcacagaatttctcagatcatcccagttccaaatattctgtccattgtcttcctgagtgcttaagtgtccccaaaatgccagcatcgtggcaaccaaactgcatttcctaggctgccttttgcacctggaagcaacacaaaaggctttctgagctgttacccaatttttgttgcagaatgtattgtctctgcacacacacacatgagtgtctcagataaatgacacttaacaccctaagctttttattttaactttttttttttttttttttttgagacggagtcttgctttgttgcccaggctggagtgcagtggtgcaatctcggctcactgcaagctccgcctcccgggttcacaccattctcctgcctcagcctcctcagtagctgggattacaggcacctgccaccaagcctggctaatttttttgtattttttagtagagacatggtttcaccatgttagtcaggatggtctcgatctcctgacgtcgtgatccgcccgcctcggcctcccaaagtgctgggattacaggcatgagccaccgctcccggcctattttaactattttttaatggcagtgtttcttaaatatggttcatccactttacttcctaataaaaggacactacatttcagttaattttgctagatgactcaagagtcagtagtcttctattatgctttaaaactgtcagtggtcaggatcttataaggtgccctgcttccccttccctaaatggccccagataataatattctttgaattcctgtttctgccttttagttgtctgtctgtctgctttctctactaacccttccccccaacacccaacccctgctttccaatctgtagcataccatgtgtatcagttagctgtcactgagtaacaaaacaccccaaaactcagtggcttaaaaaataggcttttactattgctcacatgtctatgtgccacctggctccactggtctcagccatgtttctctatgtggctatgggttggcgaggcagctctgctgatcttggctgggctctctcacatgtttggcttctgctggtttaggatggcctcagctgggacagttgagcactccttaatatggtctctcaccctccagcagactagtttgaccttttccacatggggatagtgggattccaagagagagaacagaagcatgcaaaactcttgcagattagaactggcattctgtcgcttctgttaccttttattggctaaaacaagtcactaagctggactagattcaagggcagaagaaatagactccttttttgaaactgaactaccacaccaggaaatcaaataaccaaattgattagctttgatcctaaagcaagtgtgaaaagtcttttttgtgaggtgtgttgttcccgataacaatgaaccttgaggcatggtgtttatttcatctgtagactatgcagaggctcttatgctcacttatctcatttgtgttctctggatacttgaagttgccagataaacaaggtcctactcttctctgcaagcgtccccaagggagtccctttttttattcatctaagccttatagcacttgacaaaccaactttgagaagcaacactccatgcattttagtcccaaactgtctagtctccatgtttggctgcgattccccagagacttctcccgacccatagcgagcttacaccacaatcactgcagctatcccagtgcactgctgcacacagagggatcaaaatgtttcattccgtacctgcatctgtacttggctcatcctcaccctattactgggagccattcgtgtgtcacagctgactgctgaattgattttttttagcatcatctcacttgcctgtatctgagattgccgctgctccctgaaattggatgctggttcttcctccacctcctgaccctcagtgatcatgaaatgtaattaatgaaatgagataagacagcaagggactggatacccctaagggtctattaaaaacctgctagggtgatagaggtttgggaacttaatgtctaattatagtttcaggggaggaaaaaagagggtcacagaagtcattacaactttgcttttatgggatttcagaaaccatggggtctttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccaattccaggtcttctcatgtagaggctctgatttcataatgaatgctttagtgcatttgtactgtatttctaaagtaggactaatggtcgtatcccataatgctttagattccaggcctcgtttttgttggattttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgcttaactcaggatggacagcatttcttcttcctccaacttgtcatagttttgtgtggtttttttttggtggggggcggtcacatctatacaatttgtagcaaaattataagtcttttgttaagagagaaaggataaaatctacaacttttatttttgtcatattttctcaagtggttggactgtatgtttactaaattctctttcattatttccttcccctccatgtttatcaaaggtagaccctaattagcaatctaaattgggaaggttttgcattaataactgtcctcctaccaggattggttactattgttagaagctgtgactttgctgttagctcagctctaacaactctctgagatccagagagctgtttgctatttaatggcatagtaggctctgaataatggctactaaatgactgaccacagagtgtacccctggtagccatctggtagattttttttttttttttttttttgccattactaaaggttcatggggcaggagtatgtgaacaaatagccagttccacatttccactcaagacccagttcaaagcccacgacaatggtgggtagcacatttgctaaaggttcacagatcagcatcttctagtgatgtgagaatttgtcatttgaaaataacaaaagcatataccaatcaggagtcagggataaagggacaagaatgctaaaattgctcattgagaaatattgttcctaatggacttctgaatttcctatatttattttatttcttccatctcatcccaattctgcttttctgccactcacacccagcggttggaggaccattgctgctgtgtactgttatatgctggacatcctacaaagctctttacatacctctattttcttctccctttttgcttctcctctcctacctctagtctttctgtggtcattggtattgactttggactgaaatggtactgtgcgttggccattgctgcctccttcattggcctgcctggccttctcattgtcttgtgtgtcccaagcagactctgttcatcttgtaatctgtacactaccaggaagcacatgttctgaaagagacaacctctctggctagttctacaaagggctgccttgatgaacttgccttcacactcccatcaccttcattcccttttcaactgtattggtttgattccaagcaataaaaccccagcttgaacctggttctgcaaaatagaagcatgccttggctcccagaatacaagaaggggctgtggaattgaaccctgggaaaggcagcaatgctactgagctcaggaaaagctggagccagggccttcagtgcctccaagacccattcttcctctctggtcctgcccactttccatgctgaccttattctctttcatgacagacatgtgttaggaaacatgacaccaccagcccttgaactttgtgactatacaactttgatatggtttggctgtatccccacccaaatctcatcttgaattgtagttcccataatccccacacgtgatgggagggacccagtgggaggtaattgaatcatgctggtgttttcccccatgctatgctcatgatagtaagttctcatgagacctgatggctttataaagggcttccccccttcattcagttctcattctccttcctgtcaccatgtgaagaaggacatgtttgcttccccttcccccatgattgtaagtttcctaggcctccccagccatgctgaaccatgagtcaattaaacctctttcctttataaattagccagtcttgggtatttcctcatagcagcaggagaatggactaatacaagcttctactgctgaagctggggaaagaagatatgaacctcacttgcgtcaggtatctgttcctggacaaatcaaccatggccaggagcagggcttataaataaatacatggcagctcctgaagtagccttgtgtacatgtcagagtacaattctcaggagacaagcagaagtgagcagaaacccatagaggccctctatgcctgctcacccattttggagtactcaccatccagaatccctatctgcttcactcagattcccaagagacccagcataagggtcaacccttgtacattcactgtattcctaggcagcacttctatctccatttggatctcctttcatgcctaagaaatggtgctggacagcctaggcacaaacccaaaagccttttaactctctgcattaagcttagatcttatcctatgtggccaaccttcatttctttcctgtgtcccaccttggaagctctagctaccaggcataaggcacctccagcccagactaaagagacaggagagcaaggaaagggtaaggagtccttgctttcatttcttgtgctgtttctgcacagtctgatgatgttgagaagcataagggaagaggagatcgccttccctctctgcccagcgtggggtgttctttcacctcctctcagtctttggctaccccagctgtgaagttaaccctctctgctactctctctgggaaggatcaccctcccctcccaccaagaagctgggagagcagttgaggcagcagactgctaaatgcccaggtcacccatgggaaactccaagatgcactttgctgtctcctgtcttttccatgcaatgatgatggcaaataggacaaatgagggtgcatagattcatgaacactgggtttatttgcgtgggttgtgatagtggcagcaaaataaaacatggcggtgccattatgcaccttttatctactgccacactctcctccaggtgactttattttctacatagataaatatagtaagaaatacataataatacatttattttttcacataaattgcagtcaaactacacctgtggtaggcagaataatgatctctcaaagatgtccatgttctaatccccagaacctgtgaataggttatgttacatggcaaggagaattcaggttgcaggtggacttaaggttgctaatcagttcaccttaaaatagagagattatcctggattgcccagatgggcccagcataatcacaggttcccggaaatgtggaagagagaggcagaagagtcggtgtcagagtgatgcagcatgagaaaaccatagctggctttgcagatggaagggggccacgagccaaggaatgcagggagcctctagaagctggaaaaaggcaagcaaatgaattcttccctagagcctccagaaggaacatcgccctgctgacaccttgattttagctcagtgagacccatttcagacttctgactcttagaattataagacaatacatttgtattgttttcagctgctaaatatgagataatctgttccagcagcccttagaaacaaatataaaaccccagtctctccccttctcatagaatctgaaggccaaattgttcatcctctttgtctttaatataccagcatctccgagcaccccgctgactaggagtgcctcttatagccccaatacgtgtatgtctcattctgatgattcaatacttccttttcccatcaataaaatacaacattcaaaatatgtatgcccatctaattttactgtttcctttacaaagcctctgactttatttatgtaacttaacaaaatagatttccctcttctaatacaataaatttcccttccgaccagtaccactcatctctgacactggccagcagattagttgctcgtaatgactttggctttgttgcctggttcaggttgtcaggactttctgtgttccttctccacgtgttcctctatagcatgtcttgacgcctcttgcctagaccttttttagagaaggcatgacatggcacaagctcccaggaacaatttcattcatgcttaatgcctgttgcaaagtcatattttttgctcttatgttgggtggtcacaaaaatctcaccttgggctctcaaccacattctcctaaaccaacatcaccatgagctctcaccacctctcttccacccacttctctaatgatattccaggatttttcttaaagagatctggctatgagcctgtatttcattacagcttaaataatcatattatttcccatttccttagttgctctctggacttttaagattctactgccttaggctggtcagcggacagctgccttcattgccatgcatatagtaataggcagctggagcctgcaggctcctcttgggaccaggtgctggctgaactctcaccacagcctctcctgagccttccctattgtcccctcagcccagcactcactcagggctccatatggggacttgtccacaggacctgacctggctggttggaccccacttcccaggttggagatgtgaccacatcgaggatctgctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccaccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtgaaacctgtgaatgtgacctcctttgggaagagtctttgcagatgtaattcagttaaggatatctacataaatcattatggattatccagagactccaaatccaatgacaagtgtcctcataagacaaaaaagagagcggatgacacaggcacagaagaaagccatgtgaagacaaagacagagatgaaagtgatgcagccacaagccaaggcatgcctggagccaccagaaactggaaggaaaagaaaggaaaggaaaggagaggcaaggcgaggtgagacgaggcgaggcgaggtgaaattatcccctagagccttcggagggaggatggccctgccaacaccttgatatcagacttctagcctccaaaaccgagtataaacttctgttgttttaaccatttgtggtcatttgttattgcagccctagaaaactaacatattcctcaacatgcaatgccatttcttttataaagaattcaatcagcccaagtagctaagaagtggcttccaggtgcagcaccaacttgtagcctggtccttcctgccatagtgctttcttacagctcccttgcccaggttcattctgcctgagatgtcgtaaagctcttgatatggtttgcctgtgtccccacccagatctcgtcttgaattcccatgtgttgtgagagggacccagtgagaggtaattgaatcatggggcaggtcattcctgtgctgttcccatgatagtgaataagtctcatgagatctgatggctttaaaaatgggagtttccctgcacaagctcgctctctttgcctgctgccatccatgtaagacatgacttgctcctccttgcctcccaccatgattgtgaggcctccccagctacatggaactgtaagtccattaaacctctttctcttataaattgcccagtctcaggtatgtctttatcagcagcatgaaaacaaactaatacagctcttattggtgaagcctggccccagggaagatgcataccttgcaggagatttataggacagaggatgtgcctctagtgtgcccgtggtttcgcttgtctattttatatttgtagaggattgtcaagattctttggagatgctttcccattttctatcacaatggtcctgagtgctcaacaagcctgttatataacatgatgaacttgacaaagatcagttaaatgactcaaccaagaattcaaactaaggcttttcaactgggaccactgctgcttctaccccaggggtcatgataaacacctgggacagcgaggaggctctgaggtgtccgaaaatttacatccatcttcaaaaccaaaattaccaggggctctttcattttgatttgatgaataaaacatcttgtgtcctgaatgtttcagaaaattgaggaatgagatatggttctctcaaacttggatgtgcatatgaatcacctgggggatcctattaaaaagcagaatctgactcaggaggcctgggctgggacctgagatcctgcattgctaacaggctcccaggtgatgccagtgcagctggtttatggatcacacttccagtagcatgagatggcacctctgactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttacaatttttatacatttctgtatgcctgaaatatttcaaaatttaataaaaaagaaagtgcatagggacagagtaaagaacattctaacctacatgttgggggcagaagtgatgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagatctcagacacatcagatctcataagaggccacctgaaaataagagaattaatggaagctctacgcactgaactgtggggcctgtagggatggaaagtgtgatacctttcctcatctaccataaggattacggccaacactgctataacaaaagaggttaacaagagaaaagcataaatgcatttatttcatcagtttcacatgacacagaagccttcagaaatgaagactcaaagacccagggaaaactgtatttgtgcttaggttccatgaagaatgggaagccttgtagaaatgtgattggacaaaagggtgtgatctactggtaacagactgaggggaggaaacccagcaaggcctgtctgttcagattcttcttagtgtctctgagtagcattcctacctcccaggtaggacctctctggaatgagggttttcaagggagaagggagcgagtgacctttctaggttttgtggcttgctttgcaggagaggcattctagtttctatgacccactttggcgaaaaagaattcttgtttctatgacttacgtcgggggagaaaaagggatgggagacgggggcaggagagaaggtgaaagccttggcttctgaggcccttccattctcctttagttcaaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgccacagcagtagagctgagtagtggcaacagacaccatctggcccacaaagcctaaaatatttactatctaggccctgcagaaaaagcttgccaatgcctgccctagggaaaaatagacgccccagaggaaagactccagatccctcatttggagctcccattaaaatactggtaaacttccctatgacaatgaagcccatcagtgacaagccccatccacacgcccactgagccgccaagcaggtttcagtacctcagtcttaagtacaaatggatgtccaaagattttccagacactccaggaaggctcagcgtgaaagagtataatcaaaataaaccgacagaaaaaaggaacttggaagaaccaaaataattcaacaactggaagaaacttacaataaaagtatagaactcatattatctgagaaatgagaaggtatttcatccataaaacaagaactagacactatgataaccaaaagtgaactctgaaacttagaaagtaatggctcaaaattaaaaaataaataaatagttaaaagagagtttaacaaaaagacaaggagatgaaaaatgggagggaaaataaacaattcaggatgtccaatattgaactggaaaaaaaaatataggacaagcaaacaaaggaaacaaagggtttaaaattagtgatgaatactataaaattcctgataattattttcttatctatcacacactgtgcccagcatagtaaataacaacaaccagcaagggccatcatgaaattgcagaacactctagcaataaagagatgattctaagttgacagagagaaaagaaactgaaccaaagaacgagaatcaaaatggatccaggcttctcaatagtaacactgcataccagaaaaaaaaaaacatggagtgatgcctacaaatttctaaaggaaagagatttttcacctagtgttctatgtctagcactatcagtcaagtatggagataaaagcatttttagacttgcaaggattctcatgcatcctttattacgaaactactaaaggatgtgcttcaacacaatcagggagtaaaagcaagagatagacatggaatccaggaaacatgggcttttcaacacagaagtgaaggaagtcccaaaaagatcattttccatcaagtctatagagcaaatgatccagtttcgagcaagaagactaaagacttcaggaaagaggatctctgggaaacaagaggacagaactgctcaattatttgatgtgtttaaggtataaaaaaatgattgctagatgttttacaggtttgttaaaacacttgcttggaaaaagtagtatgatatttagctgaacagcaaacaatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaagtagatgcctctctgagaagggatgggaggaaaaaataattgcttttgcttttttagtatatataatcatttggtactattttattattctaactattcacatacattttgataagaataaaaattagtctaaaataaattatatcaatctataagatcaacatatctattagatcataattataactagaaaagttgcttttttggaaaaaaatgcaaatgtttactccttgtggtctgctgatatttaaaagtctttatcataagaaagtccttccgttgggaatgctgagctggcagtctggtggagctgtagtgtcttttgtgtgttccagatgcctcgagaatcagtctttgtgggagggtggaacacaaacagttttgaccagtgtattagtatcagtaaggctagcataaccagggagagatgcaccaaggttcaggtaaagaatcaagtgaggaaaagatatataaaatgcatgtatatatcatggctgcaacagtgcaaaaatggtatgttcgttataagaaggaaataaggacaaatgaaaacagtttgatgtgtcagaagtgggagcggaaataaattttttcctttaatttagaattatgtgaagactgctataatgtttgtgtaaaacagaataaaggggttttctaaggaaatcagtggcattctttgctctgcctccctcctgcagtttaattgcctacacggaacaatatgtggaatatgaccctttgataacaccagctgagccatccaacccttggatcagcgatgacgttgctttgtgggacatagagatgaggtaaaaaatgttttaaggtttgggagtgggatgaatgtagacaaaaatccatgagatcatgagattaccttatattctatcttaatttgacattttttatcgctagaacagaaacccctcaagtagcctcccagctgagttctacttacagtttctacctccttatagctttgatttgtgcatggatcctttgtggctcccctctgaccctttggataccatgataactgagacagtccctcaccattccctagttctgattgctggaagaaaagaatctgttgttccaattttttttcctgttagacagcaacaataatgataatagctggcacgtattctgcattggccacatcctgcagtaagtgtctctcactgaatcccctcgacaggtaaacattactattctcaccactcagcagttatggaaactgaggcacagaggagttaatgaacttgcccaaggtcatactgctagtacagcagagttaggactagaactcaggcagagggctccagaaccatgatttcatcactctgttcttctggagtaactgccagcaacgattccagccagtttctccttccctgtgagggaagccactgtgtttacttaagaggggaggaaccaaagcccagagggacttggaccactttcagaattacagaaggaaacacacagacaaagctagtgtggtgtgccttcacaccccctgcaccttggctggatgaatttttatttcccttttcatgtctctgtcactcacattgtctttcacttttgccccttttctggctgcttttcctgaaatggaaaaaatcttataaaaataataaaagtcgcagatgctcattctaaaaagttcaaattatccagatgtgcataaagaagaaaatgctctcttcctccaacccgatttcaccttccagaaagaacctttgtttatagtctaatgctgtggttcccagagtggatcagagcaccctgagcactgtggggaactcacagagttaccactggatagtccaaattttttatggaaacacagcgatggttgacacatggcagatactgcataaactactagcttaagatggttcagtttcaacattagagcacgttacatcccttatgatgatacgcatctttgcaaatctggcttttcggagcagtcactatgataaaaagcaagaactgcacaaaaattaacatggaataagaaatagggacggtaagttccaacctaattccaaaatttaagaaaatgcgtagtgcccaataggtgcatattgtagttatttaagaatgaaaacaaaattttcaatttatgtgtctttcaaacagctactaagttgttaggatacaaatacatattaagttgattggtcctagccataataaatgacactgttaagtatttcttttggcccaggggcactgtgaaaaacttactgagacgctaagggtaccatgagctcagcaaatttgggaacatctgatttagtgtctattactttggatttttatgcacatataacattctatccttttgtataattgggttcaatatatatacccaaatatgtacatatatatatatagtccaataatttttaaattaacaataggtcgtggcagtctttccatgtaaacacatatagatccaccttactctttttaatagctacatactatcccctggcaccggtgaagtaagatttattttaccagtacctggatcataaatatttagcttatgtcctccttttttgccaccataaacaatgattccgggaacatctttctacacaagttcaattatttcatcagtatatattttccaggagtagaattcgtagaaatggtatgcatattttaattttagttcgtaggtccagattcctcttgagcaaaactgtaacacatctttttcattcccttagcttaaaagtgcccatttccccacattcttaccatcccaagcatcatcaatcattttgtctttgcaaatccaaaaggttaaaataattctcattttactgttttgtttccttgttaatatacttgagaatcttttcacatgtttattagacagattctagcaatatgttttgctttggatatttggatataaaacagtcacatttacttgaatcatatattttatctttttcctgatatatttctgaatctcattctttgttcttgtttctttttctcttccctgacttttactttattaatgttatattaactttgtaaaaaccctagtttctattctagttgtattaacttttaaatgttttaattaaaaacatcatcgatttaaacaaacaagagtgaagtatataaaatagtgaagttacctttgcctcccttaaatcccattcttcccagaggtatgttaacttgatatattttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattctatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttttcttagtagcctgctctgttctattggtgtttatcatgttactccccctggagatgtgatatagatttttttcatagtttatattttttccatattttcatatctcctctctatttctgccgcttagttttattcggggttattcattagagaatcatcatttctgctcattgtttcattcattcctctggtcactgctcagagcagatcattctttttgtatgcccagctatttggaagactgctcatttttataaatgaaggtcttagctttcaatcctgccatacattagaaccacctggaagtttctaaaaaatactaatgcctggtcctcacacacagccaattaattcagaatttctcacaattgaacattgttttttaatctccccacatttttttttaaatctccctttttaaatcagggagatttaaaaagtctaatgtgcagccatggcctaggactctatcagtagctggtgagggtgctctcagtgatggtatgggccaatggttctaagccatgctgtgcatcagaatcacctgggctcctctttaaaaatacacgcatactggggtggctctgggcgtctgcatcttgagcaagcaccccaggcgttctgaggcacacgacagtttaagaagtcctggtttggttcacggagttccccggcaggctttcccctgagcagttcacacaggagcagggctgcacctgaatgtatgaatggatgggcatagatcaattgccaaggttcccctctgggtcccgggtatgtggtccaagaacagattaaaagattgggccctctcttacagtgagacaggtggcaatgggagtcttggggaggtagacccccacccttcctagtgtgacatccctgcagccaagtgttctactctgtgggtcaagccctgatggagtttctgatgtctttctatttcctcgccaaggtactccccaacaagtcgactcttctccctccactaatgggtcttaggggaacccacttggatctgcgaaagccaatgagaggtggggagaaagctaatgtgtctttaaaatctccctggttcccaagatgttttttctctgtgtgtgtgctgtgctggcaggaacacaatcctctggccttactgtccatatgagaagctggccgggaaacatcccccttaacttagcaaacccttttggccatgtggaacctgatccatgttcctgagttgcttccatatgccccttgtctgatgccacccactgcctccacttccaatcctgctgctcagagctcggggtttcccaaggcttctgttggggacactcagctattttcttctctgatgcctccactggaatcgtaggctgctgtcgatcagatatgtcacaagttcagtctatgtgcttcgtgccttcctgaaatttctcaaagctctcatctgctgataggaaatttctttgcctctacatactgtgtttagtttttttggggtttttttgttgtttgtttgttgttttttttttacttaactgagctctgggcttttgcctgttccctcctcgttggccacttgtcccccagatcctcacatggctggcttcacttctcattcaagtctcactcagcactggtgtcccttcctcagaagggctttctgtgaccaccaatctagagtggccacctcatccctccagctgttctatatcacatcctcctcctggttccctttctaaatagaatgatttcagcgcctaggcctatctggcatacagcgggcaccgtgtgggctggagggaggatggatgaacaagtcattctttatttgatcgtttcattggtatttgggaaaggaggagaggcaaatgtgtgaacctaattcacaatgataaaatgaacttcctcttttgttcttgaaagtcagcaaagaagtatgtaatcatgtaggaaaatggggtcgcatggcctattggtttattccaacctattcagcactttttccccaaggaggtgctacctgccccctactactcatgccctggttctactcctgttgttctagcttcgactctgaacttcatgcctaatctaggatagctacagtgttctgtccacttacaggcagaatcaagtgttcagatacaagtgaaaacgaagccctgtttcttctcccaacagactactcctacccacttagttgctggcagtgatgttaggaaaaaacagggtggaatcagtgtcaacatcacactccagccaagggatggtttctgtccacaaaacgaaggctgaagatgaccaataaaataattgagtcactttctctcggtttcagtttaattcaatacatttgtatagtagtcaactatgtgctgtgttctgaacaagaagggctctcaagataacaaatgtagcaaggtaaataaaacatgctatcttaccatctggcaccagaactcctccttgcttggcaaaggacattaagccacttggggcagaaggtaaggccctaagggcagaagggttggcagagactgaaacaacaaagggagagggttgtgctgtcctgctgagaaaacgagacaaatgtattctctgttcctgagaggggagaactaagggcaggggaaagcaggggagggagagaagccagaggccaacaaaaactaagtctctgtgcaaggccagggaaatgcctagcattgaggtgaccagggacttttcaaaagcaggaatgtctagtatgtgcttttttaaatagtaggctgccaggaggtgcgatatgtacccatttttcaagaccctcaaattcctgtaaggcccccaccctcccaaacgcttcatgagaggaggggtttggtgggtgtgggtgaaggtttgtgggaaaggagagacagtgagaatgcaggactcccttaggaattcctgccaatctcaggtgggctttggacttcactgggctgggtgaaggggtccaggcaggctcgttatgatttccagggcccaggatgtcaccgacaatgtctaaattctgcaaggtggagaatatactgagtctgccgtggggaggttacagacagccaaatggaggatggccatagcagctgaatagaatcacggataagatgacataggatatacaataaatagcagaaaattgtgctttaattctttctccttctcagacaagctattcgatctggaagtccaaggataagaaagttatattcagaggggaaaaaaaggcaactgttttaaaggatgggcaaactacacctcaagtttatgcaacatagtgagctgtgatcgcaccactccactcccgcctgggtgacagaacaagacccctaaagaaaaagagtaaattctgagaagtaaagtttaattaaagaaaatagtgattgccagggcttctcattgaggagaagtcagtcaaaagttgccagatgacgtaattctttatgtcatctgaaaaccaccaggagagtgtcccagggatacgtatgtaaagtatttctggtggtgccactaactagatgctggagtctaatgaaacctggtgttgtcagcagaatgtggtttgtgatttgctctctccgcatgacttcagtttagctctccctctctgctgggtatcaggcacatgagcaaagagctacaaggaacctggcttgtccagcttggccgtaggcattcactcccagccaacctgacctgctgagaggcagagatcatccctgagctgcccatgcacagcgagtttgacagaactattaatccggaatattagtcaagctcctttcttatggtggtggatctccaaatatggccccattggtgccttccctctttacatcaagtaggacaccaagaccaaggccagatgaaaagagagggagcacctttttccctctctcaaactatttgagaaccagtaatccagaacccctgtggtggcttccaccttggtcatttgaaatatttgctcttgagacattccttcttggaatccatctgccatgcttggagaagcccaagccgttggagaggccatgtgcagacagtctggtcagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccctcaggttgttcttgaggtattaaataaaattatgattgtttctttagtagccttggctctgagatggggacattggattattttctttttaaggaattgccttatttcgtaatttttctaataacttgtcttagtctgttcaggctgctacagcaaaaatgccatatactatgtggcttaaaaacaatataaaaatttttttcacagttctggaggctgggaagttcaaggtcgagatgccacagattgggtgtctggtgagggcctccttcctggttcataaatgtctgggtcctcacatggcagaaaggcaagagagctctggggtgtccttttataaggacactaatcccactccacgtgacctaattacctcccaaaggcttcacctcccaaaaccatcacattaggggtcaggatttcaacatataaatttgaaggggaacacagacattcagtccacaacattctacctcaagatccccagaatttatgtcatcttgcatgcaaaatacattcattccatctcagtagtccccgaagtcttaacttgtcctggcatcaattctgaagtccaaagtcttatctgaatatcatctaaatcagatatgaatgagattaaagataccattcatcctgaggcaaattcttctccagctgtgaacttgtgaaaccaaacaagttatgtgcttccaaactacaatggtgggagaggtataggatagacattttcattcaaaaagagagagagagagagagagaaataggaaagaagaaatgggtaatgggttccaagtaagtccaaaatgcaacagggcagaaaacattaaaccttaaggctctaggaataattctctttggctcaatgctctgtcttttagacccactggggcagcagccccacctccatagctctcctgggctggagtcatacacccatggctttcctgggctgatgctctggtcttccaggcccatttgggtggcagcatcatccccacagcttggtgggatggccctacagcagctttctcctggggtccctattgctttcccaggctggggttcctcacctgcagctcttctgggcagcccagtccaccatggctctgctgggtgcagcccatattgcagctttctgtggggaccccatcccaagtcactgggcaggagcatcctgatctacctaaattgaagagacgagttgatcctttaaaactgttctgctctcctactacatgtcccttgaactctgggcctatggtgcaagtggcagccctgatgaactctgaattgcttttgagtaattcttccattgtcttgaagaatagttcctggattctgttaagatgactcatccatactaatatacttatcaaacagtcacttggccacactattagtggtctcattttttgcatatgaatagacaaagaatttttcagatcttcaggttctggtttctttttgtgcttaacaattctgtctttaagtcacgttttactataagtagtcaggaagagccaacctgcaccttcaacacattgcttagaaatttcctcagctaaatatttaatttcgttgcttgcaagttttacctttcacagaatactagaaccaaataaaattcagccaaattctttgccactttataacaaggatcaacttttctccagtttctggtgatatatgtctcatttatgtctaaaactcatcagaatggcctttaccatctatatttctaccagtattctgttcaggattatttaggtattatctaggaagattgaggctttctttatagctctcctctttactttctgagccctcgccagaatatcctttaaaggcctggttacagcagtttaggttcctctcccctcctctcccctcccctcctctccccttccctctcctttcctttcctttcctttcctttcaagatggagtctcactgtgtcacccaggctggagtgcagtgtcgggatctcagctcactgcaacctccgcctcctgggttcaagcaattctccttcctgagcctcctgagtagctgggaattacaggtgcccaccaccacgcccagctaattttttttttttttttttttttttttttgtatttttagtagagacggagttttgccatgttgtccaggctggtctcaaactcctgaccttgtgatccgcctgcattggcctcacaaagtgctgggattacaggcgtgagccactgcacccagccaatttaggcttttgctgacatatatctcaagacccttccagcttctattcattacactgtaagccacgttcacatttttagttgttcattacagcagcttcccactcacagtacgaacttctgtcttagtctgttaggactgctgttacaaaaatactatagactgtgtggcttataaacaacagaaatttatttctcacagttctggagctaggaagtccaagatcagagtgctggcaaattcaatatctggtaaggatctgctttctagttcatagatggctgtcttcctgctgtgtcttcacatgacagaagggaaagggagctctctctggtctcttatagagtactaatcccactcatgacctaatcacctcccaaatatcctgcctcctaatacgatcacattgtggatcaagatttcaatgtattaatttggagagggacacaaacatttagtccttaacataattcttaagtgttttgaagatagcttgtatattccccaagtcttagtttagatattgattgaggcaaatgtagtagaaggcaaggtaacagagtggaaaaaaagaataggctttggagacaggcagtcctgggatccaggtcctggctgccacctaccagctgtgtgaccttggacaatctgacctcttttgaactctggatgtttaaatacaatgtcagcctccctggcttatattaagatttaaatagggcactgtaaggaaagctccttacaccatgtgtagcactatgaagctcctgcagaaatgagcattgatatagacaattgcttcctttgaatctggctttcttgtcctcagtttggtaactttcctccatctctagctgggggatcagcagaaatgaaagacagacacccttggagagctttgctatgtgttggtttgggctgtccagtgggaggcaggaacttgataagaatgaagaggcacagaggacaaataagagttagaaaaaggcatccagctagcgattagaaaacactgtcaggataaggacacttcatccacatcactatacacatttctaaactgatttcattttagtgctgaacacttgccatgtgaaaagtcctatgctcattacaaagacacatgaaatatggtccctgacctcaaagagctaaaaaaaaatagctggaaagacaatggcataaactctcgaaaatccaaatgctgacataaaactctactagagaatatgtcccaaggaaatatcgctacacaatggatgtaaagagactgtgcttctgtggattgtttgcttgaatttggctgagggacagttattgtaccacttacctggagatggatgttgaaagatattttaatttgcagaattattttataaccataagagaccattcagtggtaacaacatgttcaagtcttttcttaaaccttgaagtggatgatattgggaatactcaagtgatacagaagagatatgtatagggaagatgtatctaggaagcttttaatagaacagactcccagtagtgaaatcgtactaggaaaataaggaagaaatgtggatcatccagttgtagtaatacaattgtgaataatggatagttgagggaagccaagtatacatggttacattgtatcgactaaaaattcatgtctttcccagaacctcagaatctgacttatttggaaatagagttgttgcagatgcagttagttaagatgaggtcgtacttgaatagggtgggcccctaatccaatatgactgatgactttataagaagagaaagcaggctgggcatagtggctcacgcctgtaatcccagcactttgggaggccgaggcaggtggatcacaaggtcaggagatcgagaccatcctggctaacacggtgaaaccctgtctctactaaaaaaaaaaaaaaaaaaaaaaaaaaaaaaaaaaattagctggccatggtggcgggtgcctgtagtcccagctactcaggaggctgaggcaggagaatggcgtgaacccaggaggcggagcctgcagtgagccgagatcaccccactgcactccagcctggacaacagagtgagactccatctcaaacaaaaagagaagagaaagcagagacacagacacttacagagcaaacaccatgtggagacacagaaacacaggaagagagagtgcagtgatgcatctgcaagctgaagaatgccaacatcagaagttaaggaaaagtcatggacctggttctcccctaaagctgtccaatagagcatggccctgtcaacaccttgattttggacttctaggctccagaactgtgagagaataaatttctgctgttttaagccacccagtttgttagtcctttgttatggcaatcctaagaagctaatacaccagggtatcctgtctctctagacccatttatttctgctgaactatgaccttgccattttccagatacccccaccttctgtcctaagcatccctctgattctacatctacagtgacaccccaagatttctggcccactccaaaaattgcccttctcccactcttgccaccaccaaggaatctggtggaatgaatgtggactcaccacttgggtaccagaaaggggtgacactggtggtgggtgtgcatccatgaggcagtcactacaaagtctgagtgaatttctacagctgctaatatgggcacagccctcattcgagtacagctgccactagtaccatccctggagagccctgaatcctcctctggtaaagagtaaatggttgggtccatccttggtcatagcatgaccttggcagaaagagacaatgtcctgcagtctctggggcttaaatttactgccagcctcaaccccaggggaattcttccacaaacagtatttttggttcccttgaaagttattgagtttgattaggtctgtggcttgcgtttgagagaatccaggatttgtcttcatgtcttgttgtgaaaggcctagcctggtactttggaagaggtgtttcatggagtctcccattgtttgacctgatggggttagtctaccaccatgaccctattggactatgctggaaatgcagagttgcaagccagaggctccctgacctccaggctcatgatctattggtcatcatcattgtaattagaagatactgctgttgctgattatgtgtgttggtgaagaagtagttgggtttggatgcggtatgtctagagctgcataccaatatagtagccactagccacatgtagctatttaaatttaaatttgaatcatttaaaattaaatgaattttaaaattcagttcatcagtcacactagccagttttcaacagcccaatagccacatggggctagtggctgccatattggagagcacggttatgggatattttcatcattgcaggaaattacactggacagcgccagtctacagttatttgctttcccaagctttccacgcacacaagctcctttttttttttttttttttttttttttttttactaagtggaattttccaagtattgagaatatgtcagctccataataagaggaaacatgatttaatctcttactgtctgttggaaataataaaatatatgcatctattttttaaaagaggaaaaatgagtattgctagaccaatgtttcccaatttgtaatgtggacataaatcacctagggttcttgttgaactgtaggttctgatttagcaggtgcaggtggggcctatggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaagattgggtccatgaagcatcctgggttatagtactagtgaaaaaattagagtcaaaagttgagtccataattgataggaatggtccagggagtttaatcaatggcatggtagacagcagccatttgaagggcatgccggcaaccatcacttaacatgcctccttaaagaaactgttcatcattggttactgttggtgtaccaaagtctgcatttggaatttgtgcagcttttgtagaatctgccccttaaatatgagatgtttccctttggtgagtgactgcaaaacagacttgagtcactgaagagaatatgacacgagcttttctctggtattgatcttctttaaaccttcttccttcaccccaaagcaaagagcccagccaacagcgagtaaaaagatggggcttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagtaactggtgatgtaactgtagcagctacgtaacagtagcagctaataaaaacatgcttttttcttttagaatgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaaagggggtgaattgaaaggaaaagtctccttggttatgaaaaatttgggaacttgtttatttagacttttatggtattagatgaagaatcagaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaactcagagcatgtgctgcgggcaaaggactgcccctccaaagttaatgtgcaacatccatgcacttatttgaagttgagaccatcggtcccatacgtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaatcaaagctgaagtagttaaatcataagctggactttgaagaatacacaggataatagtagacgaagaagcaggagagagaatattccaagctggaggaccaaatgaggaaagaggtggccgtgggactctcccactccataaggtcctgagaggacacgtagatgccgactagctgtatggagcgtgctgttctaggcatccacgtgtctgttataaaccagacaaggttgagtatcttattttgggttattatacaagagcctttccttgtgctgaagcatgattccaaacacatctcagagcttcatttcaatgcctaatgaagcatttgtaacagaaggcttgacttctaatactcttcactagggtggtgctcagactagcctccctgtataggaaggaaggctctctgtggccagcttgatggacccaggtggcctctctgtgtagccagctcagtcccagtttccaccccctccatggtccctatgagccacccctgggagtccttctcatcttcccttcttacctgttccccttgggtctccaagatggagcggtatagaggccccctttacctaactacctctaagcccgtaagtagcctcaggaccctctgctgcctgcactcttgcagagagcttgaagaatgacccagagtttggtcattgtgagggtcccaggagcatccactggctcagctgccaccttgcctggtcagagcattcattctagaaagtcccgagtgtagccagaaccacatatcagttcagactagtttcacaaattatgcatcacacttaaagcccagagtgcaccaaggagtgtgtccctggcaggtgttcagtgcttcttcctgccatcacctcctgcgcctctgccagctcctttccccatgccaggagggctacatttaatcttgggtgaaagcatgcatgtgagcatgtgttcatgtgccagagcctaagccacacccccagaatgcagaaatccagacttcagagggtcacccctgctccatgacaggaaaggaaatagaatagcagggaggaaaaggatagccaagagcctctaaaatcctctctggatgcccaaattccatttttatgatattcagcataactggatacatggtgggtgagagagaagctcagtcgtaaatcacataactgtaggactcttcagtcacccatcacagggcagccttttccccgttccattgcgttcatcccttcagctgcagatatcatcttagcaccaaccgtggcacagggctggcggatttagagctgactgagtaaatatcagggtggccaggcatggctatacagatgcacctccactgtggctcatgccatggaggcccctgggagttgtgcaatatggcacaacttgaggatcctgccaacctgtcatgttggccgtgctggagtcgtcccttctccgcaggattggtgaggggcccaggccactggcattggagcatggcaggaaaaagcctgaccagaactcacctgggtaaattacaaagtgcttctccacttcctctgtcctcctgtgctccctctcatctctccagtgaaagggctgcttagatcataacattcttgcacaacccacggggtgccagttaagtagccaagtggctgaatttctatcagagcttcagaatgcggaatggaggagccccaaagtgtcaccctggatcctttaaggaacaatttctatgatgatgtaatagaagttgacatcccctttgatcagtgtcttctgggtgggtctgtgagatgagggtgggggcatcatctctgtggactgggtggggtatgaccagcagcgcattttgctgaagctgtgagctctctgtggcagggtctacctctttttctccttttctgacccacctgagctgggtgcaggctccctttgcaccgagtggacccacagacagctgtttgttgagtgccttgggaatgctcatggcttctgtccacaaggcaggggcctcacagctctgatgcagggagctccgctcagtttcttggcctcatccttcttcctgctttgtgcattttcccagaataatgacagtcactccttcccatctttgctccctctcccacatctcccctacacaaatctttgtcctccctggcttgacaccctctgctgcacagcagagaatgagttaaaaatcaaaacccacagcaaagagtgtcccccgtacattttttgtgagctgtaacatctcctgagagaaggtagttgttcttctaacctgcagattgatgatccgagttccacacagtgtcggctgaagggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagaggtgactcccacgacaccacaaccatctgcagtgtttcagtcactgcccagtgaacagaactcagcttcagtggtgctgggggtggttactaacgtaggcaccccggaattttagccccaccgggaactaaaccaagtttaagctctgctgcctacgtctctggttgaccagcagagggcatagaaacactttcttctctcctggagtttgctttttctctgggagcgaaccaaaagctgtattttctaacccatgaaaattctagtttatgaaaagatatgtaaactggtgactgagggcctgcccagacctcctggtaggatggagaatgatcaagggccaaatggtttgtcttacccagccagccttgagaaaatcctcttccttgaaagcctctagggagaaaggaggctcccactggggcagcccctggatggtcctccagccctgttctccactgcttcgccccagtggtatctgagcccaggctgcctcgctccaaaagctagtttccccgccagcatttctaagtcatgaacacggatcaaatgcccgcacaggggctgcctccctactgcagctatgacaattggcagagaccaggggcaggtcaggacaggtggtctcccagatattagtccttgtggcctgccagtcacaacggcccttctgctgcaagccatggaggctcagtgcaggatggatggatttgatgcagctgctggcatttcactccctgccgctgcccttggggaggagcggtacctgcaggttttttataagagcagaagcttccaaagcttcaaggggcttcccatgggcagcagatgtgcagagaggagctgctgtggctctctgcagcggggaatgtggcctgggctctgagttcccagctcaggcctgtggggctcgaagatggccaacactaaccaaagcctgttctgaatttcaaattgacacaaaggttcctcaaaaccagtgatggtaaacacatacgggatgtcaggatgctgctgtgacagcagttttgctgttgcctgagagagacaaggcaggtcaactccaaggcagacagaaggccagggagagtccccagtgtgtgcagggagagaaaactgctgtctagggaatgttaccccataccttccccctctcccttcttgccctttccccctccttccctccctttctctcccctccccttcctcttcctccagcatgcctgttgttttcacttgtacttaaaaaaattcttggttttatgtgacaaagaaaacctttttatttttacataaaagtttattaaatttgattccgcggcctggtgcaatggctcacgcctgtcatcccagcactttgggaggccaaggcgggcggatcacttgaggccaggagttcaagaccagcctggccaacatggtgaaaccccatctctgctaaaaatgcaaaaattagctgagcatggtgacatgcccctgtaattccagctactcaggaggctgaggcaggagaatagcttgaacctgagaggcggaggttgcagtgagccgagatgtagccactgcactccagtttgggtgacagatcatgaccctgtctcaaaaaaattgattatgaaatttgtatttccatcagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagcagctcctcctcagtgctgacagaggtgacagaaagtgacctcccatgtggcattgattgagggggcaggaaatcacccaggtgtcatccatttgtgtgagaagttgcaggggcccagggggcgtgggaagacgctgacccagaaggttgcttccagccagggattcagcccagacggcctccctctgtgaacctggttctcctgtctgcctagcatggggctgaggaagcctcactgacttcgtctctggacatttgaccccttctgggccttggaaaagccaacactggcttcttcctatagagccaggttccccgcatctttcacctactggtcagacatggccttccaggcagagaaagccttgtaggtactctcaccagcagatggccattttcacttggcaagcctcccggccacttccttcttttcacagcagacctgagagagtggacagagagccctacagaacctagggcaggcctgggagatggaggagacccatgccccagctcaagagtcaagggcccacctgaacaatgaggtaggggaacagctcctttcaagcccttccttccccaccctctctggactctggataaagaaacacgactgctttcctctcacccagaagccagaaggacctgagcacccaggacttgtggctgtcagagagctgtggaagggcaggggacaccagatggcagcagcaagagctgggcggcagcatctgcccaggccacctgcggagagaaggctggaatccgagggatcacactgggccagcattgagcctgtggccaccacactgacccctcctcagctccccctcacaggacctgaaagcatttctgagttaagtctgcataggaagttttccagagccatgccacatatccctccatccactcagtgcccattttacagatgaagagagaggcacccagaaaggtacaccaaggcaagatatggcgtagacaggatgagggcagagccagcttcctgatctgatggaagtcatgaagccttctctgccttacgcttggctctgcagggtcgctgagaggttcctttaaggagatcatcagaatcctaaatggcaaaaaatggcaaatcaggggaagagttggagcccagcatttggggacacacacacacacacacagtcgtcttgccttgcagaaattgggttgcattactccagtctgccactgagtggcacctttgggccatgcacttggctccaaagacatttctctgaacagcaacagaaaaacatgtttaaccctaaaaaaaaaaaaaaaagaaacaagtacatcttactttggatgaaatttgatgacagattgaatgcactgtctgcactttccaccacgtcatgtttcagcttcgcttgtccctccctttctgttgactagactacctgtgattcccgctgctctcggaaccagcacaggacctactctcttactcactgatgggggagctggcctgtccatgcacagggcaaaggatatgacacccagacctggatcctgctgcaaggctgccttgggaaccatccttaagacccggtagctgttgtccaagctttggctctggctgctgctgctctcagcagaaaagagctcactgctcccatgcggatgctgagggattaaacagaggcaaatacggaagtgagcagatttttctctcttgctctcagcagaaggagaaccattctgcagagaagttttcaacatatgcctcttcagcattgctccagatgcgtccgtcttcactctgaaacccatatattgagcacctactatttgccaagcaccgtgctgagcactgatgtgaattggctcagtttctccatctataataggaatggctggttcattcttacacagatagtctttatgattccaggacactgcctgcttctgggatctctcctccattttgatgccatcacttgatcccaactagatttgacaaagggtctcacactgtctgcatggtggcatgtatgtagcactggggttctcaaccaggaatgagttcatctcccaggggacattgggcaatgtttggaaacatttttagttgtcataacttgggaaggggggttgctattggcatctagtgggtagaggccaaggttgctgctaaacatcctacatttcacagaatagcctcaacaacaaagaattatccagcctgaagtggcaatagtgctgaggttgagaaaccttcatgtagaaggagagaaatcccgttctgataacgagaagcacattgatcttttaatatgcaattcttttctgttctgcaccataggaacacctttgatgttttcacaatctccatggtctttgcagctcatgtagtggcatcagggcaggctgagagatgcagcagaatgggtttcatgggacatcagctctggggccatctcaggcaacatcccgatgctgagccccctggaactgactgtgtttctgctcccacttcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggtttgcttatctactcaagtggttgtcataaggtgttcatttgtccccttcattgcctgacctattaacacaagttcaaggcattgtgggtagttaaaatttcagatttggttatttttaagttcatcagtggaaaccatttcagataggcgcacagcaaaatcccaggatcgttttcctagatgggttatgtattacatagaaaccaaaatgtgcagttatatgctttatttgttccaggaaagcctcaaagtgttttacaaaatctgaaggcttgtaataagtcagtgatagaatctggaaaccagaacacagcattggggaagtgggtgtagtgagttagcagggccatgagtcaaacccacatctgtctacctctgaagcccacactgataaccacctctctacactgcttccgcagtgatctccagctctgcagtgaatattttttaagcacatctatattccaggctctgcgctatgtgataagataccacaaagaacaggcaaaacccctgttctcaccgaggttgagtgggagacagacaagtaaatgggcaacttcaacagtgtgaaaagtgccccaaatgggtgaaccctaggttaaagcaagcctgcaggagggactcccaaccctgtaggacacaattaagatgctcacagatgctagtgatgctggctaaagaaacaggaaccaccctaaccagcagactaaattttgacggctgggaggtgccatttctaaaaataagcattgggttggtttcttacttcctggcccctaatttctatttcctgtcaccatcccacacccagtgacagggcttaagattttgcttatctccttgaccccacttacttctctcacctctggggcccccagtagagaatttgggtggtttgccccttgcagacattattatctgatttaggaaactcagtgtagctgcaccaatgcaaataatggcatgagaacagtgtcccttatcatccagaattaccttgtcatttgctcagaacttcaagatggaaacacctaccaacctcaacaccataactatctacttctctccccctggtcacgagctccatcaaatgcctgtgccaatcacgaaatcatgactccttcatataccccttgcagcttcaaagcagaatgtttgagtcatgagagctctttgctgagatatttttgcttatgtgtatgtacgtatgctttcaagcaccatattgacatggccagagaggagagtgacaggggagttccgtgggggttccctgcatgaacaagctgaagctcaaactccaatatttatgaaacacaagaagagggatactggtcaaaaccttgatgcatctagcacagtattaacactccaagcatgacatcaggagggatttattttaattttttattatgaaaacttttaacacttggaaaagtggaaacagcaaaacagcaaacatttatagaccctcatccagcctcaaaaatcatcagtacacgtctgatcttgctttatctctagccccatctactttttcacctgccaccaggttactttacaacaaatccaagatgttgcatcatttcatctgtaaacttagatatgtatctctaaaaaaaagatccttttgttttaatattgccacaatatcctttatctccctcccttcctcacatccccttgcaatttatttgatgaaggatttagatcctttgtcctgtaaagagttccaagctctggatttttctgattgcagccctgtggtgctatttagcatgttcttctatcatctctctttcctataaattcgttttataagatatttaatcagatttaggtttgatttttatggacaaaaccacttcatggattgtgtggtgctctcctatcagaaggcacatgtctagccacctctctttttgacctttttgcagatattgatgtctatcgcttatatccattagttaattagaggttacaaaacaacaacgtactaattttattctttcttcacttattagctggaatactttcataaagagaaacttccctccaccactatggtattaactagcagtacaattcacataagaaaagcaggataaatatttgattctctcccttcatttgccagttttcaaaatgagtggtttgctattatcttcctatggtaaacattagggtctattttggttttactatctttgtaaactcatgagtttaaacatatatgctatgttttaatccattttgctgattacttttattgatgcttggattgggccatctctggccagttggctctttctgacacagccctaagagtgatctttgacatcatccaaatagcagggaagctaagatattccagtctttgcccttacccagaataagctgtttctccaaggatccctgattcctcttagtgagaaatggtatttagagactaaaatctaggcacttagagtgtttcattgttcctggattgtttatcatttccagcccttttcagtcgacagagctaggaaatgtgttgctgtttataataaaaatacatcctgagttcatactgatacttttaattcaaattctgacctacaggggattttatttaaccgcttgtttcttacacctgtgcctcttttctctatgctgacaatcctgactttcaagggcactggatgatagcataattactcatttgctttatactacacagagcagtctctaaaccacaatgctaaaaatacagcaacagtatgattatcgcctggttctttaattgttgcatagtattccgttgtgtggaggcaccatagtttagtcaaccagtcctctcttcttggacatttatgttgtctctacttcaagaaagttttgatggaagaagtggggaagtcagcctaacgaaggttacatattgacaagtatctcaatatccaacctacagtgctctaccattttccaagtacttctaaatacattctatctaatttctacagcaatctagactagacatgaggatgtcttaagcatccccatcttcttcattatctgctaggattagtctcccatgaattcaaataaaacactcttcctaagccaatccctattttcagaccaatttcctattgcttctgaagtgtatttccaccataaatatacaaagtgttcctttctagcagagtgaccttggacaagttgcttaaattccctgagtcttcctttcctcatctgtagaacagggatacaatggagcctacacataggggtggaatggggaccaggtgaaaggaagcatgtcaaccactaacgatgtctggcccacaataagacagagtaaatactaccatcttatttttctaatgtcactaatattctctttttaagccgtagtgtttaatgtatttggtaaaaatttttaaataatttcacataaccttagcacccagagataacccctattttggtgtattttcttccttgatttatgtgtgtagctacgtgtaaggtctgctcaggctgctaccacaaaatagcacacactgggtggcttaaactacagaaatttatcacagttctcgagactgacaaatccaaaattaaggtgtcagcagatttggttgctggtgagggctcacttcctggcttgcaggtggccgccttcttgctgtgtccttataactctggtctctcttcctcttcttataagaacactaatcccgtcataagggcctctctcatgacctcatttgaacctaattacctctcaaaagacccacctccaagtaccaccacactgaggatcagggcttcaacaatatgaaatttagggagacacaacattcattccacaacagggcgattttgcaaatagcgtgatcctgtaacctgccttttacctaaaacaggggtcagttaaaaaactatacttttcctaaaaagagccagatagtagacattgcaggctttgtgagtcatgtggtctatgtcacaactattcgattctgcatacaaaagcagctacaatgcaacaacatagcaatgtaaacaacataaatgaggacctatggctgtgtttatttatgaacagtgaaatccaatttcatataatttttcacaaaatacaattcttcttttagtttttttcagccacttaaaaacataaaaactgttcttcgctcatgggatgtaaagatctagatcacaggtctgtatctgtagatttgaatcacagactgtagtttgtgaccctgtgctaaataaaatctagcacatggtcatgaaaattattgaaatgcttcaagaaatccagaaagctacaggatagaggattgggcataaaggatcttcagtttttgggggagagtaagttagaggagacttggttttgacgcagccatggcaacacagcaatctgaattgtgaatgtttctacatgaggattgagtgttgcggagcagaggtcagcaggtgccaagagactcacactgccttaccttcctggacagcactggctgcctgccccagcaaagtaggtgcagttcagaagttcccaggtataaaaaggaggttaaaatcctcagcagcccatgaccagccaggacttgcactcagatgtcctcgcttgctggccaagattctgctcagaccacactgtccctggattgttagtgctgagggcttggtggtcgcactgagacctggagaagttctagtccctagagaaaggccaagagtctgggagttccttctagaattatccatttaagttctttaaactttctcttctcggtttgcctctctgttaaatggggatgttaacacctcagcccatggggctcaggggctctgggtggcttcctcagctggtcatgatggttctcataaaccccctgcagtggtcatatgctttaatattagtgctcagtagcctgagagaaagtacagccagatttatggattcactggaagcagggactgggggtggggtgcagcctctctccaatgggttttgtttcttatttgaccacacgcattgttagagccaagttaattgcctgtatttgcttcctgtggaaatatttcacaagacaccctgttatcgtgggcccagcatttgtacttgtgttttgctgatccgtttagcttttttgaaaattttgggccaagaccaaatcttccataaaggtctgtgggctgtgaccatagtcctcagctgtttgctgtgttgttccaatttcatagatttagccttgtgaggggagaaaaatatataggccatgattatttttttttaaggactcagttctttatgctatggatttaattctctgttcccaaccatgtggccttaaaggacctgcattgtcacctgcttgctatgtggtctgaggcaagggccttgaccttttgtgccttagtttcctcatctgggtgatgggggtgatgtcttctttacagcccgctaaggatttcagagaaatcagatgagctaatagccctgaaaaatctttgaaaaagtaaaaagtgctatatatttgtaagtgtgaactcacaaaaattaatgactttagtactctctggggtttcgtaattctaagctggatccaaaagaaattctctcaaaatatctgcccttagatgggaaaaaatgccagaaaaggatgtaagaactgaattttcaggtcctggaatgcatcctaaggaatttgagcttctcatcctgaagacagtagcaaagcattgcaggcttttacctggaagatggtgaatcccatggtgatgggcatagtaggctggagccaagagagagttctgaaccctggggcatgtcatataaagctctgctggcagttgttggtggagagaattaaaccacaggaagtattgagaaccttcagcttccttgtagggcatttgtctctttccaaagccttcacaggctctagatgagatagaaatcaaatgccagcacagtggctgcctggcttccattttaaatctcagagtaccaaggatgttccaaggactatctccctggatccattcaatcatttgtccatctgcccatacacccatgtcatgaacatccattctcccattcaagttgggaaaccttgacccgtgcggcataatattctgtgcagagggaaataacatgagaaataggaggcccagatggctttttttttgccatcaggcagagcttatctaaaagcacatcattttcaaacaaaacaaaccagacctaagaaagcacttcattgagataggattggattggaaatctgtcctttaagtggactgatagtggaataggacaagccagtccagccccattggctttgatccttgcagtttcccacctcaccttcctactcgtcccagccccactgctttcctgacctgtggtacctgctaagatgccccaccctgccctgtacctggagtgtctgggccttccagacctctggatttgaaagttatttcatgggagcagaaatttggtcttctttaccttttataagttcctgcatcacaaaggtaatgctgaatgctgaatgtcagctaaatgctgataattcattccagaattataacattttcagctgtgcctatcaaagaagcgggggacaatttgtcccttagctttcaactttggagagacaaccttggggagtacacctagtagatagtcaagaaaagcaggttaaattaaattcctacaatgtgccgattcagcaaaacttggaatacccactaagtgtcagatgttctaggcgctgtgaatatacaaatgcgtagggaggttcctttccttaagcggccctgggtctgacttaccacagctctgcttggccttgatgaactcacaaaaggatcaaagagcatgctcaaggccagaatgaggtctgcgtgataaaagagctgagaaagataccgtcaagtccacatccgccatgagcagacaagaagcctctagcaaaacgtttatattattacctaagtgtagatgtttaaatgcaacttgattaaggaatgcaaggtttctaccatttgctttgtttaaaagccaaagcccagtagagtatgattttaggtttgcccagattattcagaagtagaagtcttcccagctgttcatctttgctccagtggtggaggtggcggcattgcgtgccagtatcacaagaccacaccaagtttcctggtattaatcctctattggaaggcatttcctggtagactctcatgccagacatattttaataaggaattctgtgacactgcttgctctgggggttgctcattttatcctgtaggtggttttatttttgggagatgaacagcagagggagggatgcattttgcagagaataaatcagtcatttgtgatccagttctgtttattaccacacagactagtagttcctgacagctactgagagaagacgtcaaagagttcaattccaaaatttcttggttgctacatctaagcatagattccttataccaaaccccatgacctccttgaggaggaaatgaaaatacttttcttcttttttttttttttgagaaggaatcttgctctgtcacccaggctggtgtgtggtggcacaatctcggctcactgcaagctctgcctcctgggttcacgccattctcttgcctcagcctcctgagtagctgggactacaggtacctgccaccacgcccagctaattttttgtttttttttagtagagtcggggtttcaccatattagccaggatggtctcgatctcctgacctcatgatctgcccgccttggcctcccagagtgctgggattacaggcatgagccactgcgcctggccaggaaaacacttttctaagttaacatccctggtatttgggtaggtgaaagacaatatgcaaagctgtctttgaagctacacttttctaagagtagggattgaacagcatgaaaatactgtgccctttggccagttaaattaaatctgtttttatagatgctttgcagagtaaaggcaaaggatcatttactctcacatcctcttatgacctggaatgatgccttatgtggaaacacagggctcccatgtcctacttaggaggctaaggaaatccaaagggggcacttcccattttagatccacatgatcccaggttgttcatccaaagatacatccagaaggagcaacagcttcctatctttcacttatgtggatgtccatattgttgcggtatcttttctgttgcctcttctatgtttgttaagcagatactgatttgtgatccacttcaagtcctcaccactgtgctgtcctgcaagaaccgtgctgaagaaaagctcattttccctaggcttcagctaaccatgcctaaggtctgaggacctttggtcaaacatattcaagtctcttgaaaggtgagactcaaggatacagacttatgacttcctaagggcccatcagccctcaacgctttaccaggttgggaccttgtttccaaagatgttcatagctcccttcaagtatagatggcaagttgtgcatggactgcctgttaagtgagaaaccagagcctgggccatccctggtgtcttggccattaccattgctaacagcagtgatagtgaatagtacccaaaagggaattgtaagcagtggccacaccttctactaggatgactcagatttaggactcaagaggaggctcctaactttcctgcaaccacacatggagggattttgtctcagccaaccagtactgactccccttgggacccaagtaaaggacaatgaaaagcagcacttcaatgtgagaagagcgtgagctttggggtcacagagctctgggttcaaatcctggttccatacttaccttgggtaagccacttgacctgttagagtttcagtatcctcatttgtaaaatgggggtgtttaaacctaagcactacttcagagcaaacatcaccaacaactgaaatagtacagctagactctgctcccaaatcctctttgcttctttctccagaatctctctcatcccacaaatcatcccttgcaaggacagtcacagcatgaaattattattgccacttgacatgtataatcatttttgtagtgcttccacttctacttccacatttaattgtgtgattgacaggactagaaaggtgagcttttggctcccagtccagttccttgtccatcaccccacacagcaacaccacattctgtccacacagcctcattttccttcaagagactacatgggacccaaaagctcccaaagtctggatgtgattctaggcagcttaggtatggagggcagagatgaggcacacacacctacaaaaagaaaaataggatacttgaaaatcacaagaagagctcttggccgctgtgcaatgctccagctgggtggttctccactccaggaggacgttctgaagctgggaaatgagatctgtgctgtcttaggagcccacagcacaggggaggacataagggtcttcttgaggagttcagctgcatgcttgtggcccagggccccagtcatttgtctgattagcttccccacctcttgagagagtcactgtgttttgtctaaaaagaaaggagatttccaaatgaggactctctgagcaaaatattgattttcagcaggtgtggttttgagacagtttgtactgcatgctctctccagctctcactgtgcctcggactctattgattctagttggttttgatcctgccttagcattccaggaaagcagagctctcctagcccaagaagagaaaatgaaggtggagtggctcatcggggtaacatccctccactacagccatcaaccactccagggatatgatgcctcccactgctgaggactctggctaagacactggtgtgatttagagccctagagcattggtttatcatcatatagagaaccaccctcatcttctttggaggaggtgcctctccactgcatcccaaggtgggagtgacctctggtagttctgcttgttcatagtcagcttagtcatctctgttgtagaaagagaaagagagagagggcaagaaagggaaagacggagggagagaggaaggaagtgggaaaggagggaagaagataaggcaagacaaaataagacaaagcaagaaagagagagagcacgcgggccagcacgctttttctccatccccttaggaatttactctcagcaggggcttggcttggctggttttgccagtgactcccttgcactttgcagattctgaatatacatttcccttaagactggttgtctgcagaataggggaaacaaaccagcacccccataaatcagcagaggtcactgccaagagctttgtacacttgctgtccctggcagtgataaactcattgcatttgggaaatggccaaagaccctgagtccaatcttaattctcattcccagaaaaatctcagttttctgttcacccacccccgtttactgtctttgtgtttcctagacaaagctggcaaggaggaaagaacacagttcaataactggatcatcaaaggctgcatttcgttgcttgggggaggagttgcagggcaggaaagagtcacagatccctaggctgtggaaaagagaggcccaggccagagggaggctgaagccatggggtctgcatggggtgtgagagatccgcagaggttctcagattctggttttctcagacccgcaccttggatctgctattactgctgtggtcggttgttcccttgaagggtggttcaggctgttataatggtggtcaagggctagcagtgggattggtgtggtgagaccacctcatgggactcatgctccagtaggttgtgttcttattctcttatctttctccccacaccatcctcaccttggtatctggctttggagttggccatatgacatggagaagatgagagtggtgtccaaactgctcctctgacccacatgggcctcctgagagtggacaacctctctctgctgccctttcctccttgccccttgattgtctttctcctctgattgatcagactgtgaagctgcaagaccagacccccccctccctgcaatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctggcacctagtaaatgctcaataactatttgctgaatattattttgattcagtgtttagacatctgctttatcctgctctattttgattgacaagttctttctcttcatgaaccaggcttttccctcctacaatgagtctataagaattagctagatcagaggggaatttggtgctgagccagaagagctgtctaggggaggtttcctcacttcttatggggcagcagaggggtattgtgagatattgagaagtcagaacaagaagcagggaactgttgctttggagaagggtctggagaggttccaggcactatgataggcttttccagatgactcaggagccacctggctctgtcagccagaaagaagtgatgcctgacacaaggagacagtgtgtcatttttactgtggactaacatttgtacctaagctttaaatgttaaaataatttggctgggtgtggtggctcatggctgtaatcccagcactttgggaggccgaggcgggtgaatcacttgaggccaggggtttgagaccagcctggccaacatggtgaaacaccgtctctactaaaaaatatataaaaattagccaggcgtggtggtgcatgcttgtaatcccagctacttgggaggctgaggcaggaggattgcttgaacccgtgaggtggaggttgcagtgagccaagatcacaccactgcactccagcctgggcaacagagcgaagactccatctcaaaaagaaaatgttagaacaatttaaagagacaacaaatgaaaccaaagaccaatgatacccctcagcctgggctctgagaccattagggatggctgagccaagattttcatgctcctctgagctgagtgtaatcctcattctccttctgtgcagagagcaggaacttgatgcagtcataaacccaagcaagtatggagccagtaaacttgctgaacattaaattccaaccggcatttcagtgaacatgtatattcgactaatatctgagcctgtgctagacagtatgcatctgtaaaaataaacacatactgttcctcaaggcacttaaacaagagtgagctggatttttgtctgaaattttcagaaaaacacttagtgaagtgtgttcacactaagtttgttaaatcagaatacgtctggactatccaagtagtctcagaaccaggccactattggaggctgggcgcggtggctcacgcctgtaatcccagcactttgggaggctgaaacaggtggatcacttgaggccaggagttcgagaccagcctggccaacatggggaaaccccgtatccactaaaaataaaaaaatcagctgggtgtggtggtgcatgcctgtagtcccagctactcatgaggctgaggcacgagaatcacttggaacccgggaggcagaagttgcagtgaactgaggtcacaccactgcactgcagcctgagtgacagcaagactttatctcaaaaaaaaaaaaaaaaaaaaaagaaccaagtcagtatttaatttcatttgagtccttccagtgggtttattcccattagtggggtaactcccctgcttttgtaaatatgagggtatctcaggaagaataagtcccaaaacaagattctttgggttccaaccaaagatgaaaccaagagggcctcacatgtgaccaagacattttctgctttctactttcactttctttttgtttattttttaaattgagatgtaaaagttgtatgtatttatggtatatagcatgcaattttgatatatgtatacattgtggaatggataaatcaagccatttaacatatgcgtggtctcatacacttattgtttgtagtgagaacacttaaaatctactctcagcaattttcaagtatataatatattgtttttaactgcagtctgtagtcaccgtaatgttcaagagacctcttcaacttattcttcctctctaattatgtggtgtcctttgaccaatgtcttcccagtccttctcactccccacagcccctggtagaatggccattctgctctctgcttctgtgagtgtgattgtcttagattccatatacaggcacatctcgttttattgcacttccctgtattatgccttatagattctgtgttttttacaaattgaaggtttgtggcaaccctgcatcaaacaagtctatcagcaccatttttccaatagcatgtgcttactttgtgtctgtgtcacagtttggtaattcttgcaacattaagcttttttagtatgattatatgtttatggtgatctgtgattggtgatctttgatgttactattgtaattgctctgggggtgcccaactgcacccgtataagacaatgaacttaatacatgttgtgtgtgtgtgttttctgactcctctaccaaatcagccattcccccatctctttccctctccttgggcctctctactccctgaaatgacaactatattgaaattgggccaattaataactctgcagtggtctctaagtgttcaggcaaaaggaacagtcgcatgtctctaactttaaatcaaaaactggaaatgattaagcttagtgaggaaggcatgttgaaagccaagataggctgaaagctaggcctcttatgccaaacagcctaggtgtgaatacaaagaaaagtttattgaagattgaacatgctactccagtgaacacacaaaagataagaaagcaaaacaaccttattgctgatatggagacagttttagtggtctgaatagaagatcaaatcagacacaacattcccttaagccaaagcctaatccagagcaaggacctaccttgcttcaattctatgaaggctgaaagaggtgaggaagctgcagaagaaaagtttgaagctaacagaggttggttcatgtggtttacaaaaagaaaccaagtccataacataaaagggcaaagtgaaacagcaagtgctgatatagaagctgcagcaagttatccagaagatctagctaagatcattgatgaaggtggctacagtaaacaacagatttgcagtgtagattaagcagccttatattggaagaagataaatctagggttttcatagctagagaagagaagtccatgcctggcttcaaagcttcaaaggacaggctgactctcttgctagggctaatgcagctggtgactataagtcgatgccaatgctcatttactattctgaaaatcctagggccttcaagaatgatgctaaatatattctgcctgtgttctataaatggaccaacaaagtctggatggcagcacatctgtttgcggcatggtttactgaatactttaaggccactgttgagacctactgttgaggaaaaaaataatatttctttccaaatattgctgttcattgacaatgcaccaagccatccaagagctctgatggagatgtacaaggagattaatgttgttttcatgactgctaacacaacatccgttctgtagcctatggatcaagaagtaatttcaacttttcaagtcctattatttaagaaatacatttcataaagctatagctgtcacagacagtgattcctctgatggatttgggcaaagtaaatcaaaacccttctagaaaggagtcacccttctggtggatgccattaagaacatttgtgtttcgtggaaagaagtaaaaatatcaacattaatgggagtttggaagaagttgattccagccctcatggatgactttgagaagttcaagatcctagtgaagaaagtaactgcagatgtggtggaaatagcaagagaactagaattagaaatagagcttgaagatgtgactgaattgctacaacttcataataaaactttaatgaatgaggagttgcttcctatggaagagtaaagaaagtggtttcttgagatggaatctactcctaatgaagatgttgcaaacattgttgagatgacacaaagaatttagaatattacatcaacttagttgataaagcagcagcaggatttgacgggattgactgcaattttgaaagaagttctactgtaggtaaaatgctatcaaacaccatcacatgctacagagaaatctgttgcgaaaggaagagtcaattgatgcgacaaacttcattgtcttattttaagaaattgccacagtcacctcggccttcggcaatcaccaccctaatcagtcagtatccaacaatgtcaagacaagaccctcccccagcaaaaggattatgactcaccaaaggctcagatgatccttagcattttaacaataaagtattttttaattaaggtatgtaccttgttttttcagacataatgttattgcacacatcattgactacatatagtgtaaacataacttttatgtgtactgggaaacgaaatatttcttatgacttgctttattgtggtggcctggaaccaaacccacaatacctccaaggtctccttacataagtgaagacaagtggtattttgtctttctgtacctgacttatttcacttaacctaatgttctccaggtttgttcatgttatcacaaatgacaggatttccttctttgttaagaccaaatagtattccattatgcctatatactgcatttcctttacccatttatctattcattgatggactcataggttgactccatatcttggctactgtgctctccctttcttttgtgctgggtaaggagtgagtcttggtgaatccttgtcattgctctgtctttttctggccaggcatctctaaaatgtgtcccccagctgatgggaggtctgtgcctcctccttcgatcccttccctggaaagagcaccaaggaagaggtccttaatgaccagtcctgcctctcagatgagcactctcctcctccctgaccagctctccatccccctcaccactagggcctttgtctggcttcatgagaagaacaatgagcatacatgggggaagatgcttcctccaccaggacagccattaactaacaagcccgccctccccagtgaaggccaacctccctcctaacacattctctcttggaacagccaagctttcctgtgcagctgagctgaattccacttcaatggataaataatcttgcccactgacaagtcctcttttctaagggaccaggattttccaacccttgatgaggacagatctgtttggaagggaccacaagattctaggaattagctggaaatcaggggtgaaattatttgccaaggccagaatgtataacaaatgcccctgggagccgaggaaaagaggcggcaccttgctgcagcacctgcccctcctgggtgttagttacatgtcctgtgatgtggttgccaagaactccttccaggacgaggtggtggccctgaaatgcacaaactgacccaattgcattattgcctgtttttttaaattaaactttttattttgagatacgtattgattctgatgcagttataagaaatactgtgctgtttacccagtttgccccaatggcaacatcttgcaaaactatagtaccatatcacagccatgatactgacatggctacaatcccctgattttattcatatttcccagttttacttgtgccccatgtatgtatgtgtgcatttagttctatacaactttatcacgtgttaagatgtgtcaaaatacagaaccattctgtcaccacaaagatccttcctgttgccttttataaccacacctcccttgctccctctacttcctcatctctaaccccaggaaccactaatctgttctttgtctctataatttgtcatttcaagaatgttatgtaaatgaaataatatagtttataatctggagcttggcttttttactcatcctaattcccttgagattcatccaagttgttgttgggtgtaagaacagtttgttcctcctcattgccatgtctggttttaatcattaagcaccccaacatggcacccaagcccaattacaaatccctcaggacatgatcctcagggaacttttattctaagagagcccatatgttttgtttggtgctgctgagtttgggggtgtggggatggaacatgttgcaagtttttctaggtacatgcaaacatacctaggttccttcatctccttccccaaaacagtgatcaattggattgtaatattctttagcactggttgacagcccttccttgtgtctccttgtcaccttcctccccaggagcacatctacaagctgatgaagagtgacagctatgcccgcttcctccggtcaaatgcttaccaggatttgctgctggccaagaagaaggtatctttgggaagggcaggcttgctcttagcactgttgactcttgcctgctgcttgctgctggtttgaaatgagaatatcatcccttgggttttatttatttcctactttcttctttcccttctctatctgctcccattctaatggaaaacagttaggattgtcaccaccccagccccactgcaaggtccaggatggggcatcctacctccacatccctactgcctctctctgcatgttctgcccatggtgggggtgggtacgtagggtgacaaaagactaaggccacagtggctcagcataggagtgcagggctggcagtaacaccagcaaaacccttaggacactggagagagcccctcactgcaaagtccagccccttcacctcagacttctctccctgaccagcccagagaggagtatgaggccagggttggggcagctctctcactggtcagaaagccttgtcagtttcaagagcacaatcaggtacctaaagtcatcctggggtttctccctccttgacacccccttcctctcccgcacctgccccacggtgttgcctttctctcttaaccaagaagtaactgcacccagctccttcctcctcctccttagaactcagccatggttccttgcagcccatggagtcatggatttgaggtgcaggggccctcagcatgcaggtgaggggtgacagaagcaggaataaattcagctagattcctgggaagagaggaggaagagtaggcaggagaatagggtccaggaagggaatggaaggcaagagagagggctcctggtttcagtacacctgcccaccctctgtgcttttcagctctgatctgaggcccatgtgtggttaagtgtggctcaacttgcaccaaaccctatgacttctgtgccatggcacttagggagcacaggcatccctttctcctccctcctggactcccagccccaggccctaagcacgtggttgcccatcacatgctctccgctgggctgcctctcagccacgcaagccttctctctgtgtgctgtcaccctcatgtgccaggatcctgtctgcgtatctggttgggaccacacaactccagagtcctggagagcatttataacctgctctcctgcccttgtgtagccctggaaagaggccatggagtctgagaaaggaaagaggacttctggggtatcccagttgtcagcagctctctgggtttcctgcatccctccccacaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaaggtcaaagtaagtttttcttattttctgtggctcaagacccctgatctgatcacagtttggtgactttctaaggctctggtagtttaaccagtctaggcctgtctacacacctagaagaagagaagctagaggccattgattctccttgtgggtttgaacacaaaggaaaaatgcaccccaaaccaggctgagacccctgtggctgcagatcctcccttccaagaagaaaacctctcagaggaggtcacttgagtgaggaaggaactggcaacctgcctgggaaaagttccttagagttatcctcccagctcccgaagtaagggatgttcttgagacagaaagcccttgcagataccaacaacgtctcaatactgaggagttgtttcccaaaacagtgacaaaacctgctttctccttctgtttcttcctgagagtctccaggtatggatctgatttgtaactcggcactttcaggtaggcctagagtattcttctgatttcagggacgggttcaccgtatccaggtcataaaaggtatgtgagattcacaacctccggcggagagagggaatatgaatcagcctcacttttctgctgagaactgacctggacggagtcttgaggcacagccttctgatccttcatccctaattcagcctcttttctaatattttccaaataaatgatagtcacactgaagaatcaggttctcagggggtaggtgagctgagtcctgagggctactctaggaaacttcagtaccagtgatgatggttttccagggcagctcaatggccagtgcaaggcagaggagccaagtgagccagaccaatggccaccctctgtgagccagaggataagaataacaggccgacaatgccagctgcagggcccaggactggcctgacttgagccaagtgtatgccacccaggctggccacagggttcaagctgagtcctgccatccccagaatagagacttggtatggtacccggggccaagcatgagtccttcagttcctagtacaagaagaaaggccagcccaactctgtggtgttatgtcgtttgtgttgtattttccttctgcaacctcatatctgtcttctggcagccagctgagctgacaaggggcctggctgccaaggaagccccccaacttcatccacacaggcggctgcctttggcctgtcccctctgctttcagcacagtccgcagacccacagacctcaggctgcctctttagctccctcatttcagttatttgctgggtgtatgtttgtgtctatgtgagtgtgtgcactctccgaacttctcagcctcgggctcaggaccctggaacgggatccaggatacactagcaggtatttgagcggtcattctactctcccggaacccctgcagctaggaaatgtggggtgaaaggaaagtcaggagcaccccacacctctcttcctcctgtagtagagggaggctaggcctggaaagacattcaagggctttgcctctcctcgctcctgttctgggaaccccagctaagagttccccacaatggtttctgagcttcctctagcctgtcgtacgtacatcttggcaggtgttatgtcaccttttggatactgagaaaacacacaatccccatgttattgtcttctgagacccaagaccctttgtccatggcaaaggctatgagtagaccctccttgctctaaggacacagaacgagggtcactaggaagtcactgaagttagcaaactttctggctgcctctgggcaggggaatctcaagagagaaaacagtcctaaggcagactcatggatgagtagataacttcgcttccccggcagccccttcctgacgtccctcccacaccctgctggctctcagagccagtctgttctgtgtcaggacttggggggcccccagggccccagggccacaaccaccagggctcctgcctgtgggcacggcaggttgaaagcagcaagcaagctgctcaaacccaccgactgtggtcctgcagcaaagtcatgatggttctgatccaagccccgcaagcaccattcatggcccccggagaagcaaagcccccctctctgctccctgctccaaggaggcggcaccatttctcgtgggcttctgtcttctgtctctcccattgactcttccaacagctctggctgcttctcttttcccatttttcgccccattttgctttggtttttgttattctttagctgcagctgctgctgtttgggaaccacgtataagctgaagattttttttttctgtatttttctccctacccttttttttttttcctaaagccagaaagtgagcaaggtcgtagaacttccctagaaaagttcactcgcagtgtggtaagttcagtcggttttcttccctcagcttttcttttggttttggttttttctttcttcttcttttttttttttttccctttggttgttgtttcctttggggtgggagggagtccagtgctttctccctcgactcagcccttttcttttgcgagtgtctgcagcttctcttctagggatgaaaatgcaaaaaagagcaagcggctccctctgcagaaggtgcacccttgatcgcccagcctcaggcctgggcatttgatcatctgttcagggctttgaggaggagggaccctgctgccctcggggctgtgcggtttgtgcatcttctgcagcagctcagggagaagccatcgaactataccgtgaaataaattggctcagaaccatagctcatcgaaaaaaaaaaaaaaagccaaaatttccctctgtgaaccctggcagtcacgccggtgtgggtcgcgagctaatgttgctgtgtaggcggcttttgctgtgtgcagaaagcggccgtgctgcatgggtcctggcgatgtggcctagctggcgtgtgtgttagtcgcctctgcatgagtcccttccagcccccatcagcctcatgtgcacagtgtgatagggagaggagggaagtagctgaatccctgcggtgtcctgggtactccccgggggcaaggtcctaccggcctcctcaggccttgattctaacaggctgggtaaagatgggcttcagattcctacaggttcatggtacgccccagctagagaggtagagctccccacagtggcacataaagacagccgtggcaacaggtgggagtggggagtccgtggctgttccctggggtgcatggctgagactctctaccatggtttgtagaacaacacaggccaatctcctctttccatgctggtcggcccaagatttgaacattgagctcagtgcacaagaaatactcaatcccgctcaatcacggggcccatcctgtaccatgaacatcaaaccagagggaaccagggagcagggtcccatgcagggagctggccacattcccttcccaaagggtggcagcccattgatattgacttgcctttgttccacctctgttgaggaggaaaatccttgtaaaacctgactactgtgtgactggtatacgtatttcatccttttaagaaaaagtctaaggctcctgggttgaaagcagcctagtcatttacgtgtcgtagctagatgcattttaagtgcatttaaacattatcttgaatttgctacatgtaaacctcaaataactctagtgggtggcaattaattaaacatcggtatccatcccttcccttcctcggtcttccctctctgtggcctttcctcatgagaaatcagaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggtagtgggatcccatctctctctgtttgtctcttttgaggactggctactgtgcgggtggaggatggttagggattttgctgacaagccaagggtgcctgtgtaagcagagccttgacagcccccggaagctcttgagggtgaccgtgcaggccacgggtgtgagaggggaagcctggtacttggacaaaacgtccagacattttcaggctgtttttcaagagaagtgagtatcaagaaaggcaagaatggtctcgcgaagctctgtgaggagcatttattgatttcctttcatcccagaagtggtgttggcttgggggttctcccaaggtctgttagcaaagcatttggaacaagaaagcaccaagacacccctaagtgtctgaagtgcacacatgggagagcttccagagggagtttcagagtgagctgaaggagaaaagtatcctaagctcctgagggtgtggataaaaggcccaaactattaaaaaaaactaaattcctaaattccctgctattttatgaacaagaaactctaacaggtgatgcattcagaatttggggttccagtggtggagatggattgccatccatccatgctcctcctgctcttggggtgacaccatagccccacaagatgtggctaagtttggggaataatatgacccatgtgttggctctcagattacttaagattggaacccaggaatctggtctcaacagcccagtggtctcatcaaacagaactaactaactgatcaaccaatatgccttgcaatttgatagccattctctgactatcatatgcctaaagtatttgatttctctaagagaagatctacgtgaatgttttatctgctatatactgcaagctataaaactaaatgaagggccagttcaatagcattcctgtgttgctgggaaagatgtgtaagaacatgacccatgtcatggggctaataatggaaacaggggagtgaagctgggcagctcacggaccaaagacgtgaggccaattaccatttaggattaattgatggcaaaaagaaataatgttgatccaggtgattggataactcattcagctggaggcttgtcaagactgaatctgaattcagaatttctccccagaacatgccaatgtcctttcttttcttggtagaagagaaacacttggaaaaaacaaattgttctttccaagtcttatgttgtgccatgacatagagggattatctgttaagaccacatatgcccccttttccatgagatcctaaggagacatttaatatggttcatggaagcttttagggccatgttagtttgggtgacgaaggggcctggtactccccagtcaatagaggaagtgctgtatgagcttctctttccaatgcaagcttcattccaggttactcaggacttggatatacaaagcaaatgtctggggacactgggccaagcatcctgtcattttgcagactgaaaccacaaaccctgcttatttgataaggcccaggttctgaactaaacatgactgaagtccacgacagggcgcaactagcctaccatgtacgttcatccaaaatggaaaacaagactccctctggtgggcccagcctcacagatgcccagctgaccaggcaaaacacaggctgggtttcagcccctattgatcctcagctgccctggtgcagtgaataacccacgccactgtacatggccacccttgtccgaggagcctgtttcagaaagagctgtaacacacagcagcttctccagggcccccaatacatggcctcaggtcatgtgatttggagcctgtctctgcctaatcctgctcatggggaagcttcctttcacagtggctgtaacatatgaaaaccacagtaggagaaatctggctagtcactgtgggttgcctttgcttcaccttccagctgttcttcagattctttggtgggaagtctcaggcattactgaccagggagaggaggtgccttctctcactgaagactctttcctgttgcttggtgatgtctagcctgccactctctgctatcttcctggttttgcagttgacagaggacaataggagcatgaaggtggccagagctgaaatgctcaccctcccactgcttcttgagacagagtctcactctccgagcctggagtgcagtggcacaatcttggctcactgcaacctctgcctcctaggttcaagcgattctcctgcctcagcctcccgagtagctgggattacaggcacacgccaccacacccggctaatttttgtacttttagtagagatggggtttcaccatattggccaggctgttctcaaactcctgacctcaagtgatccacctgcctcccaaagtgctgggattacaggcatgagccaccacaccccgccctctgctctctcttaagtgtgcttgttgcttcagcttccacagagtctaccacagtggggtggggggcctcaccaaagagggcctggctctgacatagaggaccaggagcatgcgtgggagggagagggggcaagaggaatcggggccaagccacagcagcagctcccttgttgagatagatactggctgaagccatctggtgagagctccaatctggggaggagaagctggagaaagtcctttgctcctctgtccagttccacagaaaaagccgcagagggtgatagcactgaagttaggagaaaatggcagccccgagtgaggctggtgtcagcctccctgggtacctttggaggctcagttgaaaccttacctgccctcttgagagcttcatcagctccagccttgggctccaaagatagatagatagaaaatggggttgctggtgccagagcaagcactggaggccacggaggagaagggagaggaggaccaggcgttcatccacctcctaagagagcatcgaagtttagctttgccaaggtgctccttggaattgcggcaggaagggccggaagctgcagaaggcttggcatgtgatgggtggcatctctgcgacaggctttcctgtcctgcctgcctgccaaggaatgcagcaggcaagtcagatggggagcgggaagctctgggagccagctgccactcagcctccctcgccccctccttccatccccctgttccttcccctgccaaaagccaaggaagagctaatgagagccaagaagtcaacagctcactcatccccctccaggcagctctgcagagagaaactcccagctccaggcccaggtgctgaccggaagtggagggctaaggctctccgcaggggagggggcaggcaggcaatcagggcagtcagccaaccggcagaagcagctcctgcccccaggaaggcggtgttgttttcccctcctcctcaaggtttcatggggaacagccttgcaccctggtggaatgagttcccaaatacctagactcagcagaatccccagagggctttgacctcagttgaaatgatctttctgtgcctctggcaagggccaattggctaaaaatctttccaaagggttagtttttattgcaaacagtccttggactcctttgggaccactgggtcacaaacattagtgccagcctctcccatctcagagcactgagatccagctgcagtgaaaccctggccctggctggagctggagggagacttccatcgaagtgtttgggaaggaaagcagggaaacctgcctctctggagcagcaagtgcatgtcctgggactctgagacacctcagcagccctcctgcagactggctcctgcttccagcctcagcttgctagctatgtgacctcaagcaaatcactagccctctctgagccctggttttctcctctgaaatgacttggactaggtcgtctcgatggtcccttccagctagcggtgttctgcaggtctgtgcttccctctgtcctgagatttctgagttatataactcattccttagaatgggagaggagctgtcttcttgcccagttagttacctgattcagaagtgcctgccagcctgtgaggctgggaaataaactgtggatagacttgagttgggtgtatttacaaagcctggacatgcactggcaggagaactgagtgccccaggctccccacacctacaccacaggccctgctcagttgttcagggttcactcgtccacggtgagtcgccggagggtcagggaggactcacagagaacagggtgagtgccctacacccttcagcttgccagttctgcagtccccacccttccggtctggatgcccagctgtgtgtgtgtgtgtcaggtggggtcagctgggcagaaaggtggaccccagggtcggtgttgccgcatcactgcatgcactgtggggtcccaggggccctatgggtataggaaggaatgaaatgtgagcacttgggaatctcagcacactctgctgctcacctgctaccaggctttctggttccccagggaaccctgggccagcttgttgctgtcctcttttagcgatgggaaataagagtatgagagacagtgttatcctgtttacaatcagtggtgaagtccgtggttaagaccaggttacaactcctctatgcttcgcttcttatcttgactctgtgtgaaattaggaaaagcatatttactgttatagttttgtagctggaaaatgaaaatataaaagtctattttttataaactacaaaatgtaaaacaacagactcagtatggctggtgggtacagagaagacaaagtggctcctcacggggttgacaggagtctcgagacttttatcaaaaaaggccagaagttggttgtcatttttgagacactgggccctagaccctgacgtttccgttggaaggaggagcccccagctgttcccgctgatggttcaacctgtccgccaaaagcagccaaaatgctctccccacggagtgcccacttggagaaaaaccccactggtgactcaccttctggacatgtggggcaatcagggcccggtggaggcagctgctcctggctttccctggtgggccctccctcgacccccgcccaggccctctcctgccttccccagaccccaatgtgccaagcagtcaagtgaaaatcaaatcctctgaggcagaaagacacagctgtgtgtttacagccactgattcagatccaaatcgcgtaccctgccagtctctagcaaggcaggctgggggcaaagtgtgtgtatgccaagcagggatctatttcgggaggtgacctgcaggccttcgccatgacagtgccttcctcccacccactctcaggaaaggtgctctcactttacaagcggctgatggggttgtggggtctcggcatgcttgtcacttgtgcagtcagaccccagtgccatcctcgtgcagccacatgggaactgtgtgggctcccacctgcctagtaagaaggcagagagtgaaggggagtgcagggccccccgcaggataaacagcgggaaggccgaccactcagaagacaggatgcccgcctctgcctaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagtaagacccccccccgacccatggaagtccccccaaaatgagctcctggtggaaacaacaggggatgcttcccccttttaaaatagtgatgagtgtccctggtttgagttgagttaggaaagcatgacattttggaaggaggccaggatacctgtccataggtaggaatagcctgtaagatgttgccctcctgcagtgtggctaaatgggacactgccgggggtgggactcagagcagtgggatttttagttttgtcatgtttgcccaaaggtggatgagagaaagacccttgggtgtttgcttagtggcttcccaatgggtgggaaggtgagacggggttggaagcatggagccaccccagcagtggcagggccacagggcagcggttcttccatgccccctaatcatggccacattgtatcagcctgagcatgagcaacagcaccatggccacatacgggaatgggcctcattggtgtaatatttggcagattctctccacaccccccgtggcggtctggcttactgttaagaagggtaaccttaaaaaatacatttcccactccagaaaatactcatatgtggcctgttagcagcacaagaagggtgaaagcaatgcccattcctgcctccctccccctgctcacctccacgtccctgtttgcccctttgtaggtgaagtgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgcgcgcgtgtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcagctttaggctatataacaaaagtgggaaaggaaaagtgttccattgctttttgttgctctaagcaatattaagtcttggttctaagcccccacattatcaggaactttaacatctagagacaattgagagagaagagctagagagagaaagtgaccctggaagccacgtcggaagaggctggagtaaaaatgtctagccccccagcagacttgatggccaccgtgagctctttgcatttgtcttcaagagtggacacttccgggttgctccagagagcaaggctagaacaaatggctagaagatagataggtagatactaaaaatattctaacaataacagaatattccaacaatagactatgtcccctcaaagggcaacgagctccatgtctagccgtttagaagctgaatggccaaggatagtgcagagtaggtttctacaccagatcccatgatcttttgcaactggaattctatgctgccccaaatacttgttaaatggatccgactgcatttcattctgtggtttataaataagtcctggaaaaggagaatgaattataaggaaggagtttgctgagattggaggagagggatctgaaagactcaggactagactccgccttgagggagaaaaagccacaagatgacacactcaaagcaagggaaaccgtcaggaagtggaattactgcccttcacatgtcatccttgccttcttttctgttttttgtttttttttttggcatttgctgccgcagcagctgagctctgggcaacagggctctctctcccgaatgtctgaaaggaggtcagcaagtggaggacacaggcgcccactggcacagggcattggcaaccatcgtgcagtgagccccagcacagccagggtggccatgtgcgtggggcgtcctggcccaaggttgaagaaaactcatcctgtcatagttcccatccggaaagggtgttttgttgaaagcaaaaaggatcataaagtcatttgccttttacccaatgccagttccagattccaggtaaatgagctaacatcaaaaacacctcagccggctgggcgtggtggctcacatctgtaatccgagcactttgggaggccgagacaggcagatcacctgaggtcaggcgttcaagaccagcctggtcaacgtggtgaaaccccgtctctactaaaaatacaaaaatgagccaggtgtggtggcacatgcctataatcccagctactcgggaggctgaggcaggaggatcactagaacaagggaggcggaggttgcagtgagccaagcttgcaccacctcactccagcctgggcgacagagcaaaactccatccccatcccacaaaaaaccccccagagacctcggactgaggagaaactatgcccccaccctggcttccctcctctagggccctgccagggggacttgtcctcagcccagctcagggaaagggaagggttcccatgtcacattctttccagctgtcctaagaaccaccccgattgccgatgacactccctcctctcttgggcttcaccagggctgctttcaactcatcgtgggattgtgtaattatggtgattacagcttgtgacttttttcctctccatcttttgctttcaaattctttgaggcctctcattaaacatggcgatcccggtaaagtcagcaaagttttaataagacactttttacagctaaagaaagcccagtcagggttgattgctactatgttctctcagatactccattaaaactctatcaggtgcagttggtgcctaggtataagaggtgggggagagggaaggcagggaggcagagggcacctgtacttagtgacagggctggagaaccattccacaccatgcccctggctttttttgtttgcactaagcaccaagtacatctgagcccccgtgcctaacaggaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaatcactagcctttgtgagtcatcacaatccggtggttttacacctgatggaggttttacacctgatggaggtttccttggtagtgattcagcttcacatctcattcttggctaatctttaatcatagcttgcttgcttgctttttgttgttgttttggtttggtttttgggggggtgttttttttgagacagagcctcgctttgttgcctaggctggagtgcagtggcgcaatctcagctcactgcaacctccacctcccaggtttaagcgattctcctgcctcagcctcctgagtagttgggattacaggcctgcaccaccacactcaactaatttttgtactcttagtagagacggagtttcaccatgtcagccaggctggtctcgaactcctggcctcaagtgatctgcacacctcggcctcccaaagtgctggagttacaagtgtgagccaccgtgcccagctcatagctttcttgaatagttatcatagctgtaggacatcatgagaaggaccatcaaggagtgtggcttgtgtgtgtgagccccgtgacccacccttcagcaggttcatccaggttcccctcatttctatattccctggggactacacagatgcccgcacagtgaagtgcatcttgctccagcaggactgtgtttctgagaggtccctgattggctgctcgtggctgaccgtcccataccaaccagactgccttttaccctgcaggtagccagttacctcactacctgtgtctcaaaagagcaaggagctggattgtgactgagcagcaccaaccacctggagttaaatgtcaaaaacgtggcagggacatttcccccaactgcattcccatccactactgaaggtggcctgctcgtgtgaccccttgagaacaacggtccctttagtacccaccagaatgcagagaagtaagctaagttcgagacaggcaaccccagctgaatccctttttctccacctgatattatgtgaccctgggcaagtcacttgcatgtctgacaggtacaacaaagcccactgcacagggtagatgttggcattcaatgaggatgtgatcacaagagctgccatttattgggagctcacactcacagtgttggactgtgtcatgctggctttgcctgggatggactttggttctacttcagctccatcacttagttgtttgaattgcacagcttctctaagcctcagtttcctcatccataaaagggagataagagtaaataagtaggaataaaatgcataacgtccttagcacactgtgtgcagtgcgtgtgcttaacaggtgtagctcttagaatcagtttcatcattatgatattatttgcagctcatacttaggctgcgcttattaccttatttaatttccaacaatattctgcaagataggcatcattatatacatcttgtggttgagggtgggtacgtgggtatctcctatatgacagtctgcacaaggtgcatgtattacagagatcagctcatggtaactactcaataaatggcagctatgattgttggcttatttttaaagtcaactcagagagttagtttttctgcatttcctggaaatgaagggactgtggtgcccagcaggccagcttctgttctatggtcgatttcctggggcccctaagcacttcccgggaagctgtgggaactggggggcttgtcagcctgtaaggtgctgggaggtggggagggccaccaggcaaatggtgcacgtgttgtggggatctggcatttggccgcctactgagttgaaggactcgaaggtgcctcctgctaccagagacagataaggaatgggtctacccaagataagaagatgaaatccactcctccaaatgtagccctccatgtgacagaaacactcacctctcagctgtctgcttgcctggagccaccctgagcaatgcaacctcaacaagtccagttgctccgtcagtccaataaacagaggtttctcttttttaaccacttattccaaagcgaggtagtggaggagtcagaagcacgtggcaggggatgctttgaaattccttgataaaccggacccctggggtgggcactcctactgcctatagtaccgacagaaacagaagtggagaagttgtttatttccaatgaggtcaataaatgcctttttcatgggggagaattccatttttatatatgtattttaaggtgaatgctttaagtttgcagtatttgtcagagtggcatcttaggagctgatagaaaactctacagccaaacaagcgattgcctgtgcaccttgcatgagatgcttctgtaagtgcctgtggtctcaacatgcacatgaacgcatgcactggtgtatgcacatgtgcacaggtgtatacacaggtgcatgtgccgcctgcctgatgttcgcctctgtgttcagtgtatggtgtgcatataaccataagctgcaaacctgcaagtatctctgttgcatggattgcatgccctctgcagctgtgtgtgtgtctgggcaggggctcctctaaagccacaggtcttcacagtttcagctggataagttattcttcacttcccttcctaaaaacacaattgcctagtgctgctggcgcagagtcagaatggccgctgcatttcacccccgaggtggcttccttccagcagtgggtgagtgatcccggcgttcgcacactctctaatctgtggaatccttctgcacagaaggtgttccaaaatccaaaagagatgatctgtttgtccatggcatcgtctctgcccaccactcctgttctcatgccctggttccagggacagtcggcagcacccatttcttggtgtctctgttttttctgcccattttttgtacccatagtttttctctcctaagaaacaaggagctgaggggtccagaaatgatgctgagatgagtcccttgtcccagaggcaatgtgcagataacatccttagatattgacccagtaactctcttctcctagtcccattccctagcagaacagggaatacccactacctttgaagatgcttctaaatccaataacagcatccttaggcttcatttcctggtgaaagcttccataactcttcctctgtgggccctgggccaaatcctgcaggaaacgtagcaatctcacatttctacacactacaccatcaggggagaaaaaagctgggaaaccgcccatcctctgtcccatggggaccaaaagcatctcagcagcacgtgaaaagagcctgtagggaaataaggttctctgtagctaagagttccaatgacctaagtttctgtccaggtatctcctgaaaacgctgcttagtctgttccctggtgtacttcctccggttaggaatccatgtctgataagtgcctgctaaattgcattcctgatagtggggaagaaagaaatgagccggccctctttgcatatgcatccaaatgggcatggacattcactgaattgttatgcttttgtggggggatgagaggtcagcaattctaggctccgccttttcagctggctaaaccaaggaccccaagaaatgtacgtgttttgggtgaacacatttgcaagagataagtgtcctcaggaggatggggtcagagtcctcataggtcctcaggagaatcacatactgccaaccaaataactttctcttgccgctttgtccacaatatcaagtaactaaattccagcttcactgtctcccgtagtcatagtcaagggttacttgaatttcctagttggaaaaaagtagcatcaacttgttgccaatagcaacacagccatgtccctgtttcctagagccttttggtctttgcctaatttggagtgaaccagagcttagatgccagagtccatttgggaaggaggaggagaagaggaacaggcgggcattaagtgggtcacaggaaggcatgccaccgagaggccttacaggcagaatgccaccctcattccactcctgaagccaccaagaatttcctgcaagctgagagaagaaagagcaacagggttgttccgtcagatgagaggagggagagaagagagagctggtgtgaaaagggggcatttccaccacacagggatgcagagtagcagggaaaatggagatgcacaacttggacgcgagaccggggagtctggacctggcattctgccactcatgtagggctcagctgctgagtccttgtctctcccaccatccctacccagctccggatttgtccctgcacagctggggggccatggagaaaggtcccccatcactcagcaaaactgacaggcagaagaaagtgatgagcatggtgaggccagggtcagagatgccaggaacaccagcagggagggcttcctccacctggctgggcaccccgaattaggcacttggcctagaatgatttaaagtggggttggttttcattagagtaaggccaccctgcctgccccaccttagaaagggaaacatcacacctgctcctgtcctccctggggcatttgccatgtgtgttcctagaggcatcagcatcagtaacacagggccacaaacagaacggtgggttcacccagcctgtccagcagctaccacctgaaatctacatgcaccaagccatggtgacctgcaccccagctcaatgcagtaaccaaaagccccttttgccaggcttgtcagccagcagatggcacctcctttctctcaggatttccaaatgggatgaggggaagccgcttcgcagcatagaacctgcctgagataagctcaagcatgctcaagaacttaagttcttttctcagggaagttgagaaaatcaccctgcattgcccagagaggttgcccagtacgggttgggcacaggggactccttcatccctgagtgtttccatctgcctccttccttgagagtgacagccatgtgcaaagtaagaggggcatgggtcgtgaaggccgaccaactcagctttgccactgactagccatgcactcccaggcaagttactcaaactccgtttgagtctgtttccttgttcgtttagtggagtttatagaaatgcctaactggcaagcatgttgtggacataagtaagtgcgggtgcttgtaaaatgcctcgcatgcttgacagacacacaatagttgctcaatggtccatcagcaggtggctgtttgttagtaactgtcctcacagctacctgtgtacctagtgggggaccattcccaccatgccactgtcaaggcctgagtgatttgaagaacaaggcacttgaggagagagggtccatgagctacccgtgccattccatcaaacaggcccatgggagatcaggggataggtgggtccttttacatttaatccagataggagaactggcaactcttcttttgtagattcaaaaactttttaaaatattttaaagcactggtagttgccaattatattagtccattttcacaatgctataaagaaatacctgagactgggtaatttctaatgaaaagaggtttaattgactcacagttccacatggctggggaagcctcaggaaacttacaatcatggtggaaagggaagcagtcttacttggcagcaggcaagagagagcgagtgtgtattaacacttaaaaaaccatcggatctcatgagaactcactccctatcacgagaatagcatgggggaaaccacccccatgatccaatcacctcccactagttcccgctctcaacacatggggattatagggattacaattcgaagtgagatttgggttcagacccagagccaaaccatatcaccaatacaggatagagtaaggtgtctgagcctactagtggtcccagtgacattctgtgggaattgctttcagaagacgtgactgctgggtacctcctccatccccagtgtttaccaggcagagcctgagtgtttacaccacacacagcctgagtctttataccactgtacatgagaaggtaggggtcgggggggcggggtggggggtgctgttgcaagaaaaaaaaatccattacgtttattttgatcaaatttattattttttaaacaggttcagttttaagtattcatgaatgtaccatttattaattctttaatcagtgaacgtctcttttttgattaattcacttttcatctatcccttgacttttttaaaaaaattggggtattgttttatgtttgtgatatagcttcctatttaaaaggggtcaaataaaaaaatattttaaaaccacataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattctaggttaagtgtggattttcccaccatcccctgccagcgtttctccgacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttatcctcagcaagtctcccccaaccccaccccaggcctctaattccacacgtatacatcctttatgaacttgagcaccatctattcaaaggtgaccttcaggctccttgagagcacgactcatctctctctggggcctccacttcttgcctgctaagttgcatggtgagctgtattcaacgaaacacgatttttcatgagcagggatggaaaatgcctgtgtgtcacaccaaagggatccgtttgcatcaatggaggctagaaatagtgttccacattagttctgttgcgagttcgaattccccaacagaggaatccaggttcctcctgtactggagggggaagcattgaatttctccaaacccagggatgggcccagcaactgaagaagggtaaggagtgggaaattccaaggcatagatgtcatagctgggacttttttttgtcctaattttttttttcttttgagatataattatgcacggtaaaatgaacagacctgaagtacatggctcaatgaatttgacaagtgtatgcacccgtgtaacgtataccccatcaccctagaaggctccttcatgtccctttccaatcaatttcatccttctcccccaggggcaaccgtggttgatttctttcccccataatagcctggattttgatttggcagacttgagatctgtaacttcggtcttagttcatctgagcagatcagcaaaagaatctcatcagaagctcagatgtctttactctcttagcattgaaaaagatcctccctgagccgctagtgcttggctctgctgtcccccagtatgccccaatctgacccccagggctactctctgagccacagccctcctcccagccaaagaaagagtttagcatcagtctcccaggtaagtaagtggcaaaagctcttggtaacccagatagtgcatgctttgttgattaatatgtggaagtgcaatgcacagagccacagcatgtcaagcagcatgttgatttttctcactgcacaaaagggggctattccttttgtgtgtttcctttcagaaaacaaaggattccatgaccaccttcttccaggctcctagccatcaagatggccacagagctgaaatgattaatcagagcggagggtgggaattgaatgtgtgggtgttagtgaacccagcactgagcccatggtccatgaaattgaaggatcccaaattctactggattacactttgccaaatgtctcaaaggtgaaaagcactttgtcggtatgcaaagctttggtgtctctggaatgtaccttctgcagctcagttcttaatcactgtatattttttcacttggacaaaggctgcctgctaatagcattttcaaccatcctcagctgcttcgctcagctacgccaaggcctcgggctgagctggctgcggtttcctggcaccatgatccattcccaactgaccaacactgaggaacattacacactcacaccctgaaaaaaacctgcttcctctgtaactatgcaaatgccagacacaggcaggcagaattaccattccccttctgaagtggttccttcaggatcatccaaactggagacagagatgagagtaaagagacggggcagtgccctggagggtacaggcaggagctcccctctctctgggcacagcggattcctcgggagcttcctgcaagcctataggggcatgcactttggggcagctcatctctgaacacaggtagcctctactatcagatttcactttgatcactgaaaactacaggagtctcagctcttcagaagggaagcagctgctgagcaagtgtgattgcagtatttcttccccaaagccccgggccaggcatctacccatgcccgcatcctgcatgattaaccgccttccagtctgagcctgccctcactcacgcgggaggtcactgggtagcgagtagattgcagctgggctgagctgcctctcaagccgacctgaaccctcatgacctccatctttagcagcaagctggcatttggtaaatgcgcgaaagcaggagtggggagagggagacaaaaatgccaagcagcaccgcctgggttgctgagaggttgggaacaatcccaagggtggcccctaagctggtcagctgcaccatcctaccctgaaatcctgggaaataaaagcagtcgggggaagcgaggagcgggcagtgacaggctggccacaggtccttggagtcagagcggtgaggctgagctccaggatttagtcaggaagagaataattagcaccttcaagcccagcccagcccagcccattctgtagaaaggggaagggttgagggtatggaagcctcagggccaaattcacctaaaacaaatagacacataatcctccagaaatagaatctccaacctccctcaacccacagtcccctctccagccaaaataaccttgttaataggaatgaggctgcagtgaaggtttgggcaactggtaaacctcacctcctttgtctctgggctttgaatgtactcattggcaacagactcttattcagaagcttgagtgattttttttttcccatccaccagctaaatgagagccccaaacgctgtggatagcaaactcagaacatatatatttgggtacataatgtgtgatttgtggccctggcgaaggagggatgggaggaggaggaggacctgatattggtgtgtggtggttatcacagcaataagtggcacctaaaaggagagcaaacttcctttgtgcctttcataggacagggatggacataggtaaccgggggtaggggaggtttgtaagagctctcacacaaggaggcccctaggctcagcagccccgtgtttccccagcaaggatgccccacacccccatgtttcctgccttcaggcctgccccaggaaggcacattcccgagtgacaaatgcctcacactctatgtaagaaagggcactcaaggagagtcaccgctgggtgtgtgccacagaacccggggctggggggagcccttgaaggtcagcctctgccttctaagagctattgttgtacctaacctggtctagacaaaggagtagtcattcttagtgattttcaaagactgacaccataaccctcttggattttttaaaaatctgattaaaaactccttagccaagtataaatgtatcctgctgcaggctaagtttagtgcacttgaagattcagataaggttgctgatggggtgattttgtggacgtgtgtgtgtgtgtgtgtgtgtgtgtgtgtgtgtgtgtgtgtttaagatggggagaaaaaatgaaaagttttgtctcactagtgaaaatggggagtgaaagcaatggggaggaaaaaggtcaaggagaggtagggaaaggcagactttctgacagctcctgagggcaatttcatttttggacaaactcccatctatagcaccagaattctcaaagtcaggctggccatgcctctccatggagatctaagccagatgccacattgtcctgtatccagcaaatccacagcccgtgttgtttattagataaacccgttatccatcaattcatcaatcagcaggtttattgaggaccctaccaggcttcacaaacctgatcaattttttaaattacatctagcttacacgcagccaagcccagtaaacaagacgagccctcacaccccacttggaaatgaacatgaggaatcgctggcccttgcaatctcacggccaaacactgcagccccatgctgacgagctatcacgtgctgcccttcacagatggcggtggtgtcgctgacccactgtcaataatatgggtttggagtgctttcccagacacagtgatcaatctgcctgggtctagccatactgtcctctaaagccctgtgcaatgatgcggatttctaaagagggtgagctggagaacgggcacacactatgtaagggcaataagcaaagcgacggagcctcgctcgtgcccctcaccctcctcctggtgcccagtcgcaactcccctcctagatcaggggcttctccgccatctctccagggcacatacacaacgggactctcctggcacctctatggctgatgcaccaggcctcatgatccagttcactgttttagtttttgagaagaactgccacatgggttatagttgaagggcttgtaggctttcctggtatggggtcatcaaactctgcctctgggtgccacagatgggaagccaagaacataggagacagcaggagtgcactgccctggggcctacagtggctctgagccccagcaaatgccccccactttcatggtcccagaactggtcatcaagaggactcaaggtctttgtgtctaccctgcattccaaacaggactctgccttcttaagactagttcattcattagcttctgatcagccagatccttggccaccctctatttgagtcaagcccccgtccctgatctcagaacaccccaagtccaccttttcctcccccacgtgaacaaaatcaatttcagggcagcccgccggcattaaaaattgctctacctaaaggtttaaatacctggtttttggtaagtaaaattcccataccacaaaaagagtaccaacaacacaccctcataaggggaccctccaggactccctgaaccttccctggagccctggtttctccagctgtccaaagttaaggctcccatacacctagagatcaaatatcaagatggtcagttgggttggttggtcgtttggcctacatggctcatgcaacaattaattcacctgtctggctctctgtctctgtccctctgtgtgtgcgcctgtgcgtgcctctctgtcgctgtctctctgcagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcca

SEQ ID NO: 751 - DNA, 634084 bp, Homo sapiens
cgcgagttggggcagctcctcgcgctcggccctgctcggcggcgagagctccgcctgggcgccgcgttcctacagccgccggagccgccaggcgccgagggaacggacagacctccgcgcacccttgccgaccggggcgggcagaggcgggcaagcggcgaacgcctgggagcgcggagagccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcgaggctgtggggagcggcgcggagacggactagacttcccctccgcccccaagaggctgccggtccccggttccctgggcttctccagctttatcatgaacctggcgcaaggttggctttaggaaaaattctggagccagagggagagtcaaggcaattctttggttgctaaggtaattgtagttgtgataaaaaatgggcaagaaacaaatgggggaaaaacatggtttaaaacagtatcctccctccccaccccattaatatgtgttgatttcatctcctgggtgtgggtgcttgtccatttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcaggtagggcagctttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaagagaccgtgtttacagtcaccagcaggctgcgtaaagaagtggcccagtgagacagggaaagtgacccagaaaatttagttttgttcagaatgaaagctgctgtatttcatttttgtttcttaatttgacggagtaggaacgttattttccttctctgtcattgagaccagtagcatttctatgttacaaactgaagatatttggggtctcgtcggcttgggattatcaatgcttgggaggtgagttctgatcaatacctttaacaaccccaaagaaaaacgcaaaaataatcaagtttaggtaaaacttccactggactttctttccagggagggtgagagatggaagaactgggcttgtaagtatcaaaatggagttagagaatgagctacaagtttgtgtgtgtatggtctgtcaaaaagtgttaagactgaaaggaaactgttaggtttagttaaatgtgttgacaacacggctcttacatatcaattttcataggcaaataggtaattacatagagtgggaactgggactatggtgggaaactttctgtaagatgtatattctttattcttaatttatcactttttcaatgggtgggactactctgtgaaggaaagtagagggctgagggacatttggtgagactcttgagagagaaacctttgcaagccaaatctcgcatgctatagatgataaattctaagttctttgatattgtaccactcttaagctaaattgtcctgtaaatatgatctcatgcaccataaactatatatatgtagagagagtctattcccaataactcatcctttcctgaaagagtctgcaagttctataaatgtcagctgttgggaggtattgtgatgaaggagagaggccaccagtgtttccttttatatatttattctggcagatcttaactttacttctgattttctttaaggaatttcagttaacattcactgaatttatattgctgagagtttcagtaaaacaagactagattttctttgaagcaataaattcatcttatcaagtgaaacattatgacaatgcttttgtggcagaaatgtttatttaaatgagtccattttaattatttatttatttttgacttgcagaataagatctgcaacatagatgtttttgaagtaagtagacgtttcttgagaaagaaaaataaatttaggttactgtggacaatttgccagtaattttggatgtctctttgtctacagggacataattttgtgtgaaagtagaatcattccatttcttatgtctctcatcttctcccatgcattttatcccctgaactcctaagactttgccaggaattgctgaacattctgtttcgtgccaggggttaaatatcaggggatggaataaggagctgtgtgtcacataaacatttttcaaaaggatgctgtcagagatctcaataccgggattaatttttcctttagctttgcagttagcttgtcttaattggtattgctctgaacctaggaatgcatttaacctcttcattttcagtttccagctggaaggaatatatttaccaaatttcatcttctttgtaacatatggcatgatataaataattactatacacacactatcctgctgtaaggaaagaaatagaattacaaaatcaactttcgtgttgagtgatatggatataatatttcaaaaaacaattttaacttttcccctgattccaaaagtaatatttagctattgaaacagttcaggaaaatacaaagaaaaaaataaaggttatccataatctgctagggagagggagccactgttaacatatctttaactgtatattcttccaaatattattctagtcaattatttctacccagtccccctcccccacacatttttataaatataaaatatagcttggaaatataacttggaaatgtgttaaaggcttgggaatttactgcttgtttacagaatgattttgatcagatattagtttttactggtggtccttattttcaaaaagagtaggttctttctttttctgttctttgaaaacaagtgtttgcactttgggctggtaatgcttggggcttccttttgaatttagggattaaagcatcagaaaagaagtagaaaggtcattggccattgtgggtgggagacctgagttctggttgcagttactccaacttctcctgtggcctctgggcctctgtttccctaaagggcaaaaggtacttttagatttaactaattaagctaatgacgtatttattgctttgacatgagaatgatctttgaagagggcttattcaaacacagaaacacctgggggtcatcctgggagtctctgattgattctgtctgagatggggcccgagaaggtacatatctaacaagtccctggatgatgctgactgctggtttggtgacagtgaaaactagagggttaagtgtactagggttctcttagagggacagaactaataggatatatatatatatatatatatatatgtacatatatatcatatatacatatatgctatatatatgctatacatgatatatatacatatgatatatgtacatataccatatatctataaaggggagtttattaagtattaacttacatggtcccaaggtcccacaataggctggctgtaagctgaggagcaaggagagccagtccaagtctcaaaactaaagaaattggagtcagatgtttgagggcaggaagcatccagcatgggagaaagatgtagggtgggaggctaggctcatttctccttttcatgtttttctgcctcctttatattcgctggaagctgattaggttgtgcccaccagattaagggtggatctgccttccacagcccactgacacaaatgtttaatctcttttgggcaacacccacacggacacacccaggatcaatactctgtatctctcaatgcaatcaaggtgacactcagtattaaccatcaaaagcccaccccttgtcaacttgaacccatacatatctcctgagatcatacataatcttcaaataaagacaataatgaggtcaaaattgtgcataacataatacaactatcctttgtacaaccagaaatgcaccaatccccaatgcaaatactattacataaagttaacaatacttacatgctgttgtgaagtcaataaatcttatgtcacatgataaaggaaaaggaaatgaagatattttcttagtatgagtgtatatatacacaaacatgtttttaacaaaagaaggaggaaatactcttgacaattacagtctgtttctgcagctggtcacatggtcgtagctggtattgatgactaccttcttctacccattcagtattccttttgcctacagcaagcacctcagcaggttcttttccctggtggagtgacccaaacctttattcctgaaggatctggaccatttgtagtcccgcctggattgggctgttgtagtttcctgttgaccttaatcacagggcatggtaatactgagagatgccctaatggatttcctgtgttccatatgtagtcttccttacctctgctgtggagtagtagactgatttcctcttgatagtccaggtcaatcatgccagccaacacagtaattttcttcttagcctgttgactgaaagataggagtatcccaaactgtccaggtggcaatcttaacttccagtttaatggaatcgttgtgtttcctggtggcagtgttcctccctctggaactaagatctctaggccagcagaaggtaatgtcttgggaacaggaagcaaaaattttgctagtggatcagtaggggtgatggtgagtggtgccacttccacttccgccccttgattcctggacctgtgaatcctggctataggagaaacagtaccatatattggatgctgattcagagcatacacggccctctggagaactctgccccagccctgcaaagtattgtcacctagttggcattgtaattgtgacttcgaaaggccattccaccattctatcaatataactgcttcaggatgatggggagcatggtaagaccagtgaattccatgagcatgaacccactgccacacttctttggccataaagtgagtgccttggtcagagacaatgctgcatggaataccacgatggtggataaggcattccgtgagtccacagatggtagtcttggcagaagcattgtgtgcaggataggcaaacccatatccggagtaaatgtctattccagtgaggacaaacctctgccctttccatgatggaagaagtccagtataatcaacctgccaccaggtagctggctgatcaccctgagggatagtgccatatggaggggtcagtgttggtctctgctgctggcaatttgggcactcagcagtgatcatagccaggtcagccttggtgagtggaagtccgtgttgctgagcccatgcataacctccatccctgccaccatggccactttgttcatgggcccattgggtggtgacgggtggctggggaaagaggctgagtggtgtccacagaacaggtcatcctattcacctgattattaaactcctcctctgctgaggtcacccgttggtgagcacttacatgggatacagatagcttcacagtttttgaccactcagaaaggtccatccacataactttttcccaaatttctttgtcaccaatttttcaatcatgcttcttccaagtccctgaccatccagccaagccattggctacagcccatgaattgatatataatcgcatattgggccatttctccttccatgcaaagtgcacagctaggtgcactgcttgaagttctgcccactgggaagatttcccttcacctctgtccttcagagatgtcctagaaaaggcctgtagtgctgcagctgtccacttttgggtggtgcctgcatatcgtgcagaaccatctgtgaacaggccctagtcttctcctcctctgtcaactgatgatagggaactccccatgaggccgtgggtgcaggctaggggagagaaggcagggtggcaggagtggagaccatgggcacttgagccacttcctcatgtaacttacttgtgccttcaggacttgcctgagtcagatcacgtatataccacttccatttgatgatgggatgctgctgtgcacaacccactttatggctagatgggtcagaaagcacccagttcatgatagaaagttcaggttgcatggtgacttgatgacccagtcaaacgttcagtttccaccaaagcccagtaataggccaagagctgtctctcaaaaggagagtagttacctgcagaagatgacagggccttgctgcaaagtcctagagtactccactgtgattcacctatgggcgcctgccaaaggctccaaacagcatccctatctgccactgacaactcaagcaccattggatctgctggatcatatgtcccaagtggcagagcagcttgcatagcagcctggacctgttgcagaaccttctcctgttctggaccccactcaaaactggcagcctttcgggtcactcaataaatgggccggagtaacacacccaaatgaggaatgtgttgcctccaaaatccaaataggcccactaagtgttgtgcctctttcttggttgtaggaggggccaaatgcagcaacttatccttcaccttagaaggaatatctcaacaggccccacaccactggacccctagaaattttattggggtagaaggtccctgaattttagttggatttcttatcctctggcttgcaaatgtctcaccagtaagtccagtgtgtttgctacctcttgttctctggatccaatcagcataacgtcaatgtaatggaccagagtgatatcttgtggaagcaaaaagtgatcaaggtctctctgaataagattatgacacaaagccagagagttgatatacccctgaggtaggacagtaaaggtatattgctagccttgccagctgaaggcaaattgcttctagtgggccttatggacaggaatggagaaaaaggcatttgccaagtcaatggctgcataccaagtactaggagatgtgttaatttgctcaagcaatgaaaccacatctggtacagcagctgcaattggcatcaccacttggttaaacttatgataatccactatcattctccaagatgcatctgtcttctgcacaggccaaatgggagagtcaaatgggaatgtggtgggaatcaccatccctgcatctttcaagtccctgttggtggcactaatctcctcagtccctccaggcacatgatactgtttttgatttgctatttttctaggtagaggcatctctaatggcttccatttgggctttccccccataatagccgtcaccctactagtcagccaatgtgggggttctgccagctgctaagtatgcctatgccaattatgcattctggccctggggaaatgaccacaggataagtccagggacccactggacacactataagctggacctgagctaaaactccattaattatctgacttgcataagcccctagcttaaatggaggaccacaatgatgttttgggtcccctggaatcaatgtcagctcagagccagtgtccagtagtccccgaaatgtctgatcattttcctttcccgagtgcagttaccctggtaaaagaccagaggtctccttggggaaagatgagagaaagatctactgcataaattttcagtcatgtagtggagtccttccttaaggggacccagcctcccctttgtccaaagggttctgggtctgtaaactggctcaagtctggaaattgaatgaggagccgtgattctctgtttttataattcaaattagtcttttgtccattcaacctagaagttttctgtttgtgtaattgaagtaggaatgcagtaggcttcctatcaatttcacttttaggaacaccatgattaattagccaatgccagagctctacatgagtcagactattctgattgccactttgcctctgctgtccattatggtagttatgctcaccttgcctttgatggttgagtgctgccacttgacccctgccacctggtccctgccacctctggatccaattattcccattttgtagttgagtgactgtggttcccaccattagatctgacatacagagaatggcaattacagggctcttcaaagatgcaggtgctgccctcccaagtctattttgcaaggcattggtcaagggtatatcttctggaccctcccagctgggatgagtaggtctaaagggactaatccactccaccaccccaatctccctaagcctttggattccttcctgtacattaagccaagggagatcaggcatttccagctcactcacagtgggccgcctttaagagcttgtgtctatttttccacaatttcggctctttctctaggagataagactctcacttagtgtaatcttagcagatttgaggctcagtatctgcttctgaagctgggagacagaatccctgagttcatcattttctttcatcactttgtccgttgaacttaagagcagccaacctgcttcactgtgttccttggttctccacatatggtcaaatgtgctatgtacagagtcgctaaactccctgcctctcatgagcggtgaattaggagtgtcaaaggcatttattttgcataactctctaaacagtttctgccaaggactatcagtgttttctatactattagaagtagagtccttagcatttttgggtctaatcatattaagcagccaactccagaaaccccaaaaccaacgaaagaactccattcttaatattctgttcatctagaaccactcctggtaccaaaatctgtattaggtttctcttagagggatataactaataagatatatatgtcttagggagtttattaagtattcacttacacaatcacaaggtcccacaataggctatctgtaagctgaggagcaaggacagccagtccaagtcccaaaactgaagaacttggagtcagatgtttgagggcaggaagtatctagcatgggagaaagatgtaggctgggaggctaggctcctctctccttttcatgtttttctgcctgctttatattcgctggaagctgattagattgtgcccaccagattaagggtggatctgccttccccagcccaatgactcacatatttaatctcttttgggcaacacccacacagacacacccaggatcaatactccgtatccctcagtgcaatcaagttgacactcagtattaaccatcacagtaagctccttacaggccaaaatgcctgtttgacttttcacaggctttcacagtaagctccttacaggccaaaaagcctgtttgacttttctttgcagccatccatccagtgccccaaaatatacctgccaataggtgttcagtaagcattggttgaatcaatattagttttctcttatggaggaatatctttctggagtagtcaagacaaaagaataatcatccagaatttggaaacattaagcctgtaataagagttataatcattcatggaccacactacttcaaactgcaaagaaagcaaaaatgcttataagtaggcaattaaattgaacattaaacctaatgagttacattaaataataactaggaatacctgtttgagatgttacaaaccacaaagcctaccaaatacttcaccgttacctctctcaggtctggaagaggccatttattttctaccacatacacatatttcaaaaaatggaagtttcactattaattaccctaattaccaaggcagcagataaagcaagcaatctccttgctcccctctcctcatcccccatccctcccaccaagaaaaaaggctcattagaactctaccaccattctataagataggtcccaattttatgaatgaagaaatgtaaaactttagagaaagaaattaacctgcataaatccacaaagtgaagtagcagcatcagaagtaagatccaggcctcctgataccaaagggtgttgttctttaccacttccctctggtgacattgaatgtgtatatttgatagctgggagattctagctggctgaaataccccagttagaacttttgattatccttatgtggctaccttttatatagaaaatatatcttttccttctacttaggtgttagtaacatagggtggtaccaagaaccaccatttttatgtgtggtaacttcaaaaaaagtgtaaatatttggatatgaacaaaatagatcctcattcattaatagctcaggctatgcaaatgaattgtcttagaggctgtcttggcatttcacagtaatttggttaaactatcaaagagaaagccacctttaaatctgtccatggtagagttcactcattcactagtatctgcttgacccaagaacctattttcttgcacacatggaagcatgcattctacaaagccagctgaggtgaggtcccctgcatgaatgagagctggtggtggcactcccttggaaataccccaggcacctgtgttgctctcatgaagacctggctagtctggagctcagacagagaactgctattatttgttcttaaaggagcacaacaggcattttaaaatcctgttaattgtgtttctgaaccttagttttctcgtctgtgaaagaataatttaaaaaataccctttgagtatgtgtgaccatgagaatagaggaccctgtatgaagtatggggcatagaaagcacagacacgtaagaagatgggactgtcacagcacagttcctgttttctaataatttttagagtgagtctgttgagaaataagtgtttcaggataatggttcctctttattttctgttcctgaggcattgctgtgttagtcaagcatttgatggactcccaagtctctgagaatcctgctccatagttctcacattgggatttgaggaggcttgtagaaagcaagtggcccacacatctaagtgggagaaggcagcgtgggcaagatctctgtggtagccaaagatgcctctgtttcctggaggcgaaaggccattaatcaccagcaggaagagaagtgaaaaaggagactgctgctgcattgatagggcttatgccagacacacagagcaagcccatgttttttctctgcatccttgggatttcttacagtgcttggcacatagtaggagtttggtaaatgtttgctgagttattgagttgcagagtgacagctgtgggtggaggaggaaggatgggctagtattggtaggaattcatggactagtgggggtgcatggattggtatgagtgtggatgcaaggtgcacgtggttatagccttcattcttattgcttgcttgattttgcctggcaagatccacttcatatccatgatatagtgagactgtcatcctagtttcacattattgtgtgtctattccattgggctttggtcggtttggcttttttgttttgttttataatttatgtttgtaattttatctccacctctagcacaagaccaatacacatagtaaatgcttgataaaaattcgttgcctaaacaaaaacttgctcagcctacaaaactatgggtccgtcatatggttgtgggctgatcttacaaaataacaatcagcatttgttaagctttttgcaaatcaaagtcctttaagagatgttgggtggtattatgcccattttatagatgaggaaaccgagtggaaacgaggttcagtcacttgccctaagtcagatagtcattgaggagccaagatttaaactcagatcttttctgaccccaaagtccttgtgctgttttatatagcacaaggtggggaataaacagagaccctacccttgagatcatttcagttgtattggagagatgataggaataaatagaaaattagcaataaaagatgttaaatgatagtttaggaaaaaatgcaggggattttgtaagtcagatttggtagcaaatagatgatgaagacagtaagcacattatagtttagttcagagacagcattttatcatcagatctggaagagacaggcttcaggaaataggaataaactttaaaggtgcaaaaagggataatggcaaagttttcagatgaaaggtgttaataatacagtcacgtgtcacttaatgaccaggatacatttggagaaatgtatcattaggtgattttgttgttgtgtgaacaccctagagtgtacttacacaacctagatggtatagcctactgtacacctaggccatgtggtatagtgctcctaggctacaaactgtgcagcatgttactgtactgaatactgtaggcaattgtagcgcagtggtgttttgtacttaaatatatctaaacatggaaaagatacagtaacaatatggtgttataatctcatgggacccccttcatgtatgtggtccatcactgacttgtggtgcatgactgtaattggttattaaaacaattgtttgatttcagagtaagggctaatataaactccttatagttaaagccatctcagaccaccctagctaaaataataactcctgccccttctcattgctcttcattgtcttacttgccctatttttgatcacagctttatcaccatgacattgcattatatgtacttatatattgtctgtctccctctgctagaatatacattccataaaagcagggactcttttatttcctgttgtagattcagcatctgtcacagattctgattcatactaattgtttaagaactatttgtgaaatgaaggaagaaaatgcattttaaaaatgagttgcaaactcaaacactcaatagaccagttaggtaaaggaaatgagggaagcaagtgaggtttcttccacaatggtaacaagttgtaatttttacaaatcaaaagcatgttttgtttgtacattacacagatagaaagtttttactcccagaaatacatttatatctatttttcttgaaatatggggtcatctgactcattgtcaagagagacctggataccaaataagatttccttttttctagaagcagaacagccatccacgtgtgatgatgaatggcacctgaccttggatctcagggttggggttgcattagggacaggtggagaatgtgtttaagcgagaagtatgtgctgctcagaaagccctgttgttgccaaattttaattcatttaaaaattattaaccaatttcaattagaaaaatattatgtatatctacactgcccaatccaagagaaacaccttttgagctggctgtattttatggtgtgacctctgtagaaaaaaaagattaaataacatatgcaatatattttctccttaaacttctatggaaatgctacagtgtttagattccaaatcaagcaggaagatgccattatattattttgctgaccatacatcctaatacaaagactgattcagcagctggtcaaaatagaaaggacgcattcacaaagaataaatatattgattacattttagacttttttttaggtgaagggactttcattttcaggatagcaggtagtttagggcttggctgttggtttctgccgatagccaggggtatgtgacaggagacaaagtagctgaactctcttgatctgcattcttcccagttgcagaatagggctgagaaattgtgattgctttgagatggttactgaaagagagtgtgtacctggaaacaatctctggtttagtcaactattaatggggttgcgggggcgggatgttccgtaccccaggtcacagctggcctggggtctctgctgctcctccccactccttgtcctgctggtccgtgtcagacagtgcatctatcttcctaccaaggactcatttccagataatgattaattggatatggctcctgtgttcaagaaacttaaaattctgaagaaggaaaacaaatggagagacggaatgtggtaagcaaggcctatatatggaaagttagggagagatgacttcctgctgagggatttcactgaagaggctaagtagatgaattggactttggaggacctagaggtctggggcctgcagaaatggggccaggggacagagatggcaagaatgtacttggggcatttcaatgtaaacaaaattatacaggtgatcaaatgcaaggaatgtgcaaagaatatttaataccccccatacagagtgaggtccttaaaaacctttctggcaggaggagtccgtgttgatgaacttaaaactttaatgaaaacaaggataggggaaacctaggtttaagcaaaactgttcaataagtatttgtcatatttactgaaagtaaaatgagaaaacaaaagtagattatgagtgacattttactcaccttatgttggtaagagcagtgtgccacagtgaatttccagttacttcttgctgtttttcaggctgtcagccccccttacagtgaaatgcttacaggtagttttgctttattacagttagtgtacaattcttatgcacaagggcactcctccatgccaggctcactatacaaatgttcaatgcctttcagtcagagaggctgactgctgactcctgggtctccctgtggctaaagggtaaagtggatagatacatcttggggtaaactttatttaacttagttggcatgactgatcaggaagtcctcagatacctcacccccatgcctagggtatttagtgtcatgccaaagcatatgctgccaattccaggttttcattttttggtttcctttaagctttcaaaagcttctctgcaaaaatcacttccgctgcctgccatctgccttaaaaccccctcccccacttaaaaaaaatctgtttctaatcccaagagtcttttttgttgttgttttcgagacagggtctcactctgttgcccaggctggattgcagtggcgtggtgttggctccctgcagccttgacctcccagactcaagtgatcctcccacctcagcctcccaagtagctgggactacaggcgtgtgccaccactctgagctaattttgtgtttattgtagagacagggtttcatcatattgcctagactggtgcgagattcttatattttctaattattcttaaaatgaccaattgactatcaaaaatgtatttggaaataggtataagttgaactttgcttattgggaattcttggttgggggagttttctgtagttgagattaccatgttgttgggtatatgaagatgaacagtgacggataaaactagaagtgcaagttgaggccagtgtgcgaaggaacttgaatgccatataatagtgttgatagtgatggggatttagtcttctctctgatgcagactaaacaaaaaaataccaataacccaactgaactgaagcaaaatccaagtatctcgagcagaaataaatttatctgaccacataatctgagaattcaggcttagctggatccagggacttagatgatgtggtcagcactcttactcaacaccttgtcttcttgacttcctccttctatggcacgagagaagaagaagatggtcactaatatttctaccctcacatcttttcaacagtcacctcacaggggaggaatcttctttcttccagcgtccttatctcagtctcagggaaggactttggtcctgattagtcacatgtctacgatggttcgatctgtgtgtctgataatgaggcatactctggccaggacagtccacagtggtaacagacacaacctctggctccttcatcatccctgcaattataaccctgccatgatgtcattttttgcatcactgtatgtgagagggctgcaatgccaccttgagaacccaatatgctgcatccttcctccagatctgcatttatttgcactattctttttcaaacatacagttctactgaagtataacatatttacagaaaagtattcaaatcattgttcaataaattttcaagcagtaaacacatccatgttatctctctgagatcaagaaagagaatattaccgttcttccagaaaccacctcatgggccctcccagtaagtacatatttcttttttcccattggtaactgctaagctgatttcctttctctctctctctcttttttttttttttttttttttttttaaagagatgaggtctcactgtgttgcccaggatggccaggaactcctaggctcaagcagtcctcccacttcagcctctcaagtagctaccactaacctgatttctaacactgtaactttctcttttttgaaacaaatgaaataaatatgaaatcatacatatatgcctgtacactttctttctagatccttatgcacaacattgtttgtgaaattcatctatgttgcaatgtgtagcagtagactatttttattactatatagtattctactttgtgatattccacaaactattcatctactgttgagggacatttgggatatttctaggttagacatatgaatagtgctgctatgaatatttttgtatgtgttttgtgacacacatatgaatgtgtttctgtttgatatacacacctaagactggattgctgggccatggggtgtgcatatgttcagctttattcgatccttacaaagagttttcttaagtggctgcaccaatttatattcctatcatcagttcatgagtgtttcagtttctttatatcattggtaagacttgagattgttaaatgtttgaattttagccattctggtgggtgcgtagtgatgtcttattatggcttcaatttgcatttttctggtgactgatgatgatgtgcctttttaatttttttttgccacttttatttgtcttttgcagtgcctattcaagcttattgcctattttaaattagatttttaatctttttctcattgagttgtagaaatcttcttttaaaaacaaatttttaatacaaatacttttgcctgtcatatgtatttaaaatatcttttcccggctctagtggtttgcctttcactctcttttgatgaattggagatctcactttgaatataatctaacttatcagtctctttctttatggttattgtttcctgtgcctacttaagaaattgttgcctaccctaaggctatgaagctactctgttttaatttatagaagctctatttttttttttttttgccttttagccttttatctttaggttgtaaaaatctacctgtggatgattgttgtttgtggtgtgataaaggcatccgtatttgttttgttttacttatggatatccaataaacccagcaccacttattgaaaaatctcttcatttctactactctgaaatgtcacctttgttatcagtcacatttgtggtctgtctctgtgttttctagtccattccatttttctatttctctaatataatattgataacgcactgtcttaattacgtgagctttataggaggtcttgatattcagtagtgtgcaccctctagtttgttcttatttaagaataacttctaaagaacaaagctggaggcatcactctacctgacttcaaactatactacaaagtgacagtcaccagaacagcatggtattggtacaaaaaacagacacatagaccaatggaacagaatagagatctcagaaataagactgcacatctacaaccatctcatcttccacagacatgacaaaaacaagcaatggggaaaggatttaataaatggtgctgggagacatggctagctatatgcagcaaactgaaactggacctcttccttacaccttatccaaagattaactcaagatggattaaagatgtaaagtaaaaccaaaaactataaaaaccctagaagaaaatctaggcaataccattcaggacataggcacaggcaaagatttcatgacaaaaacatcaaaagcaattgcaacaaaagcaaaaattgagaaatgagatataattaaggagcttctgcatagcaaaagaaactatcatcagagcgaacaggcagcctacagaatgggagagaatttttgcaacctatccacctgacaaagatctaatatccagagtctacaaggaacttaaatttatgagcaaaaaacaacccaattaaaaagtgggcaaaggacttgaacagacacttgtcaaaagaagacatttatgtggccagcaaacatgaaagaaaagattaacatcactgatcattagagaaatgcaaatcaaaaccacagtgagataccatctcacaccagtcagaatggtgattattaaaaattcaagaaacaacatgctggcgaggctgaggagagagagaaatgcttttacattgttggtgggagtgtaaattggatcaaccattgtggaagacagtgtggtgattcctcaaagacctagaggcagaaataccatttgacccagcaatcccattacagggtatcaacctaaaggaatataaatcattctgtgataaagatacatgcatgtatgtgttcattgcagcacttttcatgatagcaaatacatggaatcaacccaaatacccatcaataatagactggataaagaaaatatggtaatatacaccatagactactatgtggccataaaaaggaacgagatcatgtcctttgcagggtcgtggatggagcggaaatccattatccccagcaaacaaacgcaggagcagaaaaccaaacactgcatgttctcactcataagtgggaaccaaacaatgagaacctgtagagagagggaggggaaaaacacctgaggcctgttggggatggggggatggggagagggacagcatcaggaaaaatagctaatacatgctgggcttaatacttaggcgatgggttgataggtgcagcaaaccatcatggcacacgtttacctatgtaacaaacctgcacgtcctgcacatgtaccccagaacttaacataatatataattaaaaagaatagcttcattatttctaaccatttgcattactgtataaattttaaagtcatcttctgatgggattttgattgggattgcattaaatctctagcctaaattgggagtaaattaatgtttttacagtgttggctattttaatccattaatatggaatatcccttcctttatttagatctgtctctcacgtctgtcagcatttttgtatccctctatattgtaaaattattgcacatcttttaaatatatattcctagtatttgaaattattcgatgctattataaataatacctttaaaaatatatcattttctgattgttgctgatatacaaaaaatacaattgagttttatatattgaccttgtattcattgactttgctaaattcactgaatcctaatagttctgtgtattaggttggtgcaaaagtaattgcattcataaattattatgaatttccatgtacacagttaaattacttgtaaaagagttattacttttacctttctaattatcacgacttgtatttgtttttcttgcctgttgtataggctaagacctcaaatataatggtgaatagaagtggtgatagtgagcattcttgtctaatttccaatctcagtgggaaagttttccatgttttactattaaatattattaaatatttctgtaagtgttttacaaataccgtttatcagatcaagcaagcccccttacatttaaaattggccaagagtattttcatgaagaggtgttgaatttgattaaatgccttaaagccataattgcacagaatagcgggctcacctctgtacttcctttttctcttggatcatgatcccatgtgtcctcattgccttgggagctcttctttttataccatatctacctttctagattttcttgagggttggactgttacaagttagatcatcattgtaggaattggtactgtaaattcaaattgtactatttttgtctgccatctacacggtatgagtaaaactgtaaaacccccgagaacctattcaattgttatttctttgatctatattgcttttggctggtaagctttatgaaaagattttcttttgttaaattttgctatcttaagaggaaaagtctaccattgctgctacaaatggaggcattatggagtcattgaaagggtgcaccttatattacatttaaatgccatgttttacatataaacatactgattttacctgttcctttttaaaaaagaaagaaaacaatgaaatcccaaggaataaaactgacattctttaaaaaagaaaaagccaataggagtgcttttcttcttaggtcccctgggaacatgtcatcctcttcatctcttagtcatccacttcttgtgtataaaaattggcaacgcttctctgtcactcccacttcttctctagcagtgatacaatctttcatgcgaaataagagaataataaaatgttatttctgcagtcccaatagtcagtagtattagaaactataatcttggaacccatacttaacaaaatataagccctctcatgtgagaagagagggaagacccaagctctaaatgctgactcattgctaaccaggagggtggcattagaacgcaacttgaccttcccaggtcttagtgccatcctctgaaaaccaaaggcttggacttgttcaagggacagaaaaaattgtaatgtaaagggctaaatagtaaatattttgagttctgtgggccatacagtccctgttacaacaactcaattctgctgttgtggcacagaagtgatcatagacaataagtaaacaaatgggcatttatttataaaagtgtatttatggacacaaactcaaatttcatacaattttcatgtgtcataaaatactgttctttcaacttttttttcaagcatctaaaaatgtaaaaacaattcttagcaaagagatcatataaaaagaggtaacaggcttagatttgtcccatgggcccaagtttaccaacctttgagtcagttaaattgtcaagggctgttccagagctctgtgttaggcattcatatgctagccttttaaaaaatattttttttgtcctatgaacattattcaaaagggtctatttttttcttttagaccaattatgaataagaaaaatacaatatgttgtttttacctttattccttcatcagtgcttgttctttctttttagagatccaagtttctgacctgtataattttcctctgcctgaagaacttctttttgcatttcttgcatagcaggtttgctggtgataaatttcctcagtttttgcttgtctgtgaaagtctttattttttctccacttttgaaggataattgcactagatgtagaattctaagtgggcgtttttttttttttttttttccttcaacattttaagtatttcactccacactctggcttgcatggcttctgtaattcttatcctcattcttctataggtaaggaatctggcttcttttaagatttcctctttgtctttggttttctgcagtttgaatatgatatacctagatgtagtttttctttttttgggtgtttgtcctgattggtgtttactgacttttctggatctgtgatttattgtatgtcattaattttggaaagttctccgtcattattccttctaatatttcttctcctttctttcttctcttcttggaattctgattacatttatgttacagctttttatattgttctatagttcctgaatattctgctctggtttttttcctcccttaattctctctctctttttagtttggaaattcatgattgactttcaagctcatggagtcttaaaaaatttcttaaatttttaatttttatgggtacatatgtgtatacttatggggtacatgagatatcttgatacaggtatgcaatgcataataaccacatcatggaaaatagggtgtccatcccctcaagcatttctcctttgtgttacaatccaattacactcttttagttattttaaaatgtacaattgagttgttgttattgacattagtcaccctcttgtgctatcaaatggtaggtcttactcttcttggccatttgagtctgctgatgagcccatggaaagccttcttcatttgttacagtgtttttgatttttagcatttccttttcaaaggagttttaaaaaaatgtttccttctctctggtttcattaccatttactttctccattagaatccttaacatttttcatcatagttattttaaatttcctatctgttaatgacacagataattccaacatccgtgacatatctgagtctgattctgatgattgcttgtctcttcagaatgtgtttttcttacctttcaccatgcgttgtaattttttgttgaaagccagacatgatgtgttgggtcataggaactgaggtaggtaggcacttagtgtgaggttttacttaatctggctaggagttgggttgtgtttagtgtttgctgagctgtaggtgctagaggcttcaaatccccccaagggtccttgtttttgtctcctctcttgactttaggtttccctaactactattcctcagggacgctgtgtcttggaagtcttttatctgtaatccactgttacacctgagcccggctggtgtggtggtagggcatatgtgagcagtaatgttctattaaccatctaattaagagcaaggatggaataacttccctttggtaaatggtaacgttacaggaaaggggtcccaatccagaccccaagagagggttcttggatctcacgcaagaaataattcggggcaagtccgtagagtaaactgaaagcaagtttattaagaaagtagaggaattaaagaatggctactccatagatagagcagccctgagggcttctggttgcccatttttatggctatttcttgattatatgctaaacaaggggtggattattcttgactcccctttttaggccatatagggtaacttcctgatgttgccatggcatttataaactgtcatggcgctggtgggagtgtagcagtgaggacaaccagaggtcactctaatcaccatcttggttctggtgggtttcagctggcttctttagtacaccctgtttatcagcaaggtctttatgacctgtatcttatgccgacctccagtctcattctgtgacttagaatgcgtaactctctgggaatgcagcccagtaggtctcagcctcattttacccagcccctactcaagatggagttgctctggttcaaattcctctgacagaaaaactttcccccataagaaaaaggaagatggagaacatggtggcttcagtgagggtgtctgaagatgagggacttgccttctgctggcttccatttcttccatgaattttgaagtgagctcatcagctaagactatgtgttaaatatgagctgggaaaagatatgacatagccatctcagaaagggagaaacaagcttggtaggaaaacattttgggtttggcaggcagtgttgactattcatttaatgtttgtggccatgaatttaatgcagctagtcagcctggttgtgtgacttcctctccatcccaaagtgttcatctgtttggatgggagcttggggttggtggatagttgggttccatcagtgttggaatttggtaaggatagtgtgacacagaaagggggtgtattagtgttccctagagggacagaactaatagtgtgtgtgtgtgtgtgtgtgtgtgtgtatattctatttttatatatacaatagtatatatataacagtgtgtgtgtgtatatatatgtaggagtttattaagtattatcttacatgatcacaaggtcccacaagaggctgtctacaagcttgaggaagaaggagagccagtccgagtctcaaaactgaagaacttgtagtcccaagtttgagggcaggaagcatccagcaagggagaaagatgtaggctgggaggctaggtcagtctcaccttttcatgtttctctgactgctttatatttgctggcagctgattagattgtgcccaccagattaagggtgggtctgccttccccagcccacggacttaaatgttaatctcctttggcaacaccctcacagacacacccaggatcaatactttgcatccttcaatctaatcaagttgacactcagtattaaccatcacaaggggagatgcaggagtagagggtatgtgcaagggagtgattatgagtgagtataatgatggagccagtgtgaatagtgaaggtgaagcgaagggtaggaatggatagtaaaagtgctgtgtgttcaatggattaaatgtctaaataagtttgaagattgtttgcagtgaatgcagagtaagtaagtgagctgaacagaggaagggtggacagagtggaggatgcttgtagtgggatttgaggtgatgacaaagtttaggatgtggccatgtgagatagtgactcagaaggaaaaagcttcaggtgaggaaataaggaactgagaaactggcttttctggtaggtctttgactctgatgttaaagtcactgaaagtggtgaaggtgttagggaagcagaagaaaccctctgagaggcggaagctggagtcttcagggaatgagaaggcataagcaggagggaggtgaaaaacagcagtgaggatgagcagaaagtggcagagccagatggcctgagtgccacagagcagggatttgtgttggagggagggagggaaatcatttgaaggagcggtggagagccaggaggctgcctgccctactccctggtcttcagatatatgacgtgaggacagagggctgtaggagaggagaaggcaagtttccattaaggtcacagaaggttaaagttcagagaggagatggaaggacatagtgggcatactatttacagaaatgttgaaagggtgggatgagtctgtggggagtcggaggggttggggtttccagagcagcgtggagttcagagccctggtgagagaggatgactgggtagacctggctttccagcagagattgcagtaacaggactcccagggccagcatgccctgttacatggctatctttccacttctccctcctagcttaatttttagaaactttaacagatggaatgcaaaatttttatttttatttttacttcagagatcagtcctcaccctgtcgccctggctggagtgcagtggtgtgatcatagctcagtgtagcctccaactcctgggctcaagtgatcctcccacatcagcctcccgagtagctgagactacaggcaacgcaccaccatgcctggctaatttttgtatttttttgtagagattgggtcttgctatgttgcccaggctggtcttgaactcccaggtttaagcaatcctcatgcatgcatatatatatatatatgcagctttgataatttaattagtttagcctgtcaggcagctgtgatagtgtagagaacgttgtatttatttgtaagtcttaaggtaggattggaatggagaagtcaacttcactgaaaactagcaagtagaatgaaggaaacacagattagttgaggacctactatgttccaggctttgtgccaaacatctactttatgtaggtgatttcacaagatggacatgttggaaaaactgtgggcattggaatcagtcctgggtttgaattttagttgcttggctgacaaactgtgttactttgggcaagttacctgtgctcttcagtcttacttttctcatccatagcgtgggaataataacatccacctgttgtggttgctgtaatgagctgtgcaagaaattctaatcagcaggccgggctgagaaccactgctgcagagtgattagcatttgttccattttataggtgaagaaactaaggcccagtggggctaaatatgttgcttacggccacacagcacttaaatgatatagccaggattgaaagccagttttttttgaccccagaaccttgttgtatccatttcattgagtttttgccttaatacatgggaagctaaaggagcccccccattagcatgtctgcccaaacatcaggcagcatgggatgggaggaagggatcaagtgaagggaaggcaggctccatggaatctaggtcagcggtttccaaacctggctgtacttacaaatcatctggaaaatggttaatctgtaaatctccagggaccaccctaggcctattggatcagaacttctggagcatgggaaccgggagtatgtatatttagaatatctcccaggttattctgagactgctagcctagttccggtccttgggcaagtttttgggaaccactgaattctaatcgatgtcctaaaatgattaagtgattatatcccagtaaaatactgggtgtcttccagtgccaccaaaattggcctttaggggttgagtgctattgccgtactttaagatcttggtgcattacctgaaacggacactctgtctgtcattgaacatttgaacttcgaatatataggaaatgtcaagttggcatactctgctataacaggaagagtgatttgttatttagagctgttgttcttccttctttccccttgggattcctgcccactcagtcagattagagctatataaacaagctcgtactactgagctagcacacatcttgtaaattttttttcctgaagtgcttaacgttgctgatgtcagaaaaaaaaaatccattgggttttaatgggctgaggcaaacaatgagaatttgatataatatggaggagaggaaataacttcaacagaaattcttatttggcagcataaatattcaaactatattacagtcagagtttgattgcttctcctacatggcatttccctgaatagggttttgagggctgggcactaagagtggcaggcatgatgtttaaagcatttagttgcaagccatggtaatttcagtgacattgtagggtaattgtagttggttctcctcttagctctgtgtcaggatcacctgaggaggttgttggaccgctgaaggcttcatctctgatgcacgagtcagaacatctgagggtgggggttggggtgggattctccattgaatctgatgccagtggcctgggaatttcacttggccaaaccctggcttagaacaaggtcactggtcagtttcgatattcattctgtgctggggcatttccatgacttagtgtcttccctcttcaaaagcaaccctgcgtgatggaggggtctcatcttccaggcaaggagctggaaacgtagggtgggagagcccattgtcaaaggccacatagtagccttaatgaggctagagctgagatgtgattcccagtctgacttcaaagcccttccttttcctataccatcgaggcccttccttcctgctctgctcaacattgttagctgccgaaccctaggctttgcttgttccagaggggctggcattataaagtaaacagcaggcatttattgtaactgcaagttacagatgcagtgtcagtttggagtagacttgcaggcacaatcctgactttcaatgattcacgaatctgtttgtgtcacaggtgctcaattgtcctattatgcatagagcatccccttcactatattttcttccctcaccacatattccttcttacctaaattgcttatgaattccagaagtggattgctgagtccaggctggttcatatcaataaaccttggggaaaatctttatgtgtgatgctatacatgggtctttgttgatcaagagtcttctttattggccacttttaatggcttgttatccagatgaatcttctggaaggaggacactgcatcctggtggaattttatcagttccatcattcattcaaacatatttaagtaccttctatgtgccaggttctgctctaggtgccagggagagaggggtgaaccccaacgataaagtccctgcctatgaagaactgactttctagagaggaagtccctgatagacaagtaaacaaagtcccgcagattcagatagttgcgaatccctgttatctcactctccacacttggctgtctcccacttaatctttctgggatcagattatctttgtggcttttttctcttgactgtctagcacaaagctgagccgcttctggggcttcagatttctatgcctgtgtgtgtgcatagccttggctggaatggcaaactttgcctctcccaggcttctgctcatctgtcacctcctcctactctgtgccatcataattgagcaaccacatattacagtgtcctttctgtgaacacatctgttattcctaccggtctctgaacattttaaggagaggatctgtgtctgacttatctgtatatccccagggcctagcatggaaccttacaaaagtagatgctcagtatatttgctcaaagaataaatgatgagttccaaagaacctgagggtgggtggtgtggtataggaattccgtcatggggagggatgctgagtcagatgggggatgctccaccgcagtggttttgtgatttattctttgagacattgagtgctgtcatgaatagaggagatgggctgggatataggcagtattgacagagacacgtggcatggaacattctggtgagaacctttgaaggaaagttagaaatgtgaggttctgagggtctagctcagagctggaaggaactctaaggttgctggattttatagccaatgcccaactgaggtccagggaagctgtgtgtcctggttctgatagttggttagttgcaaaggagctaggggtggggtgataccaggactcctagttcagagggctttccactatgctggggctatggtgtgtgacagataacagattaaaggcacagagaggagaaggaacttgcctaagatcacacagctaggaagtggtggagcctggatttggacatggatctgtctaatgagaggcatcttgtaaccatcaagctgtattgtctcttcttgaagactgtgaaatgcaaggtcctagcccattttcagttttcctcttgggttagctgtgagtccatataggaaaataatattaacatgctttctttcttttggtatgcagttacatgttttcagaaaaatgttcacattcttcaaatgttaatattgaagcccctgggttgtttactgtgtgtatatatatgtatatataagtacaatgaagaacattctgtttttctctaccactaaatttaaacccatttctattgtactccatttaaaagaagtattttacatcatactataatgaatgaaaacctagtcctttaatttcacaagccccagctttaatagtcaatgaatttaattagaaaatctttacctatgtaggtttcacatccagttctctataacatctgttgacctatggactagaaagtatattattattttagaaatgattctttctagacacaggaaagctaaatagcttgtctgagtttcaaaacgagttaatagaggaaccaaaaatagaaacatttctactgaatacgaggcttactaaaattcttcacacagagactatctgcattcacttagtagtttccagtctagactctggaacatcagcctgttttaacacacacaaatgcttctgttggtgggagggggtggctgggcagagggaggccgggcagagggaggcctgacacgtttgtttctaggtcatttctaaccttgctattataatacagttttctagatagaagagaatgtgctcattaaagtgttcattttaaaataaagcgacagaaacttaaaacgtctctattacatggatacatgagtatatataaatgaactcaatttttgttttcatgctctgttgtattctgtattaaggcaaaggagtaggcaactaagtagttgtttaaaaataaaactgtgtgttgttcatttaattttaaaagccattggttagaatggtaatcagtgtttccatgtagtactatattcatagaaatcctgatattacagtgtatagagataatattatagaatgatgctctttacctctttatgtaatctaattttaaaaaacattgtaatttataaatagtgaagaaagcaggtagtgttattcgaatgggatattttcggcaattaaattcttagcataaattacaaattcctctctctcccattttccacccaaatttgtttttatggaatgacctttggtagcaacttgttttataataaaatgtttcctgaatttgtattttgaattgaaatggccttttctgtcacgtatggtatttataagagtttctttgatgaaaagcctctgaattttgtgcaaataacccaggcagcctcttagatgagggataacatttgtataggacttttatggctttatactctgctctcatactcagcttatttgacccttacctgcggggaacttggtggaattcacattttactgctgaggacaatgtagaggaaggtgccttggcatgactcagagcatatagcaggtgtttggtatgtttgttttaaagggaaattaacaaaagaaacccaaaagattcttgtacttgctcaaggtcacacaataaatatagtgtcataccaaggattgaacttccttcttcactcaaaacttccatatacttgttcttatctcactgttatcttttcaggcttttcaaaaaggccacattaaatatatttatttttcttaattgaggtgaaattcacataacacaaaattagccatcttaaagtgtataattcagtggcatttcatgctttcacagtgttctacagccatcacctctatcaaggcccctgaaggagaccctgtatccattaagcagtcacccattccatcctccctgcagctactggcagctaccaatctgtttcttgtctctgtggacttacctattctggatatttcataaaaatagactccagcaatatgtgacgttttgtgtctggctttttacacttagcgtgttttcacttagcatgttttcaaggttcatccacgttgtagtgtgtgtcagtactttatttctttttattgctcaatgatatcccattgtatggatatacacgttttatttatccattcatgcactgatagacatttgggttgtttcccccttttaactattgtgaatagtgctgctatgaacatttgtgtacaagtatttgatatttgttttcagttagtttgtgtatgtacttagaagtggaattgctagatcatatggtaattctgtgttcaacttttttgaggaaacactaagctgttttcagcagtgactgtgtcattttacattcctaccagcaatgtttgaggattttgatttccctgtatccttgccaagacttacttgaggttttttttttttaaattataataatcttaatgggtatgaagtggtatctccttgtggtctggattttgatttccctaataaaatattcatattttaatgcatagaattaatcagaaaatgagctttggcaaggtgaactcaacagcaaaatgattggcttcaactgtcttcaggagattatttaagactgccgtggctgggtgcggtggcgcacgcctgtaatgccagcagtttgggaggctgaggctggtgcatcacctaacgtcagaagtttgtgaccagcctgaccaacatggagaaaccctgtctctactaaaaatacaaaaatagctgggtgtggtggcacatgcctgtaatgccagctactcgggaggctgaggcaggagaatcacttaaacccgggaggcggaggtttcagagagctgagatcgcgtcattgcactctagcctgggcaataagagcgaaactctgtctcaaaaaaaaacaaaacaaaacactgctgtatattcactcctggggtgtgcgattctgagctgaaaatcaataacatgttgtttggggattagaagaatatttgtggatagtaagactgcaatcatcccctaactttaaaaaatgtatcatgtaatatcatgtttttgttcatggcatctgccaaaagttacttaattctttgcatttcaaagccctctttatataattccttcgtgacttaatggtttattcatttatttttgcagtgtgagtgaagacactcaggatggctcaaggatccggggatcaaagagcagtgggggttgctgacccagaggagagttctccaaacatgatcgtttactgcaaagtaaggcgcctggtcaagtgccgtgcgtgctgtccgtgtggactgttgtgttctgtgtagggctgataaaaagacaaatgttttctgcctaaactgccttactgataaatgcatattttcttctcacatcctctggttctctagttctaaaattcaaggaagttcatacttgagcacttggtatttaacacttgaaaaatattatgccatttagttttctttaaacccaaaggttgcctaagcaatgcagatgggaagacacattctccttcagtggaaaggccttagtgtaagatgtatgaactgaaagttcttcagactcgtagtatgtacaaaatctgggctgaatgctgtgggagatagagaggtatatttgtatgagatgcttacagttggtaggagacataagatgtacacaaataactgttatagagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatctctttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctattaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatcatgcttattaaattgcgataaagaaaaaaataggttaatgggactcagcaattagtgaaacatacagaataatagacattgagtcattgttactttcttaacccacccccaaactgggagaccccgtgccaggctggtaggaacatgggctttggagtgagacttaggttaaaatgccaactttaccactctttagcagtatgactgtaagttagttctttaacttccatgagccacaattttttcatctgtaaaaagaaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagaggaaataaatgataaaatctctaaatgttggtgctgttaataagttgtctagagcaaatttatacagtgagtttttttttaagacacaggaaaacaataaaaatatttttatattcttcagaggattgcaaattcatggattattaaagaataagaaatgcaaaggtcatgtaacccaaccacctttctactagaatgtttgtattatgtttacaggaaaaaaaaacttcctgcaggtttatgagaacttggtttttactttttggtggtagtaaggggcccttttctggtttaatttagtaactaacatgtcaattgctgtagttctttagagaaatgacaactagtaatgaaactatatcttactttcgtgtgacaaacttgtgtaaagagtatatatatatatatatatatgttcatgtttatttgctatattaattaccataaaagggacattgaattggttcagtctgttagaaagaagacacacttattgcacagtgtgagctcaggtcctgacaccattttaaacctagttaacctgactgacttaaaccatggttgtacttgaactatgggattttcatatagttttctactcctgatgctgtaggctgccttttggctacaaccaagaacttacttgctgtaggacattatcctcaaggtatcatcagtaagggttggattgtgaagccaatgacaattcaaagcattttctttggaagtccttttgtgtaatcaattattcaaagtcatagccataaacccaaacctttccttagatacccacgactacaatttacatttaaaaaattgtgctttcatttttgttttctttctcttgtttgttgttgttgttttttttctcttgttgtcagacactttcagtgtgaaatttttgcttggactgcattgtgttgattcagatgctgacatttaaaaagccaaatctagagaaatgaagcttttgggtaaactttcgagtaataagtggatgattatgtccataatgttgttgtgacttttaaatgacatttaggatggtaacctcctgacatatgagtaatgatgggtgggtttttaaagcccacacttttcagaacactcttcatttccttttcatgttttcatgtcattaactgtgagaagttgtactttcccaaggcatgacttatttattgacttgaacagactttctaatttagtttttcatccctcatattcacagtttggattggaggtgtgtatgaaaaatgtattggtcacattaaagatctatttaaaagaaaaccttaattattcatgaagacacccagacctgttaaccttttttatattcctgtatccttaggatcctgagttactgaattgcccagtgtaatgatgatatttgaacctagctatacatcacatcatttagggtgctttataaaaatgttaatcctcaaaggaccccctccacaaggtatttctatttaataggtctgagctgggtcctaggaatctgagtttcaagatgttctcaggaaaatctgatgcccaactaagtttgaaaagcacttacttagtcttttacaatatccagacatagtatgtgttgcaaagtaatgagagagttggtgttttgaattagatttttgatttcataattatttgtagatctctcaaaacgtagaagaaccaagctcttgtcatagggattttagtagcttttccttagatattttctagtcttattttatagatgaaagaactaaaagtatagagagggtgagtaacttgattaaggctcctcagcactttcccatggaagccataatggtgtccagggagcctggccactccaatcagttgcctttctagcaccctatgcgactaccatgttatcaaccacagactactgttaccacattgttggagctgagtagccatggggcacattaaattaatgaaaataatatgtggcagatctttgactttcatgtttcttctgggagagttgacttggattaatgtctcacttttttattgatttttaaaaaatactttaagttctagggtacatgtgcacaacgtgcaggtttgttacatatgtatacatgtgccatgttggtgtgctgcacccattaactctcatttacattaggcatgtctcctaatgctttccctccccactcctgccaccccacgacaggccccagtgtgtgatgttccccttcctgtgtccaagtgttctcattgttcaattcccacctgtgagtgagaagatgcagtgtttggttttttgttcttgcaatagtttgctgagaatgatggtttccagcttcatccatgtccctacaaaggacacgaactcatccttttttatggctgcatagtattccatggtgtatatgtgccacattttcttaatccagtatatcattgatggaatgtctcacatttttaatgctaaagtttcattctactcattggtgcttttgcttcttcggtaaagattttctaaaatgtttacataggtaagattgcttttgagtaagagtaggttgctttctgattttgtttggatctttggtgttaacaatgcctcttgacaaagttctcctaactagactggtaatttgatttgtttgggtcaggaggcatggaagacatcacactctggatgtcttctacatccagaaggatggaggcatggcagatgtcacactctggatgtcttctacatccaaaagctggaggctctgcctgtctggtcccagctttgtgtggagaacttcactttcctgattctacttcttgttttgttttctaccttcttcattcttttcctccttccttttcaattgtgagatacttctaacacaaaaagaatatattcagtgtccatgtaaagtagaaagaattaaaaaatgaattatatgcactcaccattagcttaataaataaaatgtaatactttggcctcatttccccttctgtaaagggaggaaattggtctaaaaatgtacaaatacctttctgcaatgatttcaaagttccattctataactttttgatctttcgtaaattagtacacttccctgatatcaaaacaatgttgtgagactatatgcacgtttaaaggtcttttgagcttttgaagaaatattttagatagttgtaggtaatctaaattggattgagataaagcccagttaagtcaggcattagaataaaaagctttaattgtaattatttaatattcaacagtggaatttagatgacatcttggtggcaacctgtttctttggcttgctaataacatttaagacatttataaaattatcattttgtagtattaattatatgctatatacataacaagtggtgtttaagtagcaacactgtacattgccagtagtatatagtgtcatagatgaaataggggttttagaggaagacaaaaaaggccaatgttcttgtatatcaacaggttagttgcctagcctcgtcactgatggcttccttcacctattcatttctagttattgactccttttctgctggaatttgagtctagcctttatgttgctctgataccccaaggtcactcttcctaatgatttagggcccttgaagtcctgggcagttgttggtttaggcatacatccagaaagtaaatgtcacactattttagttacattggctgtggtatgcagcaagaagggaaggatctagcctggaagaatccgatgctatggaggaagctagggatagagtgtggtttggaattcatagagggcagtggtagaagccagcacaattgagagtctggggacctgcaggtcctggtgactaaggcatgatgaggattagaaactgtcgaatcaggaaatacgtattgagtgtcatttgtgtgccagacactattagatgctaggaatgcaagatgagaactgagccctgaatgagcccacaggccagctgggggtaaatggggaactagacaattacagtgttggtagaagcaactgaggggcatgggaggaggtagaggggtcatgtagtccatcccaggagaggggatgatgatgtagaagacatccagaggatttggcacctgcttcgattcttgaaagatgactaggaattaaccagatggaggaggagagagaaggtgtaggaggcaggactagcacctgtaaaagagcagatttgtgatgtcgtataccgagttcaggagactttaagtggttgatatgaagctaggtttctgtgatgaaaggttgaggaatagagctagacagatggattagggccagatcacaaaagaccttatgtaccatgccaaggagtttagacattgtaaaagtatcttccctttgggcctccacacccaagttcaactcctttgcatgctgctgtctgccccagaggctgagctgtgaggactacatttacagggctcctgtgacctctgggtttcagttgggtttggttagtaaaagtctggaaagagatgggagggaaggagaatcgcaatgtcagagaatttcttctcctgggtctcactctgcaaaaccttgcactggccatatccgtctactgaagtttgttgattctctcaaggcagactactttcctcttctgggtccggacatcctttttgtctactcatccttttgggcctttgccgactactttcctcttctgggtccggacatccttttcatctactcatccttttgggccttggggtggttccagtttgtatttgttatctcttgctgtgtaacgagttatctcaaaactcaatggcttgaaaacatttattatgtcacaatttctatgggttagtaatccaagtgcagattccgtgagttctccagcacagtgtctttttaaaaggctgtgatcaagatgttgactcggattatggtttcgtctgaagtctcagctggggaaaagtctactcccaaacttacttgtgtgactgttggctggattcagctccttaggggccgttggaatggtggactcggttcttcgttggctgtttgccagaggccattcttagttatttatgacacgtgtctctccatatcgcagctcataatatggcaggttttttttttttttttttttttttttttatcagagtgacaacaggcagagaaggaagatgggtggtagtagtcttagtgttttataacctaattttggacatttttttctttattatactttaagttctagggtacatgtgcacaacgtgcaggtttgttacataggtatacatgtgccatgttgttttgctgtacccatcaacttgtcatttacattaggtatttctcctaatgctatccctcccccagcccaattttggacatattatcccatcccttttgatagtaagaagtcactaggtccacccctcactcaaggtgagggatttacacaaagatgtgaataccaagatccagaattcagaaaatctttgtgggccattttggaagccatctaccacacagctctacttctactagccaggggtttctgagtgttttttttttataatttccctgtaccctagaactcctttaaacttggtccttttggaaatacattttccttaaattgtcctatgtatatcatctgtttaccaataagaccctaacgaatgcaagtattatcccacaagcaaagggaagcgattgagactctgcgtttcttgataagggaattcttcatgaaagggtttgaagcaggggagtcatttgtccaaagtggaggatgggatctgaaatggggaagtcaatgtggagaagattcagtgtggaggtcaatgggtgatcgatgtggaagggttcggtgtggagggagagtgttggagaagtggtaggattggaggtaggaggacagtttagagattgaacaggaatccaggtgaggaaaaatgatgcccaaatcagtggcagtggtaatacagatgggaggatgtgtttgagagatgtttaggaggttcaggcaacagaatttgggggctgagaagacgtagggagaatttgagaataatgaggaggaatgaggagtcttttccctaggctatatctgtgattctcagaaagtctcctgggataaacttttgaagcaaatagctgtagaactggattgcctgcccctctcttccctgtatgtagataaattgagagagcccaagacagagtctgtaaatggaccaggatatctgggtatttgttctggctgccccactccactagctcatttatggccatgcgtaagttgttcctactttttgttaagtctagttctttaatttgtgaagtaaggggttagctatgctgggtgatctctaaagcatttttttagatctaacattctaggtcttttgtaatctaaaatagagaaacccacattttattattttactacttcatagcctcctttactttatttttaattttctttaaaaagtgaaccgagccaaaactttaaaaacaggtaagtcagaatgtttaaaacaaatggcttttggtcttcagcacttagggcttgttttttttcactctttttttttttttaacattaaataaaattcctggccacatgcagtggctcatgcctgtaatcccagcactttggaaggccaaggcaggcagatcacctgagatcaggagtctgagatcagcttggccaacatggcaaaaccctgtctctactaaaaatacaaaaattggccaggcatggtggcacacgcctgtaatcccagctacttgggaggctgaggcaggagaatcacttgagcctgggaggcagaagctacagtgagcagagatggtgccaccgcactccagcctgggtgacagagtgagactctgtctcaaggactaacttcagaaagtgttcagggtaactaatttaattgttcagtctacattttaagattcctttcattaaattttttgaagctttttttattgccttaggaaaaaactgttctgttttccttttcccccaggattagacttgctggaagaaaagctcccccatcacattatcttggttggcaggagacaggcatgcaggcaagtcccagaccagtggtatcagtgtccacagatgaaagggatggtatttttagtgtggggaatagctcagtgtggtttcatatgatgcattttgatgagtataactttctaatttgaaaagcctttggtgtgtttacgtcttcatttaatctttccaatttctccccctcatttcatttcaaggagtctaagatttttcattttggcaggcagttgatcactcttgttattgacactcctttgcagtattcttacactgtggagaacctgaatggctgtaaattccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgcttacagctgaaataatttttagtattttctttagtgcaggtctgctgaagataaattctctcagttcttgtttgtctaaaatatctttgggccaggcacgttggcttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtgcttggggattctttttttttttgatggaggcttgctctgtcacccaggctggagtgcagtggtgcaaccttggctcactgcagctgccacctcctggaatcaagtgattctcctgccccaacctcccgagtagctgggactagaggtgcgtgccaccacgcccaaataatttttgtatttttagtacagtcggggtttcaccatgttgaccaggatggtctcgatctcttgacctcgtgatcctcccacctcagcctcccaaagtgctgggattataggcatgagccaccatgcccgactgtgcttgggaattcttaaccattaacttttcaaatattgtttatgcctagttttctcatttctctcttcttgggattgtgttcatatgttaggacctttttcctctagatttcatgtgtttcttatgctcttttctgtattttttattcctttgtcattttgtgcttcaacatggatattttctaccgacttatcctccagttcactaattctctcttcaatatattagataatctgtggttaaagtcatcccattgaatttgtaaccttagttattgattttttaagttctaaaattttcatttaattttctttttatagtttctagttttctgctaaacttctctattttgtcatttaattcctaaacttattaatcataattgtttcaaagtccatatctgatactttaaagtctttatcacttgctggactgtttctactaaccttttctttcttttttttcttttttttttgttcttctgtttatttattttattttttattttttttaattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccagtttcatccatgtccctacaaaggacgtgaactcattcttttttatggctgcatagtagtccatggtgtatatgtgccacattttcttaatccagtctatcattgttggacatttgagttggttccaagtctttgctcttctgaataatgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgtcttttggctgcataaatgtcgtcttttgagaagtgtctgttcatgtccttcgtccactttttgatggggtggtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgacctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttctccattgcttgtttttctcaggtttgtcaaagatcagatagttgtagatatgtggcattatttctgagggctctgttctgttccgttgatctatatctctgttttggtaccagtaccatgctgttttggttactgtagccttgtagtatagtttgaagtcaggtagtgtgatgcctccagcttcgttcttttggcttaggattgccttggcgatgcgggctcttttttggttccatatgaactttaaagtagttttttccaattctgtgaagaaaggcattggtagcttgatggggatggcattgaatctataaattaccttgggcagtatggccattttcacgatattgattctccctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatggagttcactcatgatttggctctctgtttgtctgttgttggtgtataagaatgcttgtgatttttgtacattgattttgtatcctgagactttgctgaagttgcttatcagcttaaagagattttgggctgagacaatggggttttctagatatacaatcatgtcgtctgcaaacagggacaatttgacttcctcttttcctaattgaataccctttatttccttctcctacctaattgccctggccagaacttccaacactatgttgaataggagtggtgagagagggcatccctgtcttgtgccagttttcaaagggaatgctgccagtttttgcccattcagtatgatattagctgtgggtttgtcatagatagctcttattattttgaaatacgtcccatcaatacctaatttattgagagtttttagcatgaagggttgttgaattttgtcaaaggccttttctgcatctattgagattatcatgcggtttttgtctttggttctgtttatatgctggattacatttactgatttgcatatattgaaccagccttgcatcccagggatgaagcccacttgatcatggtggataagctttttgatgtgctgctggattcgttttgccagtattttattgaggatttttgcatcaatgttcatcaaggatattggtctaatattctctttttatgttgtgtctctgccaggctttggtatcagggtgacgctggcctcataaaatgagttagggaggattccctcttttcctattgattggaatagtttcagaaggaatggtaccagctcctccttgtacctctggtagaattccgctgtgaatccatctggtcctggactctttttggttggtaagctattgattattgccacaatttcagatcctgttattggtctattcagagattcaacttcttcctggtttagtcttaggagagtgtatgtgtcgaggaatttatccatttcttctagactttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatctattttgttgatcctttcaaaaaaccagctcctggattcattaattttttgaagggttttttgtgtctctatttccttcatttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttgaaagaacatctttatttctgccttcatttcgttatgtacccagtagtcattcaggagcaggttgttcagtttccatgtagttgagtggatttgagtgagattcttaatcctgagttctagtttgattgcactgtggtctgagagatagtttgttataatttctgttcttttacatttgctgaagagagctttacttccaagtatgtggtcaattttggaataggtgtgatgtgctgaaaaaaatgtatattctgttgatttggggtggagagttctgtagatgtctattaggtctgcttggtgcagagctgagttcaattcctgggtatccttgtggactttctatctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggtatgattttgcagcggctggtaccggttgttcttttccatgtttagcacttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggcccccactctcttctggcttgtagggtttctgctgagagatccggtgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaaagttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacatagttgtcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccgtccagctttgttccgttgctggtgaggaactgcttccctttggaggaggagaggcgctctgctttttagagtttcccgtttttctattctgttttttccccatctttgtggttttatctgcttttggtgtttgatgatggtgatgtacagatgtttttggtgtgggtgtcctttctgtttgttagttttccttctaacagacaggaccctcagctgcaggtctgttggaatacccggccgtgtgaggtgtcagtgtgcccctgctggggggtgcctcccagttaggccgctcgggggtgcctcccagttaggctgctcgggggtcaggggtcagggacctacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcacccctcccccagcctcgttgccgccttgcagtttgatctcagactgctgtgctagccatcagcgagactccgtgggcgtaggaccctccgagccaggtgtgggatataatctcgtggtgcgccgttttttaagcccgtcggaaaagcgcagtattcgggtgggagtgacccgattttccaggtgccctccgtcacccctttctttgactaggaaagggaactccctgaccccttgcgcttcccgagtgaggcaacgcctcgccctgcttcggctggcgcatggtgcgtgcacccactgacctgcgcccagtgtctggcactccctagtgagatgaacccggtacctcagatggaaatgcagaaatcacccgtcttctgcgtcgctcaggctgggagctgtagactggagctgttcctatttggccatcttggctcctccctccttctgtttattttttattaagttctgggcattatacaaataatatagaagacatcatttacggctctaggacaatgttacgttacttctgagagaacttaactatttttttcttttatgtcagtcaaaataggaatggattaccttaatcaagtcagacacaaagattacttgtagctggacttcagttcttcttagggctagatatatttctagatctcctttactctctgtagggagcccttctggttccaaccaaaaccctgggtgcccctcctccttggaggactctgacctctaatttttgtcctttaaactctatgacactgccaaaagctctgttcagcttcttgatcatgccttttgtttaagaaattgacaatgctcttgagaagaacaagcagctccaattgctgggctcatcttcttagttttcttctttcaggtcatggcctcacaaactcttactgtcttggttgcttttcagtgccctcaaacatgtttaacaaaatgtttttcagcatttccagttgctctcatcaggagggtgtttctgaaacatctagttagccattgtcagaagtagaaccccagaacattggccttgagagaaggtggatccatcttttatagccttggtttgctcttaaaatgttttagaaaagacatatcctgagtgtcttagtggtctagcgtgatggtggtagaggtgaagaaaagtgaaacttccagtatatttaaaaagtggaattaacccgttattagttttagatggagatgagagaggaggattcagggctaatggccaggatctggactgggcatctggatgtccagtcactaggataagtggttgggttagtgacactggagcctcaagtcaccacagtaacagaatgacattcaccacagcctagttatgtaaaactctggacagagggaataaatccaggcaaatacctctacgtatgaaatggacctgaaaagaagctttacctggaggaaaccttacctgactccagagacctttttggtttagaaaacaggaagtaacttgtatctgtcagtatgacacttttgaacatttctgtattagtttgctaaggtgctgtaacaaagtcccacaaactatggcttaagacaacaggaatatattctgtcacagttcaggaggatagaaatctgaaatcaaggactgggcagggctacgctccatttgaaggcttagggaagtcccctttcttgcctcttccaggctttctgtggctgctggagatccttggtgttccttggcttgcagcagcatcaccctggtcttcgcctttgtcctacctcaccttcctcatgtgcctacctctgtgtttcacatggccttataaggacactagttgtgggatttaggcctacatccccatacccccaattgattgtgacctcatcttaatgaattacatctcaaagaccctaatttccaaatgaacttacatacgcaagtcccagggtttaggactacaaaatatctttttgacagacacaactcaatccacaacaatttctagtttatcaccgcgtgaagcttagtgctctctgcaaagatcaaatgaacaagtagtgtacttattgagctgttgcttctgacaaagcactgtgtggggaataaaaagtagcgtggcacacagtctctgtcctagacaactttactgtccaactggggagaccaagagtgatgcagaactcaggaggaaaataagctttggttggccacctaccatttaccagatactgcagtgggggctatacatatattgagccatttaatcatcagaatagcttgctaggtaagtggtattcaccctatattacagataagggaactgagggtcagaaggagtaaataactagtattaagtggtgctatcagaatttgaatctagatttgttgtattctaaagcctgtggttttggggaagaaactgaattatgttaaaaaaaaaaaaaaaaaaaaaaaacaaagctgttagaaattaaccataagagagttagtgtgagagctgggtgtggtggcttgcatctgtagtcctagctactgaggaggctgagatgggaggatcccttgagcccaggagtttgagaccagcccgtgcaatatagtgagaccctgtctcaaaaagaaaaaaaaaaagttggtgtggacaaggaaggcttattgaggaagaagaaatttgaagagaaatcatctgaactgtgtttttaagaaagggtaggagttggctggtggaaaagagccaaaaactgattccaggtgatgggagctacgtgaaccaaggcaaggggatagaatatatcagatgtatttaggagaaaatatattttataacactatatataagatacgtgctttatataattatagcctcattcttcatatggagaccttgaagtaagaaaacaaacatttttagctctgtgtctcacatggtaaggtattggtaaagctgagccttctgccaatgaattttttttccattcctcttcagaaataatcgctttccatttaaaaagtaataattcaatttagaaagaatcaaaatataaagtagagaaaaaatctcacatattcctatcatgcaaatatgactaaagttaacattttggtctcttcctcccagtccttgaatatgtatcagtagtatacataacacattaacctagagagtaatcatagtgtatgtgctattttgtgcttttctaccataacctaagcactaatctgtgccataatatgtcatcattatcatagttttatttatttttattatttttaattttgagatggagtctcgttctgtcaccaggctggagtgcagtggtgtgatctcggctcactgcaaccgccgcctcctaagttcaagtgattctcctgcctcagcctcccgagtagctgggactacaggcatgtgccaccatgcccagctaatttttgtatttttagtagagacggggtctcactatgttggccagaatggtctcgatctcttgacctcatgatccgcccaccttggcctcccagagtgcggggattacagctgtgagccaccgcacctggctatcatagttttaaaggttgaataatattctaagtagataatgtaccatgatttacttatttagggtttgttattaatagcaaattaaaaaattcctaggtcaaaatgcatgacctgtgttacaactcctattatatatatggttttctggaaggtcaatattgattttggcatatatagactgggcttctctgggttgttgtaaaagttctatgtcattgaactacagaaagagggtgaggggatttctaacaattagggccagtgttttcttcacctctaaaccgcatccccatcctagtgtctgcttggctttgcaacaccatccttatcctgagagctttgttgatgcctggggatattcagaaattttcgacttggaacccttccaagacatttgctattttattctctatttgtttttcttaagcaactaactaaataagaataacatttcaacctctttctactccccacagcattttttcctgcctgcaccacctctgcctacagtttaaccatggggttgcttcttatattttaaagctaaatacaaaagcacagttctgagaagcagccaagttctgcagccaagtttgaagaataaaactttaaaacagctcttctgtcacacacttgagaggggaggcaggctttgctataaataagtcacattccatttctatctcatcctttgcagtcctcttgggtaatgctttttgtatatgactacagtgttctcgaactgcccactcacccctttcaaccttccattttgtgcctcactttatttaaatgttcaatagttttggagtttagggaccctgcatgaaaggagtagacctttcctttcattcttcaggcttagatgtaatgagattcagtggctaacttattagaaactatactttctctttgtctgtaacgttttcagcagctgcctggattagtttcctattgctgccataacaaattgccacaaatgtaatggcttaaaacaaggccaggcacagtggtgcatgcctgtaattccagcactttgggaggctgagatgggattgcttgagctcaggagttcaagaccagcctggccaacatgatgagaccccatctctatttaaaaaaaaaaaaatacaaaagttgtctgggtgtggtggcgtgcacctgtaatcccaactactcaggaggctgaagtgggaggatcacctgagcctggggagctcaaggctgcagtgagccatgatcgtgccaccgcattgcaacctgggtgacagagtgagaccctgtctcaaaaaacaaaaaaccaagaaaccccacaaatgcattttcttataattctagaaatcaggagtgaaaaatgatttggcagagctgcatgccctcagggggctctaggagaattcatttcctccccttttccagcttctagaggctgcctacattccctaagtcatagccccacatcagtcccacctctactcttggcatcatatctccttctccaactctgaccttcctttctctctcttataggacccccggtgattacatggagcccacacacataatccaggggtacctccccatctcagagtccttaacttagtcccacctgcagagtctcttttgccaagtcaaataacatatttataggtttgtgggattagggtgtggacatctttggagggccgttattctacttatcacactgtcttagaaaaggaaaggaaaataattttggaatttttgtctttttcatagctagggaggaggtacgctgaagttttgtttttccttcctgtatttgtgatggttgatatgtggcaatctaaactaagtctgggatgtctgtttgtattggctgaagttcattggagggcagaaaagaggagagtttcagagactggcagtgaggatgggagggtggcttaaagaccttcacaacctgctcactgggtgctcctgttaggccccacaaacaagcccatgccatcgaggagaagtgaccaagcagatacattcaaaatgaataaaaggaagacctcatttactgtagtcccatccagtgtggcttccttataggactatttgtctctaattattttatttattttttattttttcagagagagtctcactctgttccccaggctggagtgtaatggtgtgatcttggctcactcagccttgacctctggggcttgatcctcccgtctcagccttcccatagctgggactacaggcatgcaccaccacacctggctaatttttaaacttttttgtagagacagggtctcactgtgctgcccaggctgggcttgaactcctgggctcaagtatatcctccctcctcagcctcccaacatgctgagattacagatgtgagccaccatgcttgaactatattttaaaaaaatattaattatgatactaaacaatacagtgaataaataaccttctcatgactgtccatctggcatagtagaagactttatgtgcttttttcaaacaatgagagaaagtgctggcatatcgcacttcccttagcttgagagacatgtgccaatctgcttgttgactctgccaaggcctctctttccgtcattttccatgttctggtcaggatttgtgacatatagtggctgacaaaaggcacacaagtgatagtgttggtggccaatctgccagggaagagtctgaccctgggcgctaatgtgactcaaggtagatgagcccttcgaggagctagtcaaggaaacagatgataaagtctaactatcagtgagcgagcagggggtgagcattttctttctgaagggagttattactgtcattaacttcattgcgttgctgggaaggaggggtcagtagttgaaacaaaagtctcctatggctgatgacatgttacaactttaggacagttgtcagcaagcaacttgctgttgggcctaatctgtccccatgcctttgatcccttgagcctcaggatggtttctacattttgcaatggttgaaaaactttaaaagagaagccatattttgtgacatgtgaacattatgtgaaattcaaatttcagtatctgtatatcaagttttattgaaacacagccacatcatttgtttatgaattatctatggcttttttttttgagctaccacggaggagttgagtggttgtgacagagactgtccgtatgaccggtgaagcctaaaatatttactaactggctttttacagagaagtttgcagcttctgttttcggagatttgaaagagactgaaaaagcatcggcaaatgtccttgttgggacaatatttccataggaaccaagacccagtgattccatgtggtgctgatttatttccaggaacccatggagggtctaactggggagggggtatacaagataaattagaaacaagtgcacattcctgtactacaaaaaatatacaagacctgccattcacccctcaaataatatgtttcctttcctgaggggtcacataatttatgccagtacattattgatgagatttttgtttgtttttttaaaataaaaaacaggcatattgagctgctggaagtgttgagctggctgttctgaaatatcccactaggatattccacttgctggctggctacctccatctcagatgcaatgtccaaatggctgtcaatttctgcaggacccactttgtgccaggcattgggccagtgctttgggcacgtgaattgctcacactgagagcactgctgtaaaatcattgttattcccatgccgcatatgaagaaaggagcttacactgggtaaacccatgcctgggcctcccctgtaagtgggaatcccgagttgcaggtcaggctgtctcttcttcacagaccatgctctttcacaagacctggaaggaacaagacaaccacctggggagctgcttacttctgatctttcctctgggatgccagggctatcacaacctcataggcaagatactctaatcactgagttatggtgttcggtgataatatcgacttccatttttataatttcttctagcactctgcatcctgcatgttatatttgtaaaaggcctgtgaaaaacataaggcagacatatctatttctgctttgtaaatgaggaaactgaagctcaggggtaaagaggcctttctaggctcaaccagcttttagtggcagagccagacctcttgacctggggtctggtgcctgtacactacttcccatgggccaggtctttgggaatagagctgcgtcactcacacttaccttagcagaggctgtgatagactctaagccgtatggtttttagtttatcctcagtgaacctcaggtcatcaactgacctccagagacgaatttcacgttgtagatggttttttttgttggcattactttacaactgtgactctgctgaatgcactgtacctttctctttcctattaccacatccattgcttgagtttcagtcctgtcttagtccattttgtgttgctgtaaaggagtaccagacactgggtataaagaaaagaggatttataaagaaaagagggttatttagctcacagttctgcaggtgtacaagaagcatggcaccggcatcaacatgtcagagaaggtcaaaggagaagtgagtacgtgtgaagagacaccatacccaaagggcatcctggctttacataataataaaccaacctaatcccatctcgccagagtgagaacagcagcccagcacgaagtcattcatgagggttctacgcctataactcaaacaccttcccctaggccccaccttctgacaccaccacagtggggagcaaatttcaacatgagatttgatggggacaaaaaatcccattatccaaaccatagcaagccccaatccaaaccaaaagcagatccccattcgtggttcccctttccacatggttccaaatgaggaagggcaaaattcatgtgttctgctcagtaaaaggttgaaaagttattgggaaacacatcttccaaggtttgtgtcctttgggacatgggaatatgttattaaccaggacagctgctcacagctgcacagggatgtactgaaacagctcattttaagcaaattttaagtagtggagaggatcattcctgggcacatttcacaagcattctgtcttggttttaccccaatctctgcatattccttcttcgtcttcattcccggggcagcttcttctgcccaccccgtgaaactttggcccattcttttctgtatgctgtccaggggccatctcctcctctctacatgctgcattgaggatccccaaattgctatcctctctccaaactccaaatgcctatatccagctaccaaaaagacatctctgtttgaatcttcctcacttaccacaaacataacaggtagaacatagcttatttcttgccctgccaaaactgttctccttctgagcttcagtgcttggtgtagcatcctccacatagttggcatcggaggcagaacctgaacctgattctctttgacaggcctaatcactcaccactctacgcaatatgaaaatgacatgccatgtgaatccaatgccatgtaaaaaaagataacattttctgtttgtctccctaggatattgtaaatgcttggcaccaagtaggtgataaataaatgtgaaggacaaacctgttgattaagcgttcctgagacatatcctttatctttctcagatgagattctctgccacatagcttatccctgtattgggtggattgtgtaactctgaggttcaaacattgggtattgcctctaaaccttgcacagttatttatctcagaactattgagtttggcggctgtccacatcatgtaacaattctgctgttaccttcctttccttgttttcttccttccctctctcctcatcttccacattcctatctgtgagagaggatgagaaaaaaacagacaagaagacaaaccaatatttctctcaccaatgaaaaatacctttccgttctgtttttaccattaaatgtggtatttgccctctgtgtctcaattaaaacaggttatttccttcttagtttcttcttttatattttttttcttgtttcagaaatggttcatgttaattgtaaaagaaaaattccgaaattatagataagccaaagaaataaataaaacatgtaacaaccccctgctcagagagttgtggttaacttttgaagtacctacttccatgcttcttttctaggtacatattttaacagaaatagagacttactgtacttgctgttgggaagcttcttttcacataatagattgagaatattttcttgtgacagtcaatattcctctagaccagcaattggatcactttgtttaaagggccacatagtaactattttaggctttgtgggacttactgtctctttcagctaatcaactctgctgttataagtgcagaagcattcacagaaagtgtgtaaatgaatggacatgtctgtattctaataaaactttatgaaaacaggcagtgagccagatttggcccatgggtggggctgtagtttgcctatgcttgtctagaatatcttttttttttttttttgagacagagtgagacagagtcttactctgtcacccaggctggagtgcagtggcatgatctaggctcactgcaacctccacctcctgggttcaagtgattctcctgccttagcctcctgaatagctgggactataggcctgcgccgccatgcttggctaatttttttgtagttttagtatagacagagttttgccatgttggccaggctggtcttgaactcctgacctcaaacgatcctcccaccttggcctcccaaagtgttgggattacaggcgtgagcccacactccactagaatatcatttttaatgcctaaatagtgttctatcttattgatatatcattatttacttaaccagtcagagtaatagctaatgttgtttgaggccttactctgcgcttgcaacattgcttcgtttgttctatttgcattctgacttacacctgcccacagccctgtgtagtgtaggtattattctttctatttaacagatgagggaactcggataaagaacaggtgggtaatttgcctaaggttagatggttagtaaatagaaaactcaaaatttaaatttgtttgatttttagaagccatgctcttaactactcattatgtttttacgcacgttagtaattatttgcttggataaattcctagaattagaataacacatgcattttaaggttttgatatttgttgtcaggttgatatatttggccaacttatatttcttgagtggtatatagcagggctgtgtttctacacccttgtctataacaaggactcttttgacgctttgctactttaataggtaaaacaagcttcatctttttttatcttatgaatactctctatatttcttctaaggtgagtgtctgatgcatgttctttctccattgttcaataagagcatttgtcttctctattaatttgttggagccttttatgtaagggacttctgtggtttttaagttgatgctacatgacgtgttatgaacatagccttttactttaaggagatgttgtctttacaattgaagataattaaatggaaaagtatttagttttaatgcagcattaattagactcctggaattgaaaaaattcccagaaactgtaaggtaagggaggacttactcctgttggggaacttgtccctttagtttccatctcttaagtactagaatttgtgttctttaattggaaccattgctttgctgtggccatggcaacacatcttagctgccatgaacagcgcacactttgacaaaatattttttttagagagtggcttttagatggaattcattttccaatgtattcatggagtctagatgaattaatggatggtagacccatacttttataataatagtaataataatgaaatgaatagttactatctattgatcccttactgtattctagccacaatgctttattttatattatttcatcggatctttgtgataatcttatgtcatagatattgttgttatccttactttatacataaagaaattaacacagaagagttaagtggcttgctctggcttatacagatggtaagtagtggagtttgaccttgaccttaaccttgattttctactgcgtgagtcttacaggtttattatagcctttagggtatatactgaattcaacagtggtagcatggatggcaaatcttgatgtcatctagagtctaagatgacactagcatcagtgggccacagggaatctgacccagactttcataacttgtattattatgaagattagagttctgaagcttactggattagaagagcacgagggggtagctgccccaatatattctaatttctcttgaggaccaccaaattggcagagtgtctctgatagggaaaaggaagagttggaaggcatcttagcctctaggacagaagaaccatttttattggccaccaaagttacatctagttgcctacaaatttatatccaaactccttatcctgccaattcagggttctgcaaactgatgccaaactatagtttagtcttctatcacatgactgcattatacatacccaattatctgggcaaacagacctgatccaaacacagtttgtactttcctttcctttcctttgtttagcctgttccgtctacttggggtgtctttgatttctccagcctcagtctcccgctgttagaattctgggcctccctcaataccaaggttaagtagtacctaacgaagaattttttatttttacagacaaaagcagtttctctcctcctctttgattcttatggttatttatattactctcaagtcaatcataaccttcttatttgtaggatagtttctccctgtaggacttgcaggattcctcgaatacagtgcttttccaaaggtaaatgacgacataccttaatcttgttgttagggattctgactctgagagacatgaaaccactgtttagagtcttgttatgtatgaattgtgtccccctccacccagtccatatgttgacatcctatccgcccatgtctttgaacgtactttgaaatatgattgttgcagatgtaattagtaaagatgaggtcatacaaaagtagggtggactcctaatccaatttggccgtcacactggaaatttgggcttgcacccaccgagaacattgtggaaagattggaatgatgctgtcagaagccaaggaactaccagaagctagaagagaggcctgaacatacccttccccagagccttcagagggagcatggccctgccaacacctaggtcccagacttccagcctctggaactgtgggacgatacatttcttttgttgaagccactcagtttgtggtactttgttgctgtggccccaagaaagtaccacaagcctgaggttttcaccgtccttacagccagcaagacgggatgtttcagatgaccctgtcctatgtggaactgggggctgaggtggggtggcctgataacagagtcaccaaagagctgcctctcttatctgtactcctgagttctcacagccttctgggcatcttcagcaccagcaactcagcatgtcaaaactgaacatctttcctctccaaaccccttttccctcataagcccatctaaattatggttaccatgtccctctcagtccctctggaattcttcccttttctcatccccaattgaaaaaaaaatctggaattctatgttcttctggaaaataaggaagatctggcaacaccaggcctttgttactgcatggctataattggccagatggatgggctgcccctgaacatagagaatgtgtcctgggtcctgtttgacatcgcatgccagaccctgtgggcattggagcctggcccctggcagggtggaagtgattgcctctgcctcacagggacataagtggaaagcttcagatcattctctgagtcaagctgtccggtttatgtcctgctgtgtcgcttactggctgggggcagccatgggaagtttccttgatctccctgtgcttccgtttcccagtctgtaaatggagataataatggtgctcgcctcataggggtgttgagagaattaaatgatttaatgcgcatcaggagattggaacctgacacgtagcaggtgcacctgaaatgttcccttatattcttatgtagtcaagaaaatcttgtcaccctttatctaaactgctttattatttttcatgacgcacggcatatttacttcttggttttactttgctactctccatcccccaccagcttgacacacattcagaaaatgtggccatagtttatacacatagattcagggctggcctaccaaggagtttggacaaagctcccgggatctcacttggtggagctcctgggcctctcctggctgccgagtcccctgtgctttctgccttctgtgttgtttcggttccagtgaccaagggcacagcttggtgactggcctcccgaggccttccgagtcaccgggggatccctctaattaggtacactgttgagcatgcaggtgtatatcctgcaggcaagaagggctgctgaaatagtagcttaacatgaaatccaggcagcaagtcgggtgttcgttagaagtgtgtttttttttttttgtgatttgggacactgacaaagcccagacaaacctccccacaccaattgtttcccccagctgtattccccttattgggccactcctaagcagtgctgatgacttatttagctaatatttgttgactgaatttttattaatcaatagagatttgttaagtaaatggagcattattcagacatgtggcatcagatccattactagatgtaagtgataaataaagtggtaggtaagacacagtcctgcctgtaagagatgtgcaatctagtcattgagagagaccctatgagaaacagtgggtggagctgggggattaccggtgttgtttatgggatcccagagaggaaggaccctgactcagcctgaggttgggactgggggcaactgggggatcatcagacttgtcattattgatctaatgtcccagtaaaattgggcgttttcaggacagggactgtgactgtctttttattgctctatgtcttgtcctagcccagtggttgacatataacagacggtcaataaacatttgatgagtaagggaattaagtgacatctaagctgagaactgaaggatgaggagtctgccaggaggaaagtgtgggaggtaggggaggaagggggtggcgggaggaagtaaaatgatgacgaaggatggtacagggagggaggagcatgtgctccttgagggtgacaaggactgcagttctgggaactgttagcttgtatggtgggtggcatggagccatttcaaggtgggggcctgggcagagctgaatggtgagaataacatagagttcttagtttttacatgatgaggtttgatatgcatgatccaaggtgcaggaaatggattggagaggacagggtggaagaggagaggccattcgatggctattgcagcaatcttgagagatggtggtggcaggacaaattactgacacctgagatggagaggtgactagattcagaagcaactagggatgtagaattgtcagaacctggcaattaggtgtctgtggggaaggaaggagagatgtatgaatgatgctcaggcctccaggggatgtgggcaccacttacttgtgatagatgagaagaggagctgtgagaaggttaaattcacacttgggcatggtgagtttgagatgcctgtgggaagtccagagcgcagttgtatacagcaggcttcacctccagagagtgatcagatttgagatacaggtttgaacactcattggcatagagggtcagggcttcatagcctagaaggacatagataaaattaagaaggcctatgaacttcagaaattatattaaaatcataatgcatgtgcattgttctgaagagctagctttgtatcaacttttcaaaatgtctgtgtcctcaaaaaggttaacccttggtgcatatggttaatgaagccagaaggagagatgagatttttcaggcagcaagaagggaagagagccagggtttgtgctgcagaaaatatcaacatttcgggggtgggaggcactgtgctgagtcagaggcctgggggtcagagttctgggaatgagataaagacttacaggtagcaatagctttactgttcataaagcacttttacatacaatgccattttatctctcaggaactcaactagatctttataatttggctctgtatcagttagagttcagtacaagacatgaaaacttggctataaattttaaagaagggatttcctagagggaataggtgcttactatggacccagaaaatctgagataggtctcagttaatgtagaaagtgtattttgccaaggttgaggatgtgcacccatgacacagcctcaggagggcctgacgacgtgctcaagctggttggaatgcagcttggttttatacagtttagggagacatgagacatcaatcaatgtatgtaagaagtacattggttcggtgtggaaaggtgggacgactggaagcaaaggcaggaagactcaaagcggagagggagcttccaggtcatagataggtgagagacaaacagttgcattattttgagtttctgattagcctttccaaaagaggcaatcagatatgcatctatctgagtgagcagagggatgactttgactagaatgggaggcaggcttgccctaagcagttcccagcttgacttttccctttcacttagtgactttgggggcccaagatattttcctttcacattacaaaatctctggaagggcagccccagggaaagattcccagaacaatatagaactaaggtcagagtacatccctgtagctgccaccctggcatcgaaaagctgggactggaaagccaccatggctgcagctctttctcggccttcatggagctgaaggaaggatgctggacactactgtattaagaaatctgttttcgtgacctgccttgatagcagtgaacagtcaaatagaagccaaagcatggccctcatctcacttccaccttctagaactccttgcttgagtacatttaattagtggaatccacttcagtcctgaatctctagatgcagagaagtctggaagatatctttataccacctctcttcctaaaaggagtgtgaaatggagctagagaaggggtcttattttgtaagggtcaagttaagaactgtttcagtcttagtgagccatgtggtctctctgcagccttgccattgaagtgtggaagcagccagagaccatacagaaatgagtgagcatattgtgttccaataaaactttatttataaaatcaggcctggcacagtgtttcacgtctgtaatcccagcactttgggaggctgaggcaggagtgagcttgattgtgccacagttctccagcctgagcaacagagtgtgagaccctatctctaaaaaataataatgataaagttagttaattaaattaaaatgagtgatggggcctaaaggccacagtttattgacctctgaggtaagcaaatcaattctcaataattatcgtaggttcttttttacagatgagggaattaaaaccggagagcgtcagtcgaagtgaaaataagtcctggttatttagttttcaaagttcatgttctccaggaaatcctgatgctcagcctctcctcttacaaggcttgtgatctaaaagaggagataaaatatgtactttgttggtgcagaccatggtaaatgctcccgggatggtgcggaatgcttttgcatacaaggcatttttgacaggagaaatcagaagtatgatggtgaaagtagttttagctagatgttgaagaaaggtataactctaacaggtggagatggagaagggaggagtcaaaagagctgatagggtttggctctgtgttcctgctcaaatctcgtgtcaaatcataacctcaatgttggaggtggggcctggtgggaggtggttggatggtgggggtggatccttcatgaatggtttagcaccgtccccttggtgctatccccgcaatagagttctcatgagctctggttgtttaaaagtgtgtagcacttcccctctctctttctcgtgctctggacatgtgaattgcctagctcccccttcaccttccgccatgattgtaagcttcctgaggcctccccagcagctgagcagatgctagcatcatgcttcctgtacagcctgcagtgcatgagccaattaaacctctttttttttttttataaattacccagtatgaggtatttctttatagcagtatgagaactaatagagaatttttgatggagtcaaaaactgcaagagaagtttaggaaaacagctagaaatggaaactcatctgaacattgtgaccttctatggtgttagtggagataagactggatcagggagaaccttagatagtaggattaggaatccgaacttggaaaaggggaagcactgatagtcttcgagcagggttgtgatacacacattacctcaggaagaattatctggttttgttctacagaattttgtgtaagtcagaagatacagccagcaagaattcgctcaggcggttgttgtaatatctttacatgaggatgcaaaggaagaagtggacatgagtcttgggccattcatgggacagggcaacttgtaaatgtaggtggaatagaaggatggctttgatgggaagagatgaaatgaataacaatacttgggaaatttgaggaatgggagcttgttttgtgggtaaagtaatgggccccatcttggatatgaggtgctgaggggcagaaacggaaatatggagtaggcgattggaaatgttggcttcatcttcaagatggggttggttgggagtcatcccatacaggtggatagagagccaagtaagagctcagctctctgagggagtgtgtacagtggaggatgccggaaggagaacccaggagacaaaggtattccagaactgggagagggacaagagataggaaaatgtagtaggcagggtagtgagagtggcaggatggatgttgtaccagaggagtcaagttagggagctatttccagaaaaagaaagagccaggaatgttgcatgccacagaaaggtcaagaaatactcgaaaaaccactggatttggtgaccacatctcaaggtcatgggcgaccctgagagagctgtttagtgtgtgttcttctcttgaggagtttcatattgaaagaaaagaggagagaaaatgggagattgaaatttgtggcttgttttaaagtggattaattcttcagtgccagaagaccacaaagaacttggtctgagaatatatcctgatttctccccaagacttttcttaagaaaaagcaagttgaaagaggaacaccctttagtttcgttctctcttgatttcaggattcggtttttggtcagttgtttgtgtctgactccacttttggccctgtcgtggggccgctcctggcaacctgggaggtcacgcacaagtgtgtgcagttgttaagcaactgctcgcagtcgcggtggccctgctaaattgggaacatgtattcgtcccagtctgagtcttcattcagtgggaaacaatgagtccctgactttgaaatctcagaggttacacatttgtggaatatgaaatcagtgtgttgatgatttttcctacctcatagaattctttaaaaataacactggagaattgctatgcaattctgtgaaaatttagttctctctagggccttttctagaaaaaacgttatgcccaaatcccaaaaggaactgagtattttatatcaatgctttctaagataaataaaaacagaacacacacacacacacacacacacacacacacacacacacacacacacacaacgcagcaacaacagcaaaagtcaataaaacaactcaccaaactaactctagagtttcagatggaaatgatgttatcagtccaaattaaagacatattctcttattttcttttacaccttggtttgtggcttccataatacaatcatctgagtcttgtatggtttctgaaatggatgctagaagagataacttgaatgagtacttttcccctggtggaattctcttcctcatctatatttaaacagttgttttgcacctaaagggccctaagttacgtttctctggagatatttagagataagaagtgttgtaagtactctttcacatttgtgcagaactttagtctttgaagtgtttagacatccattaatctttttttttttttttttttttttttgagacagggtttccctctgctgcccagactggaattcagcagtgcaatctcagctcactgcaacctttatctcctgggctcaagtgatcctccctcctcagcctcccaagtagctggcactacaggcctgcaccaccatgcctggctaatttttgtattttttgtagagacagggttttgccatgtcacccaggctggtctcaaacaatctacccacccttgcctccaaaagtgctgggattacagacgtgagccactgtgcccagcatccttaatctcattctacctcactttctgcctattgagagataggcaccccaagtaggaagtccaaatgctgataaagaaattgggattcagagtgacttactaactagccccagatcacacagcttattagaggcagattcagggctaaaggtcagattttccagctgcagatttattctgctttgagtggcattttagacattagtgttttctttaatccttaagcatttcagtgtctaaggtttgtataacatcaggttggtttctggtagtacgttgattgtggagagggcccagaagcagaaaccacagtctttacatgatagttactcttatctgaggtttggcctttattgaatggaagtctcttgttaaagaagggtatgcattgaggcaagagtcttgccaacttttcaaaaaaaaaatgggaacccctgggctccttggggatggctaatgacaatgattatggaggaggctgcaaatgtgaagtactttataaatcctggaggtgtggcagtagactgtgtgtttctggggagacagatttttgcatacattatcctctggacacttctgcctttggtgcatgcttgtttttataaaaaagcttgttttgttcctcctgtagaaatgagcctatcatctagagtcatggtggttttctgtatgtgtgagcttatgcttcagttacactgaacactcgtactactgcaaaatcgaattcagtgacattgccaatatcttcgctctcagtagtctttaaatattcttagccctgggaactggcccaagaaactgcttattcttttccctgtatcacttagcatataaatcctgaattactgctgactgaagatacataaagtacaaatcaataagtattttgtttctatattttggagaatgagacaatgagtgaaagagaacccctcaatgagggctttaaaatattgtcattgttctatggattagtagagctgcggctactattttacttacccactggccaccaggtactcacactgcagtgaaaggattcctaaaaacatctttattaagatattcacatactatacaatccacccatgcaaaatttaccattcgacgttgttggtatattattactttgtaaaaatcatggccctatgcacaacatacaacttgccactttaatcattcttaatgtacggttcggtggcactaattatgctcacagttttgtgcaactgtcactgctacctatttccaaaactttttcatcatcccaaacagaaactgtgtacttattaatcaacacctccccgtgaaagaatttttaaacataccttgattattagctttggatgtatataaaacctttaaggaagattttgtttagtctgttttttttcagggaaagtttattttttaaggggcagttccatacagtaggtgacacaggttaggttcctccagaaagcagcctcttatagtagcatgtgggacattgccagagtctcaggagcaacacttctaggggatgggggaagggatggagggaggactgggtaaaaggagaacgtgtactgtgttgtcattggaaggcctcaccctacccagtggaactctggaactggcatttcccaagttggggcaacagggatggatctttgtaccatatcattcagtcatagggttcagctcccaggacggcgcatgagcttggacaaattctctccagccaagggtcagagaaggttgacagctgagagctaagagccagcagctgaggggtgaaatgctcagtccatactttgccaaactttgctctccactggaatcacctttgcatcctcaaaaatactacgcctgatttaattggtatggggtaagagacaagtggaatgcttccaaagctccccaggaggtttgaatgggcaacacagattgggaatggctgctttcagtcttgaaggggagtcagcatagtatacatcatcatgggaaatgcctggactttggattgaaaaaaagttgaacttggctcaaccatttactgacgttgtagttcttatttatgttctgttaagattttgctactaggctttaaaaaatatgaatggatggtgcacctgggtggctgagagggcacttacaaattaaaacaaaaacagtgaacacctccagaatttgatagaacacaagaatgcataattcataaagaagaaattcaaatgctttttaacatttgaaaatatagtcttaatagcaactgaaagaatgaaagttaaaactatattttgcttattatattagcaaagatgaaaaataattgctattgctcagtaatggtgaaggtagtggcagaagacactctcaagctcagcacagtggttcatgcctgtaatcccaacattttgggaggccaaggtgggtggatttcttgagctcaggagttcaagaccagcctgggcaacatggtaaaaccctgtctctacaaaaattagccaggcatggtggcatacacctgtggtcccagctactcaggtggctgaggtgagagaatcacttgacccccaggaggtggagcttgcagtgagctgagatcatgccactgcactccagcctgggtgacagagcaagaccctgtctcaaagtaaataaataaataaataaaacaaacataaaagaaggcattctgatcctcttggtatgtccattggtgtaacacgaatggtggaccatttggcctccattcatgtgtctaccaatgcaatgtagataaaaattcataaaaagcgaatgccttttgacataacaaatctaattctagaagtttatcctgaggaaataacagaagagtatgtaaaaatgtgtgcataagttgtaattgcctgggtcttgctggcaattaggagaagcacaaatggtcattaataaaatattggttaaataagttctggtacatacctatgtacttctaatgagagaagccattaataaaatagtgtgagcctatttttgcattaaaacatttgcattgaaaaatgactttgagaaaaatatcagatgttaatggtaaacagtgtttttccccctgagtataagaattatgggtgaattttattgtctaactcatatctctttataatatttatacttagaaagtattacatgttatttaattatgtgttaattttatattcataaagagcatagagctatttccaaaaattacatatttccaagattacacacctgcatatctctatctatctatctatctatctatctatatctccctattcattcagcaacctaaaatgaaacagcctataatccaattagtagttatccctagaatttgaggtcacgggtgatttttattttctttcttgtgcttatttatactttacagatttttataatgagatcatatctctcttataatgagaaatgttttaaaaaagcttttaatatctcagtgcacttgcctgacctattttatatccattcttgcatctatttcatttgaagggtcctttggatagcatttctttctccatgtctttcttcctgctgtcctatttaaataatcacaattctgtgttgaaatttttgtatgctttacctaattaggacaaatattctgactcttgcatttgttatcaagatgtacatttttactttattcattattgttttttttttcttaagcaaagtttggcctttagatgatgcatttccaagcctagcatccatcatctaccattatgcttttgactcatctattaaatagtaatgtgtcctccaaaaatattgatgttaaattaaatgactctatatttgtccttggaaaaagctttgaggctataaaatttaccaagcaggtaggacatgcaaaaagagaaatgcatgcaaatgcttcctataggcaggagctcttcaatgtgtctgacaaatctcatctatcctttaggtcctaaattaaacatcacttctctgtgatgcccaccttgactttcccagggtaagctggtgctgacttctccttatgtttattatgcctcttattaaatcttattttaagtagttattgatgtctaccaatgcattagaccaccagataggaaatatggttgccatccaccaacactcttccaacagtccctacctcctcatattcaagcccctgacaaatagatgatgacagacgcgaccatatgtcacttccaagattaggttttgaaagacagaggtttccgtgttgggctgtttctcttggcccactaacctatggaaagctagctgttgtgacgataggcaatgtatgcagagaggctcatgtggcaagagctaataaaaaatggaagctggccacacacatgtgagtgagctttgaagcagatcctcccccttgtcaagccttcaggtattacaggcctggccatcagcttgattgcaaactcataagaaactctgagtcaaaaccgtccgtctaaatggctcccaattcctgaccttcagaaaatacgtgaaacaataaattcttgttgttttcagttttgagttttaggatagtttattatgcatcagtagataactaatccacattggtactagaggtgcagtgcttatgtaacaagaaactaaaatgtgataggactttgaacgaggcagcgggctgtggaaaagctgtaaggattaaggaccatgttagtaaaagtgtaaagtgccttgaacacactgtccatagaagtttggactttgaggaggctgccattgaaggcttcaaggaaaatgggagaaatcctattggaaactggaaaacagagaatctttgttacgtagtggcaaaaaaaagaaagaaaaattaacaacactgtcacctgcagtaatgtagaaagtagaaaatgtgcctgataaactggtgatatagttaaggagatttctaaccagagtgctgaaagtgctttctgattttttttttttcctgttgcttagagtaaaactgcaagaagagaggagaaactgaaggtaaaactattaaataaaaaagagccaggacttgctggttttaaagattcccagcctccccacatggtacgtgatgctaaaattaagaaatggcatctgagcaaagaccaaattcagggcacttttaggaaaacaaggtccaaacattaagccaaggatgcgactataaagtcttttcttaacatctcagtaaacaaagatagtgtctcagaatactgtttagtcagaaaaacctaaagatactaagacaagcttgtccaacccttggcccgccggctgcgtgcaacccaggatggctttgaacgtggcccaacacaaatttgtaaactttctcaaaacattatgcgtggacctttatttttatttttattttttagctcatcagctattgttagtatattttatgtgcggaccaagacagttcttcttcctatgtatctcagggaagccaaaagattagacacccttggacgaagggcttgccttacagatcctctctatcaaccagtagtgctccctggaagctcacagacattgtacctcagtccaagctcaagaaggacctgtttcaaagagatttgtgggtgtggcttttgtgtagtggaattaagcctaaagggattcccagaagacccatggagttgaaagggggttgtgcttgaagaaacaccatcagctggaaagaaaagagacataaagagtacaaaatgcagagaggcctttggaccaccaagtgtcaacaagtaaaaagcagactgagaaaactaactccccaagcacatgttacctttcatgaaaatgaaaggatgcctgagagggcacactcaagatttcaaagggtgagactaaagccatagagaaatattcctaggccttaattagagaccaaatcaaggagcttccatcatttgcttgcctggatttcagaactactatccttgcatacttcccattttcccctttgtgagttggagtgtctatggcagttatcctctccttatcctgcccttgcatgttgggtgcatggggccagataacttgtttctttatttgcacatgcctctatatcaagaagaaccacattcaattgttgtatgtcagagactacacccaagaaggctgatttagatgatgagggtctggacttggaactgatgctctgttgggatgagacttttggggacagtaggaggggtgggagtccttgggagccaaagggtgtcctgtgttaggcagcctccaagatggctccctttgatctctgactcctggactcacagagttgttaatcccctccccatcccacattgtactagggttggcctgtgtgaccaattgcaaatggcataagtgatggtatgtcgctctcaatattagtttattaaagactgaagcttccattttggtcctgctctaatcccgtgctttcctggatccctcacggtggggaaagccagctgccataagttgaggacattcaggcagtctggtggaggcccacatggtgaagcagttccagccaatagccatgtgaccctctagttccaatcaaggcttcagatgatgcagaccagattgacagtttgactgtaacctcatgagatactatgtagaaaaaaactgctgtaggccttagacttctgtacttacaaagacttcttgcaaaattggcttggctggcatccaggaatttggatttaggggaggcctgacaccatttcctaatggataagagtggttcactgtgcctaaactgtaaacaatattatttatgctgagcacttgctttccatatgggagtcttggatttttatatgtgctaggcagagggtgtgtaatgagcaaccctcagtaaaaaccttgggccaggagtgctggcttacgcctataatcccagtgactcaggaggctgaggcaggagggtagcttgaggctgggagttcaagaacaacctgggcaacagagcaagatgccatttctgaaaacagaaaattagccacgcatggtagtgtgcacctgtagtcctagatactcgggaagctgaagtgggaagattgagcccaggaagtcaaggctgcagtgagccattaactgtgccactgaactcccgcctaggtgacagagtgagaccccccaccccaaactctaaaaaaaaacagacaaaaacattgagcactaagtctgtgataagcttccctggtagacagcattttccacttgtcacaatacgatgctggaggaattaagcccatgctgtgtgattccacagcgagagaactcttggaaacttgcatttggttccttgtctggcaaagagaaaaggtgctgattttgctttatattcttttgctataataaatcctagctatgaataatattatatgagtcctgtgaatcctcttagccatcactgaatctgggggtggtcttgaggacctccaacccagagctcctgagctaggagcacctagatcttcctagaccctcagaaaccataggataataaatatttgttatgttgaggcactgagttttggagtagtttgcttcacagcaataggtaactaattctggaagccagtcatttctctcttcccagcatttagtttagtgtcttggaacataggtgttaaagaaatatttgttgagtgacttgacactatttctgcctttgaagaagttcatagtccatttggttcctttgctggaggaatctaaatcctggcttggtattatgaagcaggcttactctcttttttctgtggcctagaagaatcaatcgcagtggcagcagcctgccttaacgttgtcaggttctgccatcttccctgttgaatgagatccatgggtataagaattagtgtatgaccatgcctcttctcttttactcacttcttaggtcctttgatttttattttctctcccttctatgtcatggcagtggtagctattcttactattgaaataaaaacttcttcctgctgaaaaattaattaccaaatgtttcagggccttataagatattaatatttccatatcgagtcttgcctcttactctatcatatgattgccttgaggaaagttcagacaaattaactttccattttacattgcaccccactttcccagcttctgcaaactgtcttgaaatagactttatagaaagataggaaccatttccactaaaatgagtttaatgtagggaaaaaactcaaagtatacactgaaagtagacttctttgagtcatttacagttaaaaattattttaatctaaaggtgtatttgagtgtgtgcacaggtatacacatagaccgccccccaccccatactcattcctgtggcacacttcttgctagttgttggcactgttaaataaaaattacagggggccatcgttttggactaagcttctgcacttggccccaacaaaccagattgaaaatcaaaatggagtcactcatgctaaagttccatgtcaccttccaataaatcaggggaggaagataacaatctaattttccaaacagggcagtttcaatcttcaatcagcctgatgaagttctctctgctttaatccttacaacaaaaagtaacctgaaggaacgtgatgttaactagatatttttttctctattgttctgttttcctgttcctggattacaaagaaagtaactatgcaatgaccaattgcttttgttctgtgtttctgctttctctagcccttttctgcttacaaagccaaccatctctgcccactcattgcagcacttattaatggcaaaaccgcaatacttttgcaccaaaatatttaatggaatgaagtgttgttctattctaaaattgcaaataaagctacttgagctcctgaaagtaaatttgttgtaattttgtcctttgacagatccttttcctcctctttgagtctccttccggttcagcagatgaccttggttatgagtttcatgagaatcccagggtgatctaatagaagctctctcatttatcttctttccatctaattttttacaatttttattgttttttcttgtgtcagagaatcatctacctttgtttcaaagggttctagtcctgctttcaatcccatatacttgggcctgatggatctttcgaaagtgaaattgtggcctcatgatggcatcatttgaaagcctccgatgactgtttcccgaggagggtgaactttctctccttacctgctcttgctttcctgcctccattttgctcatggcattcccttgaattaggttctatgagtggaatacagctttgaaggcaattccagagatccaacaaaaacccaggagattggaaggaattcatatttgtcaaaaaatgtgtagctcaaaaatataaaaaaaaaaaataatgcaaataaaacccaatagagtataacaactatttacatagcatttatattgtattaggtattataactgatctacagatgatttaaagtatagaggagggtggcataggttatatgaaaatactacaccactttatattaatataagagacttgagcatctgcagattttggtatcctctgggggggtactggaggcaatcttcctgggatactgaggggtgactgtaacttattttcagtactttggtaatagtgtatttaacggtctattgtttctcagggtttgtggatgatagtccattaggatctgaaaataagatattagaagttctatttacttttttttgtttttctgaaattttaagtgtatatgaagttaagggaatacatgtaattttgaaataattaaatattcatgtttggaaatctgttcaaatttttgggtggctgggaacacaaccaaaaagatatgaaaaccaataacaattatgtatcagtaggcattttataaatagtctttgatattattttggatataagtgatttgattggcacttctcatttaattgcttattaggtgggtttctgttttgtagagaacatttaaaaaaaatttagacaagcaaaagttaataaaatcacctgtggtatgaccactcagaggtaagtataatgaatgttttattgtatcttctttgcagctagttttctatacacatagacatgattttcttctaaaaaaggaaagatcatgatgtatttataatttgtaaaacttttataccttgctctttgaactttaaagaatgtcatgaacatttccttagatactaaactctttccccatatattttaatggccttattatatgaacatataaaaataatttattttgataccttaattcatgtgctgttggatttttaggctcttgcaccattttccccacttctctgcttgctgttataaacagttctgaaaaccagatgctgttagccacaccatacatatctgtgatgtttcctgacaagattcctaaaagtagcaccttcctttcataggtgaggttttacctctacctttgttgtctgtctctaaggcaaaggcaattttgtgtaatggtgaagaactcaggacagaatttgaattgtgcctcaaccagttactactgtgtgactctgggctagttgtgaacctctctattcctcatttcccctcatctgtaaactgggggaaacactaataccaacattgctgggtggttgtgagcaaacaataaacaaataatagtgtaagcaaacaataaattttagcaattgtttataaggtatttctcttgtcaagtaagccaagttaatcatctaatggctcctataaaataaagcatagggccaggtgcagtggctcatgcttgtaatcccagcactttgggaggctgacgtgggcggatcacctgaggtcaggagtttgagaccagcctgaccaacatggtgaaaccccatctctactaaaaatacaaaaattagctgggtgtggtggtacgtgcctgtaatgccaactactcgggaggttgaggcaggagaatctcttgaacctgggaggtgggggttgcagtgagccaagatcacgccactgcactccagcctaggtgacagaacaagactccgtctccaaaaaaaaaaaaaaaaaaaaaaacaacaacaaccataaaataaagcatagttatagtattcagtaaggtgaatgacacattaatgactccattttccatttgatcagttcttacatccaggaaccatgaacacagctatctcaacatatggtagtttatagggatagtctgtaatcttgcaaatttaaaaggtaaataggagtccttcagtaggcagattcatatattgacaaatgaaggaagaattagtcttgttagaagaaacttgccatttcgtttgtgaacaatgtagttaatttatcacaggctcagtgagggcaaggatggagctatttcactttactatttgtgtacagatccagctcttgggccgtggtaggcactcagtgaatatttgtgaaatacataaatattcatgagcaaatatatctatactttgttgaatgtattgcaatgtatgttgtaaacataatgaaggctttgtgtgatgaaccgacaattgacaatgaaattattgtctgcaaagtgggctggggccttcaggcttttctcctgattatagattcagaaataatgcaagaggctgttgctcaaagtgaatcccttactccgtgctggtcgtgttctttaattcatgtgctgttcccttgtgtgtgctcagtccttattgcagctgctgggtctgagctcactgtgaaaatcgtgtttcctttctgccgacccatagggctcagtgtttgattaataagtttcccattttctgagaaaaatacctaggtaaatcccccttggacagcacaaggatctgcagtaatttacaaccaccgtgtgagccttgtgttgaatgacatgctctttgtaaggatatggcataatttataatgctggccccaacgtccactcctagggcgttctcagtgcagtgccttgactctgatattggataatgttgacagttaagagaggaatgactttagttgctgctgctgaattaaaaaagtcagacacacagtctaaatggattttgctgtcttcaaagtagtgaccttgggatagatagaactctttgatgcttccattgatgttgctattgccccaaacatttccggaatcctttaaaaattacctttaaagcatgtggcacattcttgtgaatatttttgagtctaacaaatactcattctttgtatgaggctttgatttttggaaagagtgaagagtcactggcatcaagtgcaacaactgaggtgggtgatgagggcagagagtgctggttttgtttagggcaacatatggttttagaggccttttaataatgtcatgagacttgagcatttgttctaaacatgatttccttttaaaataatgtttgaaatgatgaaatagtccaagcctacagaacacaacattacatgccagataggcacgttcccagcatggatgttaaacagatgttaacgtgctgtgtttgtttgcgtgtgttctttcatcttgctctccttccctgttttttctttgaaagacagtgttttagatattcctaaacaccccccgcttccctccatacccgtctgccttctcccctttttccatcaatattcatacttctgccaatgttgccatgcttcattcccaggtgtgcttgtaccttttgaggaaatgtttagaaatttaaaggaattatcttgtgtgtgtccttctaacattgtctttgaggtttatccatgttgatttgttttaactgctgttttagtccatttgtgttgctataaaggaatacccgagactgggtaattaataaagaaaagaagttcatttggttcctggttcttcaggctgtacaggaagcatggtgccagcatctgcttctgctgagggctcccagctgcttccactcatggaggaaggtgaggggaaaccagtgtgagcagatcacatttcaggaggggaggagagaaagagagagaaagggaggtgccaggctcctttcaacaaccagctcttgagggaactagtggagtgaattaactcattactgcaagggcagcaccaagccattcatgaggaatccgccattatggcccaaacacctcccatcagttccaacctccaacattggggatcaaatttcaacatgagatttggagaggacaagcaaaccaaactatagcaactgctccataggattccagtatatacgaataaatcaagagtcttcatctgttcacctgagagaaagttcagatgctttcaccttttttgttattacaaatagtgatacagtagtaactgtgtgcatatctatctagaaatatgtactagaggttgtctagagccagtactcagaggaaaaatggctaggttctagaacgtgcacattttaacttagtggacattaccaaattgctctccaaagcagttgtaattatgcttccattggtggtttcccatatcctcttagttatcagatttttaatttttgctaatccgattggcacagaattgtatctcattgttttatattgcatttctctgcgttctagtgtgattgagtgtctcttctgtactcagtggccgtctgagtttcgtcttttgtgaattgcccatttatattccttgctagtccttctattgccattggcctttttattaatgatttataagaatcatttataatctagtattctttgtcagtttaatgggccccaaatatctttactactctgtggcttatgttttgactttttatgatgtctctaattaaacagccgtgctaaattttaatgtaatcatatttatccatttctcctttgtggcttgtacttttttatgtgtttttaaaaagaaatactgctctatcccaatgtcataagaataatttcctatacattcttttaaagttttcaaatgtagtgtttcacagacacttagaattgatttttgtgtatatgtaacattggaatccacttttatctttttccatatggatgtccagttgtctcagttacatgtatcaaatcttttcccactgtcatacaccacattcccaaacacgtgtgactgtgtgtggcttctgttctttattttatttttatgtttatttttattttttgaaacggagtctcgcactgttccccaggctggagtgcagtggcttgatctcagctcactgcaagtgctgcctcgcgggttcacgccattctcctgcctcagcctccagagtagctgggactacaggtgcctgccaccacgcccggctaattttttgtatttttagtagagatggggtttcaccgtgttagccaggattgtctcaatctcctgacctcgtgatccgccctcctcggcctcccaaaatgctggaattacaggcgtgagccaccgcgcccgactgttctttgttaatggtgtgtttgcttactctggctctaccctattttaattaccttggtcttataggtttgggtagtttaagtttcacttcagttttcttttttggaattttttttggctattctaagctcattatactttaaactgtattttaggaatgtggaagccctattgggcttttgttggaattactcagatggtttacagataaatcgtaagaatttgctctcttatcctgggtcttctcatctacaactatggtatagctatgtttatttagttctctttttaggtctttcagtagaattttgtaatttttgccatacttttcttacatatctttgttaaatgtctttgtaagtatctcatttctttctttcatttgttcctttttttgagataagatctcccaggctggagtgcagtggtacaatcatagctaactgcagcctcaaccctcctgggctcaagtgacccttgtgccacagcttctttctaagtagctgtgactacaggtgctcaccaccacatccagctgatttaaatttttttatcccacattttttgttgctgtcaatgatatctttttattgtatcttttcctattattgctggtgtataggaatgttatttttgtatatcttgctgaactcattaattttcatggtttagatactcatacattatgcagacagataaaatcttttaataataatgacaggtcttttccttttcatgttatgtggcattcacttctttttcttgtcttgatgtactgacttggactttcatgatatcacctgtttttgttaataaagttttattgaaacacagccacatccatgttgtctgtggtaccattgtattataacatcagagttgaatagttgcaacagagactacctagtttgcaaagcctaaatacctgccttcaggctctttacagaaagtttgcctatcttcacaaaacagggttgaacagaggcagtgatagtaacctttcttgtctcatccctggctttaaaaggagagcttgtgccaccaagaataagtgctgcttctgggttggttgatgtgtgccttttattgggttaagaaaatgtcttttttttttcttcaacttttattttaagttccagggtacatgtgcaggatgtgcaggtttgttatataggtaaatgtgtgccatggtggtttgctgcacacatcatcctatcgcctaggtattatgcccagcatccattagctattcttcctgatgctaccccacacctcacaggccccagtatgtgttgcttcctcccatgtgtccatgtattctcattgttcagctcccacttataagtgagaaaatacagtgtttggttttcttttcttgtgttagtctgctgaggatgacggcttccagctccatccatgtccctgcaaaggacatgatctcattcctttttatggctgcatagtattccatggtgtatatgtaccacacaagaaaatgtctttcttagatttgtaggaagtcttttcttgtttgttttgttattaaaaaaaatcatgattgaatgttgaattttatcaaatgtagttttggcatctgattattttttctctcattttaaacatacgcaattatattcttttgaatttttctattatttctagtccttggggctagaatccgcccctttgatgtgcttttataacttgtgatctcagtgggtctcattttttctgtaggaattgtctgcagcatggattgtgggaattttgctctggcattttccctgcccattcattagtccaggaccaatttttatgtgaatttctcagattgggcatttccggaccatataggaagcctaaatttgtaccgccaaaatgttccagaggcggtggtctggagtttaaactttgcaagggaaggcttttattctcctcccttggagacagacagaaacatacgagtctctttgtggttgcagctctttgaggagcctcactcagggcagcagccttctacctcgggcagagcccacagactttgcctgtttctcctctgtgctagttgaaatctaaatgcctactccccctggaccaatacttgtttctctccttctccctcaccatgatcctgtcactctctaaggggagtgaatttatgcttgcttctggttttagttgttgctttgtttctggcacctggtaatttcttctttcttattgcaggttcagctatgaatttaaaaatatatataatatttccaggtgcttgtaggaggtgagtgtgaatgtgtgtcttctcaccctcttgctgaaatgagaggctgccctctaaatgaaatttcaatattgaaaagataaaacccaaataaaacaaaaagcaaccccccaaatcagctccctaaccatgagccaggcagcacgtgaagtcctttgatattagctcatgccattcttatagaaactctgtaactctttttaagtggagaagttaagaaactggcccaatcccatgtcagggcagagccaggccaaaaacccctctgttttattggctgttacctcattttacatgtctgaacagtaataacagtgggtgtcaagtgtacctttcctaaaggtaactactacaaaggtcaacactattttccatctaacactcctaatatatttttacacattagtctcacctggtaattctaagatagaataatgatcatgcttgtctgtgagaattagcaatttttttcatggatttaagttcaagaaaaatcagaaattagcagttcaggagttttcaacatttgtaaaaaggcagatgggtgcaccattagcacttccttctgagtgaggtagatctccagggaattaataggaacccgttgttttccatgttggcaagatattagagaaatatgtcttactctcaggtttactaagacatgttttaaagataatactgtcatgcatgtggcttatggaaggctatagggatgtggatttttatattctctctagatttatttgcccatactctgaaatcaaggcagacggtaaaggtggagtcagtggtcattctgtttttttgattaggggtttatagatggctgacattttaatctcagttaatgactggggatggactccagggtccttcaccacagctcacccttgtttgtgatctaatttagcagcatcttgatttgaattgaaagacagccttgggaatattagctcggcccttgtgagagcattctggaatgctgcatattacctgatgctacctgagatgtaggtggttgggcagtgacagcctctctgagccctgacctgtcggggagaggttgagaagtggcaaaactttgattctaccagctgcaaagaccgatgtcaccatgaagttatattaatgactttgacaagaattttctcagtgtacagtaggcatatttgctgaatgagctgatcttgtaatcccagtatatctggagtagtcaattatgaattttctaattagcttgatgtttggtctcccagctaagtgagctcttgtgaactctgccagaatctggatttccaaattatctgacaggaggaaaggaaaggattgggccaaagtggccattgcaagtcagtttcttataagtcaaaaatttaatcagaccaagtgcctttcttttctgtgttcagaaaatacccattctttgtttctcacaactgttaacctgtcctaggatgaactggttctgcctccctttgctgtttcctgcattagtacttggaaaagcctgtggctgcatggtctgaggtgtgaccttcatggtgggcacaccttgtctctcttctctgcccgaaaggaggccactgttttcttgtctctgtaactgctctgtgaattcttcttcttcctgatgactaagtgtgactattctccaaggtctttatctttttgcaagttttctgagatcttcaccaataagcacgaatacttactgaatatgttttgtgtgccaggcactttttaaagcactttaataacaataactaatgtttattaagcatctactgtgtgccaggcactgcttttggtacaaaagatgtgaaataaaccacacaaagaccatccctcttggaacctatgttttattgagatccagccaggtggtagaacacatcagtaaacaaacatagacttcagcaggtggtgacatgtgctctgaaggagaaatggagtccgagtagagagtgactatgcatgatgaactggtcaaggaaagtctgtctgataagggggtatttgagaagagcacttctccaaggaagtggaggagcaagcccagtttgcttccaatttcttcctccttgtgtcttgccaactgggaccaagcatgcctggcgtggaacaaactctttctgttctctgctgatggagccattttctcccagagcccaggctctaggtctgaaccctgatccttctcttcacttttcttttctaatggccagacgtctttgtccttcctttgaaatagaagtgacagcaaaatcttctttcccacagccgttgtggataggaagcctctgcctggctgagcactttgctactttatttctgaattcctgtgccagcctcctcaatgatcttagctgctagtcttgctcttctcacccatctgtggccaccaaagcactggaacacgtaagccatcatttgagtgcttactccataccacacactggatcctcacaacttgctgatgctattacaatatgttttttttcttttttcctttttctaactttttttttttttttttttttgagatggcgtttcgctcttgtcacctgggctggagtgcaatggcacgatctcagctcactgcaagctctgcctcctaggttcaagcaattctcctgcctcagcctcccgagtagctggaattacaggcgcctgccaccacacctggcttatttttttttgtatttttatagagacggggtttcaccatgttggccaggctggtctcgaactcctgacctcaggtgagccaccctcctcggcctcccatagtgctgggattacaggtgtgggccactgcgcctggccttttttttttaaagttttatttaggttcaggggtacatgtgaaggtttgctatgtaggtaagctcatgtcatggggagttgttgtacagattatttcatcagccaggtgtattaagcctagtacccaataattattttttctgctcctctccttctgccacccccaccctcaagtagaccccagtgtctgctgtttctttttgttcataagttcttatcatttagctcccacttataagagagaacatgcggtatttggttttctgttcctgtgttagtttgctaaggaaaatagcctccagctccatccatgttcccacaagagacatgatcttgttattttttatggctgcatagtatttcatgatatatacgtaccacattttctttacccggtctgtcattaatgggcatttagattgactccaccatgtctttgctattgtgaagagtgctgcagtgaacattcatgtgcatgtgtgtttgtggtagaatgatttctattcctctggctgtatacccagcagtgggattgctgggtcgaatgatagttctgcttttagctctctgaggaattgccatactgctttccacaatggttgaactaatttgtttttcttttacaaagttttttttcaagactagtcaagtacactagtgagaagggagaaaaaagtagagcaaggagtttgatctgtaactgactgaacaatcaatggagatacctcttacctttggaccagttgctattacaattatgattcccattttgcagagaaggaaacagactttcctatggtcacttgctaatacaggaggtggctaagccaggatttgaactcaggtccaatggaatccacaggctccttccagccaccagaccaagcttcacataccctgctgtggagcaccatggagaccctggttcgctctttcactctttggctggctcaggattctttcatgcttcctattatcagtgggataaaagtccaaatgttctggaataatatttgagatctttcatgcctggaccgtacttcacctgtcttctggttttgtatctgagctccctcctgtaacaacctttgctgaacatactcaaatgtatcatggaggtaaacacagcgatgcctacgtttatacagtgagtgctttttctttccctttacctgaactcactctttcttcatgccccagctcagactccacctcctctcttaccttcgtctgtgttcatctatacttccaaactctcctgtcagttagaaggcgtgtcctgcctgtttcatgtcattcctaacatcagaggacatagctcttaaagatcttattaccaacttgccatttccatgaatttccttagcccttgatcctaaactattgagaaagcttacatatccaaaatgagtctaacttttctaagcaatggtcttgggagatgtacatatttcactagggcttcctggagctggaaatatatttggtggagctcctttttctaaattgccttccggctacccaagaaagtcaatttccttctttaatagctgtgactcatttttggactgatgatggcactattccagttcagtcacctatctgagtcatcagtagggactccatttaaaatttgactctttccctaaattgaatcaattctcaagggattaaaactagatattcactagaacattccccaggaaaatttagaaatcagagttctgaaaatgtttgctcaaaatgtcaaggggtgaaactgagagaaggcaactggaacgtttctcttaatccactgtccctcacttacctgcttggcagaaagaaggcgggggaaggaaagcattagaataaaaagagaaatgttcagaggcagtttgagtcatgaggaaacagctaaaacttccaaaacagaaactgaatgacatcctcttcctaattcaagccttcctcaggggaaaattgaacagaacatttcacttgataaatggaatgagacctggtcctggagtatttggaaagatgaatgacaggcaggaggaatacagtggaagggaatgccatttatttacaaatgcatctcctcaggtaagggaggggatttcacagagagagggaggtggaaccgcagagggcttggtccaagttagaacatgaacttactccttgctctcgtttctgggggagaaagccatgtatacctccagcactcagaagtgctcgcgacaatgagctcattgggatttgctactcaattagattctgctttgtacatgtagcacttagcactgtgtctagcacataacgaggactcggtaaatatttgttgaatgaatgaaaaataattgctgcctgggagaagttgagaggctttgtaattctgccctgtcatttctggtagtgaccaccaggtggtgccttcttaagaacaggaggaaataaaatcactccagtgaacacagaaggcttggggttgactcagaaccttgcccctgtgcacaccgtctaacagtacatcacaatttcttgttcctaacgttgaatgtgcacacaggattcagatacgtggctggcactgactttctttacttgagtcaaggtcaagtaaggttttcatcgttggctgagctctgggatttaaaaccagttctatcccaggccaagtgggtttctgttgttcctgcttatcccctgtcctccaggagaacacatgctgcccttgcttccatattttctcagaaattcgtccccagcatcactaatggattcatatccagctcttgcactcacgggttgaaaaacttggtacccctgtgtattttaagcagctacctgatgagtacctatgttgaaataggtttctgtggtcgaaattctcagaaaagtcccacaagatgggcataaatgaacaaactagctcagcaggcttaggtggctctcccaaagtaacacagataagtgagttggcagagaggattccagcccaggacagtctgcccttaggttgtgctgtgatctctattctgttttatgtggagtgagtttaatgtatctgcattaacgagatccagggacaaaaatataacaaaattcaaggaatgtgaagcaatgtcctatagaaggaggacagttcactatcagtgtgagccaacacactcagctcttggcagttttcagacagttgcaaagaaatacttagcctgaggcttcttcgtgcccataaacctaattaagggtactagagattctgattggcaagagctagggacagagaggctgagtgagactatacgtgtccctatgtttctgtatataaagacagaaagagggagtttgagagagcgaatgagttaaatcctaagtagacctggaaaactatcattttgctaggactggacttaagcaaaacagcagagcaaagttcagagttaagccagaactttgccttgaacctcaggcccattgagccctctgctccaacagggccaaatcagcatccaatagtccccttcaagttgtatctgtcccgtgtctcggtgtttctggtttctgttatttggtaggtcacaattaattatacagggttaacaaaaatagattaacataatgtacttgccgaatagtgtttctttgggagaaaatgacttaactcacctaaaatatctccaggcataaaagatattaatgttgggaatatcaggagtgattaacctctgagagaggttgaagggaagcaaaattggacaggaaggataggaggaatggagataggggatttcgggtggggagagcctcttagagtcttttatttcagaccttactctgtgcctttccatagggccaagtctgatcatcctctttttatggtctgaatatctttgagcccttcagaaactttcaaattagtaatatacatgattaatatttttgacacttacatgttaggaactagacattatttcagtaatcctcagaggagccttgagtggtagatgctatcattcttccccctttcttttaaataatgaaatagaggtttaggaagacccaaagctagttgatgtcagagccaagatccaaagcccatgtgtggttataaagccgtgttcttaccactatattatgctgtaagaataaagggacaaacctcaaaataaaagctttcactatcagtaacacagcaaaaaacaattattcattcaataatgagcaggatgaataaaaacagacaaacctcatcacatgaagttgaacttcagagaatagtcgaataaaaagttccctcaaacttaggagaaacctaaggctatgaaactgattgtttcatagccttggtaataagtagccatcaggggccgggcatggtggctcacacctgtaatcccagcactttgggaggccaaggcaggtgaatcacctgaggtcaggagttcgagactagcctggctaacatggtgaaaccctgtctctgttaaaaatatgaaaattagccgggcatggtggcacatgtctgtaatcccagctactgaggaggctgaggcagaagaatcgcttgaacccaggaggcagaggttgcagtgagctgagattgtgccactgcactctagcctgggtgacagacagagactccatctcaaaaagaaaaaaaaaagtagccatcagaacccatttaaaatctgttcatttggtcaacaacaacttgtcttagtgaaagttggttttaaaactggcagaactgaccagtgtcaaatccttacttcagcccatcagggatgcagtttccagtaaacatctctctgagtgccagccaatcaaagaatcaattacagcctcagctgagcacccacgtgctgtcaacccacgtgtgcctctgaacatctcacaaccacagagctccatgctttcaaagccctctaagccatcagccatctgtcctgctcacagacactgtttggccagcatagctctcttctgtgatgagcaatgtattcagccttggagttctgtgtcagatactaagtggtgatctcattgttatttgaaaaaacaagcacacatcagtatgtatgtagtgtatggctacagagacaatagcacaggtaagaggttgggtagggcaggtgctagggggggctactttggatgggaagctcaggagagcctctttgtgggtgcaaggtttatgaagagacctatatgatttgagaagagtccagacattcacagatctaggcctggggcttccaaaaagaaggaaaggtcttaaggtaggagaggatgcctgcgtgtctggggaaggagtagaagaggaggctggagaggaaatgggtggaggctgatccttcagggccttgtgggtcatggcatggtcaggatttgggattttgcttcaagtccaacggggaggcaggaaaccacccagggaaggactatgtcctctgctttaagagagagagagagagagtgtgtgtgtgtgcatgtgtgtataatatacacttgcacatatgtgcatattgaaagaaaggggatggaggcttagggtcaggagtgcctcttagagtctcttactttataccttactgtatatctataaatgcacatacatgcatatatacacacaagttttgcagttaggttcaaagatcctgtagatctagaagaatgtctatgacattgacaatgtgagtcagtacaccctccactgtgtgctaccaaatctgcccaccctcttccactgggagtcccataaatgaagtggttttactaccctgttgtagcccagtgacagatgatcagtgatgtcaaaagcgtgattctggagaggttggtcactttgttgcaaagctgctgtatcatttcaggtacatagtctgggaggtacagagtctagggtcagagtagagtctcaagccattgtgcatgcctgcccaagacagagtggagttggtctactcctgaatatattaaccattttttcccttagtcattacatgtaaagcttcatgtctgcatttgtcagttatgatttatccggatcacctttcttacagaaagcggtagatgccaaccagaagactggaataggcttccttttatctcttttgcacagttgtgtcttcggtgagatgacttgactctctgatgttgagagtgtttttgttaatttttgaagcatgatctcagttggtttaggatatgaatgccatacacactcattgttttcgtttggggactgccgctgtgctgggtgactgcgtgtttgtgctgctggcccttgctgacactgatattggatttacaaagccaaccttgcagttttgtgtgggcaggtaggctgcctttaatttgtggttgctttgcccttctgaaaacacgaacttctatctggttggaagtcattttctttttcatcaatctcaactactgaacctatttcttcaggcacatctccagactgccttggatatttcgaggatatgttctgcgtgttcacatttgaactgcagcttggtttgcagacaccctctccttagattggcagctgtttgtggaattcctgagtaccaattacatccagtagcaggaaataaaagacaaacaaggaactagtagagctcaaggtattctttcatccttcctccttcttagctaatacatcttacagttagctctgaaaggagaatttatttaaacatactaaacactgtgcatagtgactcttacatcttttctggtaatagcatgctaatgctatacttcaaagtgcagtgaataagccctgtagagaaatatcctcatggtatggtttcaaaggacaggcatccttctggaacatattgttatcttaggtttttgttttaaatgtcagcacatggagaccttattctaaggctgcgtctgtgctccgctagtgagtatggaaggcttaggtgattcatggtgggaagttgaagtaactagagaagacttggtgctgtttggctttagtgaaatttttagaagctgtagttgaaaaaccaacacagattggccctctgtttgttgcttttggctgtctagggactgcaaagtaaaaaatgacattttcttgatgtctttctgacagtttctcacctgtaggtcaagtcctaattgaaatatgacataaatatttggcgtcataaaagcagaatctccataacacattaggtgatttctagagtaatgctcacttttattgtttgggttccattgatgagttaggcagggttatattttaagaattttcttacatcaggaagagtcaacagaggatggataacatattttgaacgtggacattgcttgtaagttgcaggacacttgtaaacactattgagtgtcacctatagcaggaaccagtttttctttatccctcgttctgtgacagctacctgggttctatgttggagccccgtagtatagtttcaaatgcaatagccactgcataatccttgtcacccaaagactgcagatcttgacagaacttgtacaacagtggccttgctgaggagtgatgtacatttcttttgtcatttggccacataagaaaactgcagccatcactgtattttgatgcatcagactctgtgtcctctgagtgtgattcagctgttggatttcttgattatgaaagtatctagagtacctcatgttcagtgatgtgaactgctatgaaagttccctccgtgtattctgctggatttcttaagttatatcttcacagagagggcttgcctcttatacagtctgcatccagcacccataagtactttcctttgctgcaggagcaggaactgaacccaactgtggatggagtgggaatgtgtgttctgattcctgcttattagcggtaggatgtgataaatatgttccaaagcaatgcctggtagaagtgttcccctacctgcatgtgacaagaagcattttcctcccttcatttggatagaggaagggctttggataaggaaaaaaaataaagaagatcttggaccttaagctggagacaggaaggtcaagtgctttattttttctgtgatgagaaccagctcatttgagaactgaaggtgaatactgactgtcatatttaataagtagtgatggaatttgcatttcttccttgaggtcagtagtctgctttcatagatagaacaggagtttaaattctgagcaaaatatgcaatcttttctctttctttgattcttatcctgtcaattatctcgtcattctacagaggactaaaaggtaaagagttctaagatcttcgcattgtctgggaagaagtggaaatgttaatattagtctttaataagttattaatgacacatattataattgttaggataactcctaaaaggatagtgaagagcatataacttccatattaatggttaaagatgtgccaaacaatagcaacaaaggaggaggaaaatttgaacattgggataaaagcactgcacacagtggtagatgtaaacacaaatatttcagcaattacattacatataaatggactaaatgatgcaattaaaagataaagacatggatgaaaaaacttttcaggaggcatatttaaaagataaggaaataaaagtttgaaaaaataaaaggatagaaaaatattatgcaaatactaaaggaaagcagctgtaggttggctggtatcagtgttgatcatatcatggacatggttgattatggtatgagtttgtgccttatgttgtaagtattcacaatcagagtttcttatagttagaaaaaattagatgatcaaattataaattactagaaagatttcataattgttaaggtgtaggctttttactgcacctggagaggcctttcagccatgatgtgaattatgtaccattatgtaagataagtggagcgtaaatgctttgttcaaacaattataatgtaattggaaacttcttgtgttaacaatatcattatcttaaaggtgaaaggggtgggaagaatgtggtagaaatcaagttccctggggaataggctttacagccaaaagtaaagtcattttttcctgaccagtgacttagcttaaaacaggtcaatgatattctttaaataaagcaatatttaattggattcatttgcagctgatatggattctggggcttgatagcacttacatattaagctggaaatctagaaataagaactttagcaacaatttttttttttttttttaggatttgagattagttattaataacacaggatgcaagactcttaggttgtagttgtgggtaagcataaatatatactgaatagattcagacattggccaagtagactcagtttttttcaggagatcatgttcattcaaagggataatttcttctttctgaaaaacttctattttgaaaatattaaatgatagaattccccctgaaattttttattgtgctgtttaaggaatggtattttacccattagtgataatccatgaatgcatgctatgaatggatacttaggaaacatttcctgcatgtccatggaaagataattatttttaatatttgtatggactgttaggcttttttctgtgagtaagatgtttttaatgtagaggtgtacttatagagtatacgatttttattgtattcttttaaatggactatttaatataattgacatatttcccatggagtaaaaacactatttagatgcttgtggtaacataactcctcaaatcttagtgacttaagacaacaaaggtttattacatggataatgtagatcaacaggaaactgctcattggaattgaagactccatgctgacactgatgggaggctccatccatgcacaggcactcacagtcaccaaagcagcataggaaaatatggtaatccttgcactggctgttaaagcctttctagaagagaaataacacttgcttatatttcattgaccaaagcaagtcatgtggccatgctaacttcaaagaaggtgggcaagcgcaatcctgtatgtccaggactggactattagggaacagcctaattgactactccagattgctactgacaacacttttttaaatgattgggataatactccaataaatgcctatgccatagtttacagagttagcccattttaatgtttgcagtgccaatagtttattaataatgctgaaatggacattttggtatagtcaccattcctccacactgctccttttctggggtacttaaactaatcctagattaagtctcctgttgtatagtttaatggactgctgtatgtctactttgtagcacttattttctaccaacacgctataaatttcatatagagaccacacctttttttcagtgctgtgtctgctaaccgttacataatagatattaaataaacattaatgaaggaatgaattaattggggaagtgggaagggtaaattggtaaaactactattaaggctttttctatatgtttccaaattgctttccaaaagaattatagcaaattcacatgtgagtcagcagtggtttatcagtttaccacccattgccaccactggttattttcctttgctaaatggaaagtcaaaataaataatatctcaatatttttagcactgtaattggcatatctttgattatcaataagactgggtatttttcatacatttggtttttgttattgtgataaaaacataacaaaagttaccatagtaaccattttttaagtgtacagtaaaatataactatgtgtacattgttgtgccacagatctctggaaacctcattttgcaaacctgaaactctttaaccattgaacagtaacttgtcttcaccctcctccaacacttggcacccaccattctactttttatttctaaaatttcgactacttaagtatacctcatataactagacttatgcagtatttgtttttttgtgactggttaatgttacttagcataatgttctcaaggttcatctatattgtagcttattgccagatttccttctttttaaggctgaataatattttattgcatatatatatgtatatcaaattttaaaatctgttaatccgttgacatttaggttacttctacgaacttggctattgtgaataatgctgtaatatacatggtgtgcacttatctcttcatgattctatttttgattcttttgaatatacagatgcttgacttacagttacgtcctgataaaacccatcatcagttgaaactatcataaggtgaaaatgcgttcaatacaactaaccaattaagcacaatagcttagcctagcctaccttaaacatgctaagaacacttacattagtctatggttgggcaaaatcttccaatacaaagtcaattttatagcaaagtgttaaaattgtcatataatttattaaatactgtaccaatagtaaaaaacaaaatggttgcattggtgggtttttgatgttggttatcatgacaaggtctctcactctgccacccaggctggaatgcagtggtgtgatcacagcttgctgcagcctcaatcccctgggctcaggtaatcctcctacctcaacctcccgagtagctgggactacaggcatgagccaccatgtctggctatttttttttattatttgtagagatggggtctcactatgttgccccagctggtctggaactcctgggctcaagtggtcctcttgccttagcctctcaaagtgctgggattacaggcatgagtcagtgtgctcggctgatgctttggttatttaccctcatgatcatgtggctgactggaaatggtggctctttgccactgccccgaatcataagcgagtatgttactgtatattgctagcctgggaaaagatcaaaatttaaagcatggtttctgctgaatacatatcacattcacaccatcgtaaagttgaaaatagtaagtcaaactgttgtatgttgaggactgtctgtatatctaagggcaggattgctggataatatggcaattctacttttactttttttcagaactgctgtcctgttttccacagcagctgcatggttttatattctccccagcagtgtacaagggttccagtttcttcacctcttcaccaacacttggtattttctgttttgttttttgtttttgtttggttttgatagtggccatcctaacaggcatgaagtgattatggtttttgattagcgttttcttgatgtttagtcatgttgaatatattttcatgatgctcgttagccatttatagtatatcttctttacatagatgtctctattcttcaagtcctttgcccaattttaagattggtttatttgttttgctgtgtgaagagagataattttactccaatttggatgccatttatttattgcctaattgcttgggttaggacttctagtactatgttgacgagaagtggcaggagtgggcctctgtcttgtttctgaacttaaaggaaaagctttcagtttttcaccattaagtttgatgttagctgtgggattttcatatatggtctctgttatcttgaggtaatttctttctattaatgaaattttttgtgtgtttttgtcatgaaagggtattgaattcttttcagtgcttttttttttttggcaccaattcagtcatgtggtttttagccccttattaatgtggtatatcacattgattgatttttgtatgttaagccatcctatcattccaggaatatatcccacttggtcatgatgtataattactttaatgtgctattgaatttggtttgctagtattttgttacgaatgtttgcatcagtatttatcagggatccttgtggttttcttgtagtatctttgtctgctttaggtatcagagtaatgctggcctcaaaaaaatgagtttgaaaattttccatctttttcaatttttttgtaagagtttgagaagaagtggtgccaattcttctttaaatgtttgatataattctccagtgaaaccatctggtccggggcttttctatattgggaggtttttgattacttacttagtttcctttccagttaccatattcccctattatctgagagttcactttctgcagtttcaggtactggcagtcaactgcaatctgaaaatattaaatggaaaattgcggaaataaacaataagctttaaattgcatgtcattctgagtagcatgataaaatctcccactgtcccatttcatcccacccagaacttaaatcatccctttgtccagcatttctacgtatacactactcccccattactgtataggaaaatacatggcatatagagggctcagtactattcagggtttcaggcattcactggcggccttggaatgtattccccatgtataagggggaactgctatattgctatgttcagattgtttattactttatgattcagtcttggtagatggtatgtttgtaggaatttattccttttagattatccaatttactggcatatgcttattcatagcaatatattataatcctttttatttggacatcaggtataatatctcctctttcattttgatttttgttatttgaatcctctatatttagtctgaggatttatcaattctattggtctttaaaaaaactcaatttttgttgtttttttctattatttttctattctctaatttgtttatttttactctagtctttattatttccctctttctcgcaactttgggtttagtttgtttttctagttccttgaggtgtaaagttaggttgttaatttctttcttccttgttaacgtaggtatttactgctataaaattccttcctagtattgcttttgctgcatcctatatgttttgcaatgtgaatctcaattgatagaggtttatttagccaaagtttgaggacatgcccaagaaaaacatgggtcacagtagcatttgtgccctgtgcttttccaaagagcattttgggaacttcagtatttaaaggggaaatagcaaaaatgaggctctgattagtgctcagcacatctacattttatttatttgttttaacttcttaaaattttactttttaaataaacatatggtaaaattgacgttgtatgtgagtacagttctatgaattttgacacatgtatacatttatgtaaccactgccataatgagaatacaaaacagttccgtcaccccagagaactccctcatgtcatccttttgtagtcaatatccctagtcccacccgtaacactaacctttagcaagcactaccctgttacccatcaccaaagttttgtcttttccacaaggtcacataaatgaaatcctaccgtatataatcttttgagactggcgtctttcactctgcataatgcctcgaagactcatccaagttgttgcatgtaaacatattattattattattattattattattatggctgagcagaattccactgtgtgaacataacccgttttgttttgttttgttttgttttgtttttcacccattgtagagcatttggctgtttccagtttttgataattaagaattaagcttctataatcattcttatacaggttttggggtacagatatgttttcatattgtaatgcttaggtaattcctagaagtaaggttgctgagtcaaccggtagatgtgcctgtaactttatgagaaactgccacactgtttgccagagtattttcaaatttcagccattctaatatgtgtatagggtattttatcatgattttaatctacatttttcaaatggccaatgatgctgaacatcttttcatgtgcttatttgccgaccctacgtcccctttggtgaagtgtctgttcaggtcttttgctcattttaaaaattggactgcttgttctctcaatattgagttttgagagtccttaatatattctgagtgcaagtattttgctggatatgtgatctgtaaatattttctcccagtctgtagtttgcctttttattcttttaacagtgtctttctaaaaacaaggttttaattatgatggtgtgatttattttttctgttatagatcatgatttacccctttagttataaaaattttataattttatattttacatttaaatgtgtaacttagtttgagttaattttggtataaggtattgagaggtgtagccagctgggcttctgggtcaggtggggacttggagaactttcctgtgtctagctgaaggattgtaaatacaccaatcagcactctgtaaaaacacaccaatcagcgctttgtgtctagctaaaagattgtaaatgcactaatcagcactctgtaaaaacgtaccaatcagtgctttatgtctagctaaaggattgtaaatgcaccaatcagcactctgtaaaatggaccaatcagcaggacatagatggggccaaataagggaataaaagctggccacccaagccagcagcagcaacctgctcgggtcccttccatccacactgtggaagctttgttctttcactcttcacaataaatcttgctgctgctcactctttgggtccgcaccacctttaagagctgtaacactcactgcgaaggtctgcggcttcattcttgaaatcagcgaggccgtgaactcaccagaaggaagaaactctggatacatctgaaggaacaaactccagacacaccatctttaagagctgtaacactcaccacgaaggtcccaattcttgaagtcagtgagaccaagaacctaccagaaggaaccaactccagacacagtatgagatttaggtcaaggttcattttcttgcatttagatgtttgaatgcttcaaacaccgtttattcagaagactgtcctttctctgatgaattgcctctgcaaatttatcaaaaactcagttggtaaaactgtagttgcccatgggtatatgcagcagagcagaactttctgaagtaatggaaatgggaatacacgttacagggtgtgttatgtgggcatatgcatttgtcaaaacatcaatttacacactttaagtcagtgaattttactgtatgtgagttatacttcaattaaaatatcagttggccatatttctgtaggtttatttctggaagtctattctatgctgttgatctacatgtttatctttttgccaataccatgctgtctttattttttattattttattttatttttgagattgaggctcgctctgttgcccaggctggagtgcaatggtgcaatctcagtcactgcaacctctgcctcccaggttcaagctattctcctgcttcagcctcccaagtagctgggactccaggcacatgccaccatgcctggctaatttttgtatttttaatagagacgaggtttcaccatgttggccagtcttgtcttgaactcctggcctcaatcaatccgcctgcctcagcctcccaaagtgctgggattacaggtctgagccactcccggccaaccatgctatcttgatctcaattactttagctttatagaaaccttgatgaagtggaaaagtgtgattcctccaactctgttctttttcaaaattgttttggctattcttgtttctttgcctttccatatacctttagaatcaccttagttctacctacaaaaatcttgttgggattttgattaggtttgtgctaaatttatagattaattaggggaagattcacatcttcacaatactatcttccaattttgaacatagtatgtttttttcatttatttaggtcctctttatttcattagcattttatagttttcagcataccctctaattgtttacataaatatttattagatttatatgtaagtatttcaattttttggaattgttttaaatatcatttttggagttattttaaacagcatttaaaaaatatttggtttccagctccttattgctaacacataaaaatatgatccatttttttacatgtactctacaactttgctaaatacattcattagttgtaggaggtttgtatgtatgctatttcttgggatttttcatgtaaacaataatttcatttgtgaacagggacagttttatttcttcttttccagtcaggatatctttatttcttttccttgcctgattgctctggcttggaattccagtatggtgtgaaataggaatggagatagaagtttgccttgttttcattcacaggaggaaagcattcagtcttcatcattagatgtgatccttgttggttttccaatgatatgtcctttattaggttgacaaaagtctctttttgtagcaaatctacattttacatgtcaaaagagggagtagatgaaaaaagtaaattacatattcatctcatactcagtgaatctacattttactaaataagttgaagtaaacataaaaagaggaagcagaggaaaagtcaattatgcattaatctcagggtaggtgaagagataatttctggtcttgtccttgtcctgtacccgcaaagataagctggtagttgacattgtgagggtgagagtcaacagagctcagttttagggctagtttataggagggatatagatcctgaacgatttagggcctcacgtttatacttattgtatcttccctatgaattggcccttttattgttgtataatgtccttttttgtttcttctgacagttttgacttaaaatctatttgtctaatattggtatagctacctctgttctcttttggttactatgtgcatggaatatctttttccattctttcatttcagcttatgtgtgccattatatctaaagggaatctcttgtatacatcagatagtgaggtcttgttttttaattccttcagccattctgtcttttgattgaggcatttaatccatttacattgaagcaattactgattgggagagactttctgttgtcattttgttaactgtattctgtatatgttgtatctatctattcctcttttcctttttcctttttatttgctgccttcttttgtgtttcattgatttttttttttttttttttggtgacatgctttaattcctttctcattttcttttgtatgtcttctataggtattttctttgcggttgctatggagattacaaaaaacatcttatagttgtaacaatctattttaaactgttaactacctaactttgatcacataaaattcctttacatcccccgtcctactttgttaccaatctttcaaattatacctttttatattgcatatccaatcaagctttcaaactatatccttttatattgcatatccatttatagagttttataattgtagttattttttaagcttttatcttttaaattctataccagaatttaaaatgacatacaacctaccagtacagtattacagaattctgtatttgtctatatattgacctttaccagggagcttacattttcatatgctttcatattgatatctaggatcctttcatttgaaggacttccattagcatttcctgtaaggcaggtctagtggggatgaactctcccagcctttgtttatttctccttcatttttgagtgacagcttttttggccatggtattttgtgttggcttttttttttcttttagcatgttgagtatattatctcacttccttctggcgtataaactttctgctgagaaatctgctgataatcctatggaagatttcatgtacatgatgacttacttttctcttgctgtttttcaagattctctctttgtttttgattttgacagtttgattataatgtgcctcagtttaggctcttcaggttcatcctagttggagtttattgactttcttgaatttagatgttctttttccccctagatttgggaagttttcagtcattattttctcctttctctcactgttctttctcagggactctcataatgtgtatattgatctgctcaatggtgtttctttctttgtttcttttttggctttgactagaaaatttcaaatgacctatcttcaaattcattgattctgttttgctcttgatcaagtgtgctgttaaactcctctggtaaatcttccaattcagttgttgtattcttcagctcaagaatttgttaggttcttttttaaaatagtttctatttatattctcattttattcattcttcattttttggatggtttattttttattgctggttgtctgtacacccagttaactctttaaacttctttaagatggttattttgaatcctttgtcaggtaatttatagatatctgtttttctgatctgcttttggagatttattttattcctttgattgggccatgttcccctgattcttcatatgcattgatttttgctgggatttgggcatttgaaaaacaactacaacaaccagctcttccagtcttaatggactggctttgtgtaggggaagacctttaccagtcagcctggctagagattctgagggtctctgcgaccttctctggagatgtgtcttgtctgggcttgcatgtaatttcccaattagagaagtttgctaatttctttttcaacagtttgtgttctcttgctttctctgtgacactccacagtactgtaggttctccggtacagcaagaaaacatcaagttcttttgttctctgcagccctagatgtccaaagtataccagtttcccgttagagtctgtgttaagcaaaacagaaactagtctcttaggcagccccctgaaaaactggaacactggatgtgcattcactcctcttttcctcccaaaggagaagctctgagtaggttgttttctcccaattcattgagctgtgccagcctggggaaaggctaagaatagcaaaataaaatgacttttcctacctgttttaattctgctgttcttcactttgtatttgcctaggggcactgtggtttcataactggtttctggaggtcttataaaggcattttgtacaatatattgttggtaagtctgtggggggtgggcagggaatgagatctggggcatcctattttgtaatcttacttatatcacctcccaggaagatcaaattttatacttatcagtgtatgagagtagaaatgtcattgtattggggggtcagtagataagattccatatctgtttctatcactaatgatagaactactgctaaattataaaaatgtaaaatggtgctagaatagagattagagtaacatatttttgaaactttaaaatctgaaggaatttactgcttaacttctgcctactttcagggtattaatactagagaaatttcctctaatactttcctttttctttttctttttcttttttttttttttttgagatagagtcttattctgttgcccaggatagagggcagtggtgcagtctcagtttaccgcaacctctgcctcccaggttcaagcaattctcctgcctcagcctcccgagtagttgggattagaggtgcatgccaccatgcctggctaattttttgtatttttagtagagatggggtttcaccatgttggccaggctggtctcaaactcctgatctcagatgatcctcctgcttcggcctcacaaagtgctgggattatgggcatgagccaccgcacccagcctctaatacttttctaattatgaacctgatgaatgcttagtaggatatatatgtaaatcatctgcaattcattcaacatgagtaattactgttaacattttatagtattttctttacattttgtatgtatctgtataatgtattcaaaattatgtatatttaaatgttctctatacacagatctgtttgctctctgatcaccaggctttatataataaactttttttttcatgttaaacattcactggtttttcaatatctgcatattttcctaataatatattgctgtaatatacctcatttgaccatgtaaccatatctcatatttctattttgggaggttattataaatatggggccatgaaaatgtttgtagaaatattctatatgcttttaaaatatcctgttttcttcaagtagattgctggagatggaatttctaggtcaaagaataatgtggacataaatgattttagaactttttctacctttgccagttacctttgaaaaagtgtgagagtgttacattgcttttgtttctcatgaatactatcttttaaaaattttagctaacttgataggtaattttatttgtatttctttgaacattaattctgcttctgtggcttgtttattcttatcccctttgcccttttctttattgtgatattggaaatgtccctttcaattagtttttactctttatttattaagggtgttaatactttttttagatttgtggtaaatattttcccctgattcgtagtctgcatagcttttaattgtcttatgttattgtgggttgaaacttttatttagtcaaatttgtacaactttctttagtaacttttttcctttgctgttgtgcctgcagtcacacaccatccagatattaatcacctagattttaaattttctatatatatacaaatttctgactatactatattccttctctatgaataacctcttttaacatttttttgatgggcaaatttgctggcaatgaattccctcagtttttgtttgtatgaaaaagtctttattttttcttcacttttgaaggataactttgctgaatatagaaatctatgttggtggactccccccatttaacacattaaatatttttctccattctcttcttgcatggtttctaacaaaatgtctgctgcaactttcatcctctatagatgtttccctccttttggcttctttcaaaatttcttatttgactttggctttcagcagtataaatatgatagcccaggtgtaggtatttttgacatttattgtgcttagtggtggtctctaagcttcctagattggtattttggtgtctgtcatttattttggaaagttcttggtcattattccttcaacatttcttttgcttcattctttcttccccttctgttcagttacacacatgtcgcacctttgcaattattccacagttcttggaaggtcgctgctgctgtcactgctgctgctccttcctactcctcctcttccttgttccgcttctcctcctcctcctctctttttcttctctgcccacctcccactctgttttcttctctctttgcatttttatctgggaggtgtctattgagctatcttcaagttctctgattctttcttcagccatgactagtctcctcatgagcccatcaaaaacattcttcacttctgtttgtctgatttctagcaattcctttagattctctcttacagtttccatttccctgttgacattacctgtctgttcttgcatattgtctgcttttcccatcagtgttcttaacatactgtgatagttaattttaggtgtcaacttgactttagaagggatacccagatagctagaaaagcattatttttgggtatgtctatgagggtgtttctggaagaaattggcatttgaatcagcgtactgaataagaaagatctgccctgccccaatattgacaggcaccattcagtcagctgaggtcccagatacaacaaaaagggagaggagaaatgaattcatattctctttctctccccttctctctcttccttcctccctctccctctccttttccctctctccctcccttctagagctgagacattcatctgcttctgatcttgaacatcagaactccaggttcttggctgggtgcggtggctcatgcctgtaatcccagcactttgggaggccgaggcaggcggatcacttgaggtcaggagtttgaaaccagcctggccaacatggtgagactctgtctctactaaaaatacaaaaaaataagctgagtgtggtggtgggtgcctgtaatcccagctacttgggaggctgaggcaggagaatcacttgaacttgggaggtggaggttgcagtgagccgagatgatgccactgcactccagcctgggcaacatagtaagactccgtctcaaaaaacaaaaaaaaccaaactaacaaaaaaacccaaaaaactccaggttctccaccctagggattctgggtcttgtatctgcagtcccgcagtttcttaggccttcagccttggactgagagttacattgttggctcttctgattctcaggcttttgagcttggactgagccatgctaccagcttccctggttctccagcttgcagatggcgtactatgggacttcccagcctccataatcagatttaattcccctgatgaatcccctcttgtctatctatttatcctattggttctgtttctcaggagaaccctaatacacatattaatcatagttattttaaatttcctatccgataagtccagtatttatctggtttgattattactttgcctcttcaaattgttttttcttgccttttagcatgccttgtaattttcattgaaagctgaaaataatggattgggtaatagacctttagtataaggttttatgttaatctagactagattaatcacagactacagttggcctgtgtttagtatttgctgtagctgtaggtgccagaggcttcaaattcctctggcgtcattgtttcagtctcccctgttgtctttgggattccctaagaactcctcagatagagtttgcatcttgcagctcttttagacgtaatctaatgtaatctgttattttactggtgaggtatggtgctaaggtgtagggaaggggaaacattctgtaatcttaggactacataccagtttcttagtgggcttgcattcatggcctatgaccttcacaagtgtttcttagcttttattttcttaaagaaaaaaaaaaaagctcccataatgagataggaaggctagagggggccagagtaggaggaatgtccttccctcaggtggataaggctctggtaaagtctttttggattccactctggagagtaggcctttatttttgaaactcctctgggcatatttcacaatagttaccattagggatggaatatttgtgtccccccacgcccccgcaccccgccaagtttatatgtggaagtcctgacacccaatatgagtgtgtgtggtaggctgcgtgtggaggtattgggaaattcaggttcccaaaagtttggtcgtagtgaagtcctcagaggtcttcttgagtctttccttttcttcaccaaaggctcactgacgtcatccatcctcctgatggaggtcaaagcattaaagtcatttttctccctaggagcgtctcccccattgccaaattgccaggctagtattagggagaaatgtcctccctgaatttcattgttgggtttttttttttttttttttaaaccttattatggctttaatgttgaaatttctgttttggactttttagcatgacacatacacacacctctcattttattttcattgctttttaaactcccatgtccaatgtctattttaatcttatgtttggcagcctgaaacattttatttctaaaattaattctctaattatacaacatctacatggcttgtaatgacatcagtagagcagaatctagaatccaactcaaggttttcgttttgttttttaagagtaagtaacttattttgatcaatgtagtaagaggagattgaaaggtaccagtgtgtgtgaaagtgaatagttgcttcctctccccatctcctcttcttcctcccctgctcctctcctcttcttcctccccctcctttcctcttcctcctcccccaacccttcttccttctactcttcctcctcctctgcttattccttcatcttaactcatccttcactaaaaagagttatattagcattagaagtattccttaatggctatacttttcagatattataacttcagaattttctagccaataacaggattctagggcaaatgtcatgtaggatatggctcttcgagtaccaacatggcaagaaattgatttcctctattgaagacacattgattttcagctgtactgaaaaactcacagccttccagtatcgacaaatagtaaaaattgacttcacataataacacctttatttacctagccttgtgaccctctgattttgttagatgatcctatggtgaaagaatgcaccaggaccaatgcttggacaaatagtaagtctccattttctttatagtagatgcttctacataaaattccgctttgggcagtaacttgcgtagacagctgttcttgtgacacgacataatgcacactgagcacggtgacagctccagacgatggtctactctggagtttccaactggactggtaatctactggatactctcatctggaattgtctcctagctgagtggttaagctatagaagcccatgattaaacaatgttgtttctggaaagaataatagaaatggttattattagtgagtacttactgtctgccaggccctgcactaagggctttttatgtgttagttttgtttaatccccacaatatatctaagaggtattatcccccttttcccgtgaggacactgaaggtccaacagctaataagtgaagctggcgatatgtcctgttttagctactaacatttatcagcttcatcatacagacatactttgtcagattggttagccaggcaagtgaccgctgagagaatggggcacaggagaagtaagtgatgactgcgaacacaggctggacaaagatcactttcttatacgagtctgcagttcttgaaataatacctatcagatatggcattaacagtgattggtagccttatccaaatgcgatatttgacttttgccttcatatcatggtttgaatttacaaacttcatttctttttctttttttttgagatggaatctcgctcttgtcacccaggctggactgcaatggcgcgctcagttcactgcaacctctgcctcccgagttcaagtgattctcatgcctcagcctccagagtagctgggattacaggcatgtgccactatgcccagctaatttttgtttttttttttttttttttttttagtagagacagagtttcaccatgttggccaggctggtcttgaactcctgacaaacttcagatgggggcattgccttaagtgtatgatgcccaccattgaggtagactaccacatggtacctggatgagcatcttatgtttcaccaaaccagaaatttcccaggcaaagtgaacggaacaagagagactgcggattcagacgtttcctatgcagttatacttctgaatgggtagtcacagtgtgttcaagggtaaatgatagctaaattatcacccatctttaaatgttttcactttaacggggttaccaaatcgctctttaaacttgaatttctatcaagcttcagaaccataaatgttttcttagaatttttccaagattatctgaatcagtgagtcctttaactcacttctccaggtatcaaaagtcttttaagtcttttttctgccaaaggtgaatctatgctaacgccttctagtactgattctcctttccattttcccatgcaccctactgctttctgtctccctttgcaattcaacagaaagagaaatcatgaggcagtatgaaatgaaggacttttctgggctgattttccttttgaatcagaatggaaatttatggtcatagtgctttccatgaggtatttagaagtttccagtcaatcattgctcttatcaggggttcttaaaggctttgggagatactaggttagctttcttacaatataggctgccctttgttacagcgacactttctttttgcagattttttttttcttaacagagaaaattgagatatgaaattatttccttaatctctacaataatcaaatcataattatttctattctattttttaaacttttaaatttcactaacagtacatagccattgcagtaatttttttaaaaaatagagaggagcttaaaaataacaaaaacctctataatcccatcacccagagatgagttttggccccattcatctcacaagttctgtgcaactattgcatttcatgttgcctattcatattaagagaatagcattacttttattatgatgatgatttgtaaacaatttcccagagttaattcccagacatttaaaaattttggccataattgaaagtcaggattttatcttctcagttggaaagtagaagagaaaagtataacagtgaaaaaaatttttcttaggtgtgtatttgtgttggattgttctaatttcaaaacagagaaagttttgaactcctgctttcatggttcattcttagaaataaatagaattgttttcccaagaaaaccttggaaaactttctagtaatagcaggaggaatatgggagtaggaaatggcaagttgaaggattttaatttggaaactgccaccttttggaatacagaagagctggttatgggattggcccctggctttacttgtccttaacatgggctttgataaggggaaaacaaagtgagggcttcgagccacaagtcaaggtcttgggaaagcttagcaaaatggtgcaagtctctcgtgatatctacctttatgcttactgctttctattggcaaaaatctctcatcttttgcagatgcactgagatcccatcagtagacagagaaagaacgtgggtgagtcagaagcaatcagccagaagcacacaaatgggtgtggacatgtcactgccaacaacccacacagagtggctggctactgcattcacccttaggatctcctaatgagcacagttaacagtagttggagctttgtctctgacatcctcttgcagtcatctgccttatttgctgattgatttctgttcttgaaactctgaacaggaagccttctgttgactcatccctgcttttcagactggaaagcacttgtaattttatctgccatgtatagtctctaaaaatttattttgaagatatgctgtatcaaaagcaatttaagaaagtaggaaggtaggaaatataacaaccaaaaccaaacagtgacactaaatatatacatatatatagctgtacactagacttaacctaaactgaccagctagatgattttgatgcagtaaagacaagttaagaaaatttgtctttactgtcaacaagacagtaaacttgtctctatgtcaacaagaaaaaaggcaattagaaattcttggaaaaacagaaatttgcaaatgaagtcccaatttaatatgaggtaaactgaaatgtgacagaattctgcataattgatggtatataagaaaaaagaaaaaagaatacattggaacttgacgcttacagctagtatggtgacaacggactatatctcctttaactgatttagtttcaccatctggaactgcactgaataaaaatatttacctaattgtaatactgaatatattttattagttttcatttttcataattaacctgtatgcaaagcatggaagataaattatatttgctgaacaaaatggaaatattctaaaacttgatgttgtaaattaatgcttattataggtgataaaatgtaagggggggattgaggtggaatggagtacaagagcatatgttttcttctgtttcatagtggatggttgaaatggtactctttagtcttgatacatagagaagtagagatttaggaatatgattacatgattaaggtaacaaatgaaagattatatatctgaagaggacagaggggaaaggagatgctgtgtctcaaaattgtgttctcctctagcagggaatcaatataccgttgacccttgaacaacacgggtttgaattcaggagtcctcttatatcccagtcttttttaaaccaaacatgaattgaaaatacagtattcccaggatgcaaagcctgtgtatagggagggctgactttgcgcatatgcagattctgcaggtggactgcaggacttgagtatgcctggattttggtatatgcaacaggtcctggaaccaatcccccaagtgagtatactgaggggcgactggattgtttcacttttgtagaggcatatgggagttaggcagccttgtgcttttcatactatgttcttgtttaatttctggggttttttgtttgtatttttgttatccatgtacatcttttgaaactgaaaaaatggtgatcagatgatttacaagaaactttgattaacaattatactagcacaactttgttaaatttccctaggagaagacaacagcctcaaatgcagtgggaaaaaaaagcaaaatctgcctgcttccacattgttttcaaggagagcacttgaacaaaatggtactatttggacaataaatagatgggtaccaattctagacaagcacaagcaaaaagaaaacagggctggcagtattcgcatgggggcaatttcaagacagaaagcattaagtggacaaaaggtgatattttgtaatggtaggggttagaatccaccaagaatttatacagccatggttctttacgtatggaaaattagcgccgaaattggtaaaggaaaaactgttaggagataaaagaattaaagaataaggcaaaaaatattagtacttagaaaattataatagccaatggtataatttaaggtatgaaaataaaacaaacaaaagtctgcacctgcaaaggaaacttgaaaggcagggctgttggggatggggtgtgtgtggcggtgaaaggggtacagatagtttatcctaatcataggttttaatcactttcttgtagaaggaaggaaaagttttatttctgtgacaccatctcattgtaaaatccagtaaaattgaaaactttgagataaatgtattatcaggagttacagccataacttttagtatgtgagctataaattctgttcttatcactaagtcactgagaactaaggctgctgattttcccaacatagtaaaacagagcgacctgaccaaaaaatgaaaaacatttttatggacttttattctccttcctgcaaccctaatctccttccttcctctatagattctagtctatctaagaaattctaggtggatggtttgctttctctgagggaagctaagattgaggccaaaaggagatctgctaggtacctgtgcaaacgtcaggtgggacagtgaatagaaagtaggcatgcaggggaccgagaaagataggctctgggcatcacaaacagcttttccaactctagagacttgaaaaatgtatttggagttacatctaagtcagaagagtacatcttgtttatccccccaaaaagcctcctggtatataccttttagtcaaatagcattgtgatcttgtcacaatatatggacaacagatattttcagttcatttgatacttaacatagaacatattaatgtgccattttatcagaaacctgtaaaggagtttaataatggataactagaatgaacataagtggtagcaggtccttactctcatcccccctcccacttttcataatgtactgatttgaaatgttcgtgaaatcaatacagacaaattaactcagtgagcagcttctccccagtctcttgctgcagtgatgagaagcctctttctggatctacttgtttccagatggtagacaaggcttattctgacacatggactgaaaacagggcagaccagcagtcggaatcttccctgcttagtgtcttaatctatagtaagacctcaaagaattagattccctagcatgaggaatttttcttactgaattttttaatgccactatatggcagtgattaaatagcaagttcaagtgattaaatctggtccatctctatacttttcctttacaattgctatcaggttttgtaagtaaggaagtggaggcatttttgtaagtgtgttaactctcaaagcccacaaaagtatgtttttaaacttagggatcaagttgtgtggatccgatttcagacccccagaggttcttccaatgtgtctaatgtccaggacagtgcacatgttcagagtttcattgtatttttctttctttctttctttctttctttctttctttctttctttctttctttctttctttctctctctctctctctctctctttctttccttctttctttctttccccctccctccctccctccctccctccctccctccctccctccctccctcccttccttccttccttccttccttccttccttccttccttccttccttcctttctttttttgatggagtctcgctctgtcaccaggctggagtgcagtggcatgatcttggctcactgcaacctccacctcccaggttcgagcgattctcctgcctcaacctcccgagtagctggggctacagctgcccaccaccacgcctggctaattttcgtatttttagtagagacggagtttcaccatattggccaggctggtctcgatctcttgaccttgtgatctgcccgcctctgcctcccgaagtgctgggattacaggcatgagccaccgcacccagccagcagcatgttttctttgaagtgttgttcaggggtctcttgcatcagaatgtcctgaactgcttgttgggaatgcagtatcctgatcctaccctccagattctgattcagtaagcctggactgagccttggaaatctgcattttatttagcataatgtcctgggggcttgggggctccccaaagtttgaaaaccaccgctaagggctattatgtttctgtaggcaaacctatttttctgttttcattttatgtcatacaaagtaggagtttaagaatttatttttggtgaaactagaacactgtcttcaaattaataagagccttgttgtgtaggagaaatattctcttcaaaatctctccacgaaattgatctcaaaaagactggctgagtcaaatgctaaacagatctgtcctgtatctggctgccacctgtcaaaattgctgaccttacacttatgtattcaaatgcttcctggaagtcaaaacatattttcaaaagtttctagtggaaaagaactaagcctgtcgcttggttttaaaaggtggaaattgagataagaccgaatggttgagattaatttcacatcacaagaataggggtgagaagagaatagcaatttccataacttctatcatttatcttttaggttgaggatactgtgaaataatccttccctttccaaccaacatgaagatgactgatacacccatcatactgaaggattcctactgtgtcagagattacattatattaagtccttacagaaatataaagagtataaccttcaaaaaactgggaattgttaaattatacattggattttgggggctattgtttgggaggttttgttttgttttgttttgtttttccttctttcataacagttcgctcaattaactataccagaggcatctttggctgcaaaggtggaggaatcactgtgctcgaagatgacagttctacaccttggcctgacagttttgagattcttgcttctaaaataagatggaacctgaaagatgggatgattctagcatactaagtatttgactttaattggaatcattgaacgtcccttgaattttttttctcattggtattggattctgttgtctttactgatggaaatttcttttccttccattcttggttcatgacaaaccaccaactgtccacgcatgatctcctttcattttacttgtatttgaaatgaaaacctgtgagtgcaatgcctaatctaagaatcagaacattattcttttatacccctatctctgtaattctcctttatcttactccttcacctccccatccctctgccaccagaggtaaccaccattctgaacattgtttatcattctcttgcttcacccctacatatctacatgtagccttaagcaatacattgtttcattttgcctggctttgaactttatgaagaggtatcatccctggcttatatgatctcttgagacttgctgtttcactcagccttatattcctaagattcatccatgctgtcattgctgtgtagtatttttatttgtgcttatactgcagtttttctataaatgttagtataggttatactatgatttatcaatactcatgtcattgggcattcagggtgtttcctgtttttgtatctatgagcagagctgttagtaagcatttgcgtctcctggcatgcatgtgccgaggtttcccttgtgtctatgcttagaggaagtacagcaaccactgctgtgttgtggtgtatgaaatcattcaactttacaaaagaatgggaaagcgctttcagggtcgctatatccatttacacttccaccagaggtgcagaaaagatcctatcagttcacctcttcaccaactctttgtattttcagacatcaattttttttttgccaattttgtgtttataaatctactgatatacttcttaagtattttatctatcccttaggaaaaaaggtaggaaatagaatgtggttgccttcacatagagaggctagaaaacaaagtatcatgcctgcttagtttgatggcacccaaatttttctcccagttatctcactactagtagttgacattcttttctcaccctcgctagaaatatgaaaaccttgcctctgcacagtggaatcccttggaacatttaaaaaatgctaatgtctggaccccacctccagagactctgatttctttggagcccagcattgaacatagggatttttttttttaaataaaagcttcccaggtgattctaacgtgcagtcaaggttgagaatcactgctttaaaatacagaaatcttgacaagcaagcataagctcagggtagcctgatattgttaattgttctttttctcatttctaaagtacaaagtttgcataattttggagaatcctcttgcctctaatttctagctcagcagcctttgagagttttttggtttttgttttggtgtttgttgttggtagaagtaaatagtagaaattcaataaaagttagtatgggctagaaattgtgcttgacatttatttttttcttataactgtggatctcaaagtttagtgtgcataagaaacacctgggaagcattttgttttgttttacaatgcggattttgattcagtaagtcttggcgtgagcccccgggaatctgtgttctaacaaagtgattatgatgtaggtggttctagaatcacctttggataaaaactgcctcataataatcctacagtataagcagtattctcatttacagatggggggatgtgaagcccagagaagttaagaagcctgcgccgtgtcacagagctccctaggggactagcctttgctctgtaagctctcagccctgctcatagtatgcctccaacaaggctctcagaatttaggaaagtctgctttggaacatgtgttatcttctctatacttacattctttcttaatctgccatgactttctctcctcatcaaaaaacagcctttaatctcctacccaaatccacctcgtacctgtgagtcttcaggtgtgttacactctgaacatggtcccgtgagagaatttcttattaaaaattgagcttgcaaaaaatcaaatgtgttatatttttgttcttatttcaccctaaaacaatgactttagttgacaatcacttttatgcaaccttagtaattatttctaaactcatgtacaagtggatggaagtatttctgtgcacatttagaaaatttatattcattgcttgtttccctcccctgccaccccacagagtgaggactttaccatgaaatctgggcctttggcctatgtatttttaatcatgttcatattgtactgtatctgcaaccatctgtaatacagctgtatatgtttacatgaaacacaataaacttttaagtttaattccatttgtgagcagatggtagcttgtcaaggaaacatttgatcatgtttatgtctgtatttggccacaaaaacctcataattactctcattaattacatatccttttcatgttacctgtaataaatgctaaggtatcatatgtgttggccttgtgggatatatttttgtatgtagagacagtcctcttaagaatgtttgcggcctggagcagtggctccgacttgtaatccaagcactttggaaggccgaggcaggcggatcacttgaggtcaggagttcgagaccagcctaggcaacatggtgaaaccccatctctactaaaaatacaaaaattagctgggtgtggtggcaggtgcctgtaatcccagcttcttgggaggctgagggaggtgaattgcttgaacctgggaggcagaggtttcagtgagctaagatcgtgccattgcactctagcctgagtgacagagtgagactctatctgaaaaaaaaaaaaaaaaaaaaaaaaaaagaatgtttgcttctgtaggcacatttatgtctacctattatgatgtcaagggtgtattccagtttgtatctgtagctgctacaagaagggtgtcatgggatctgtggttacactcttactcttcccatctgggtatttctgagtgtatttgctccaggagagccactggttctgctggcctacatgcaaagtgtatctatctctctgttaatgcgtttcccatgatgatactcgctgctgagatacttcctaggaagttttgctttcctatcacctcctttaagtgctttcctttaagtgttctcattttaactcattattaaactagcagacttgattgcagtgaatttttcttaaataacttaattgtagggccttttgcgcgtcattttgtgctcctacttactgctcagaggtggtacaaagtcagcagctcaagagacagacctgccacccatgatctctcctccaagttctcaggatgttcagaaagttaaaatttcactctgtcgagtttccatctggcttggcaatcaatgccggattagctccaaatactctttccaagtctcttgaaggatgtgctagcctctgttttgaattctacttcaggatcacaccatctctgcatgcaagaatgacatatctgagtgactgccactaaacccacatggtggaagtgtttgcttatcctgctatgtgatgctggctatcatattgtcagtttatgaggtgtttttttttttttttgcttgtcttcttccatgtaagtatttccagagcagaggcattggcttgcagaaggtgtgcctgcaatcagtccagcttccccagatgtgctgaggcttcaacaggggtttttaaaacttgtgctagaatactcatcttccaaaaaatctttaagttgatgcaatataatagctgccaattgagcatacattttgaggtagttttctttaatgggagtatatgctcatccacactctctttccagtgttaaatattttaagacagctggttagagttgagggtgccttttttttggtcataaaacgatgacagaactctaaaatcacatggttatttatcaacattaaaaacattcttttatatccattaattaatttattctttataacagcttctgtggaataggtatataaagggtttttttttttgtctactgttatttaagagtatcataaaacctgagaaagaaaaacataattagttgtcatctagtctaatgctctcattttgcagataaataaattgaagttcagagagatgaagtcactcacttatggacctatagctagtgaatggccctgaaattgtttcccagtcatggctggaggcacaactttgtctgagacctgactgatacttttgactatgtgatgttgtgtcaattatctaacacttctggacctcagtttctttacccatattatggattattgtgaatattatattagactacatccaagaatgctattaacccagggcctaccatcaaataagtagttaatttatatcagccacttcacagctgcacttatttttatttttattttttctgagacagagtctcgctctgttgcccatgatggagtacagtggtgtgatcttggctcactgcaacctctacctcctgggctcaactgattcttgtgcctcagcctcccaagtagccgggactacaggtgccaccatgcctggctaatttttgtatttttagtagagacggggttttgccatgttagctaggctggtcttgaactcctgatctcaagtgatccgcctgcctcagcctcccacagtgctgggattacaggcgtgagccaccgcgccttcctgctgtgcttattttcaatactcttttctcagggatcttggtaaccagagcagaatggcagtttttcagctcttacaatgcctttgtttagaagtcttgtatgtgtatatctgctccatcacttaaaagttctcctaatgcaatttggaagggtttaatatggaacaagagcagggactttgggatggagtctaatgataacttgtcacatgttcttttagaagctgaattaggtagtttttgccttactggtgcgctctcatttaactgtgaggtatcctggcacttcaaacaggtaccatatggtaactgttttgtgttttaagcctggtactgtttagaacacatgcttcagagagtggtcattgtttcgctgccacccagttaaggcatgtgttacctcttgttatggatggaatgcctgtgagccctaggttcctatgttgaagccctaacccccagtgtgatggtatttggagatgaggcatttgggaggtgggtaaggttagattagctcatgatggtgggaccctcttgatgggattcatggccttataataagaggccatgtgaacacagagaaaaggtcatgtaaggactcggcagaaaggtggccatctgcaagccaggaagggaggcctccctagaagccagacactgcctgatcttgatcttggactttccaggcttgagaactgtgttgtttaagcccctcagtctgtgatattttgttatggtagctgggcttgaacagactgagagacctctgctggagtgtgcgttgttcaatgatttacttccttgtttgcctacattatacactttcactatgtctccacgatggaagaggcatgactgttcagatgcatcggggttcgtctctacctaccaaggtcctgtgccatgaggagatgtcgggccagggactcaaacaggagcagtcatccaactcctttctattaggtctttggtgatttaaaatctcatatgaatcaagagctggtagagtgctaatgttcacaggtttttatagaacattaaagctctgtaatagttattttgtatgttatataaataatttccctgcaagtatttattcatttactcttcatttacataattgcttataatcttttttaatatattcttgtcccctgcgccacccctcccaccttttttttttttttgctgtggttcatatgcttttatgtaacctgagctataaaagactagaatactgcagatattctatctgccatgtctgtcattttcttatgatgggtacttagtctaccgtatacaaatttctgtatagttaccaatgtctttttagctatttattaatcttatcttgtttctttggcttctgaatcactttgctgaagttgaaatcatctgaggtcagagccagtttttatttaaatagactgaatgcagctaaacctggattatagccaagaaagatcttacaccaagtgcctacaaaattagaagcattgccaaggacgcatcagcagagtgttttgcttactgaagtcttattctgaaataaatttgaggccctggcgatgggagcttttggttgttattggtagacctcctaaaaaatgtaatgtagtttaattttacttttaatttttttagcatgaactttctccttcatttcttctttccagagatttttgggtctatccattggttgccatctatgtgttcaaacatgtgactaggtagaagagaggtaaacaggagtgtattcacctgttatcatggagaagttattattcaagacctgtaaggggaatgtggcagtcctaaaggctgcaaatattctggcagcattgtaggattgcactttccctcctcctctgaaggtagatgggagccatgtgtcttgctgtggctaatgaaatgtgagcaaagtgttgcaagctttaagagccagtgcatgattcatcatgttcccatcccattgccacagtgtttgtgaaagcgagtgttgagatggaccctttgttttctgggtccttaattgactgtggtaagataaattattgacaacctgtactagacatatatcttcagcagtatcctttggttgggattttgttgagataagggtccgtgatttggcatactcagtgtaacctaacctattctgattcttatagggaatcagagaagtgtccttacactcagggagcttgtgatttaatatagttgagaagatgtgtttgcataatgaagaaggaaccagctgcttaactgtactctttatttagccacattactgaacaagagacaagctgattatagcataatattgagattttgagtatattcctgagaccctggtttcaactggaaaagtaactttttttttttccttgacactttcagatcacaattgatcaaaacacctatgcaaggaattaaacttgctacaaataagccactagatgcatgatacctttaaaaaagaccaattatgagttatcttttattgttctttttatattaaaaatctgcatgggaaatggaatgagaatatttataacagtacagatttgctatgatggtgtctattaatcaaagttctttattttttagtatgtggggacgacacatactcatggctaatattggtgaaattgctaattcattcattctttatttggtgattcactccacaaacatttattgggcatttggtataaaccaggcatagctctcaatgctgctggtacagcaagaaacaagacagagcctctgactttgtgtcttacattttagtgagagaattgggtaataagcaaacaaagaaaggtacagtgtggtatcaatgatgagagttataaagacaaagcagagaaatgagacagacagtgcaaggtgtgtgatctcacatagagtggtcaggaaaggctgctttcagaaggtgacatttgaacaagaaattgaagaaagcagggagaaaagccatgtgactgccctgaggaagaatccttcaagtggcataaatagccatttcaaagaccctgaggcagggatgtagtaggatgtttgaagaacagcaaagagaccagtgtggctggaagaagggtgagcaagtgaggagaggtgggtaggagatgaagccagagacgtggtcaagagccacagaaccagggcctgccctgcctctgatgaaaaggcactgggattttgaatgtgagagaaccatgacctgctttatgttggaaactgatgtagtctgtggagggcaagaaaacaaacagaccagcaaggagacttttgcatgagtccaaattggagatgatggagtttggacacagttggcaagtgtggtggttgtgagatgtgttgggttcaagatatcttttgaaaatattgctattaggactttgtgatttgttgtggactttggcctgagcatctgattgactgatgatgctattttctcagatgaggagaatgttcaagatgttgttacctatttaagagaaggtggccattgcatattgcatatgtgagcctggacttcaggggaaagtttaggactggagataggcggttggtcattcaatggataggtggatttgaatccatgagattggatgagattcttttttgtttgtttgtttctgagacatagtcttgctctgtcatccgggctagagtacagtagcacgatctcaactcactgcaccctctgccacccaggttcaagcattcgtgcctcagcctctgagtagctgagatttacagatgtgcaccaccacgcccaggtaatttctgtatttttagcagagacagggttttggcatgttggccaggctgatcccgaacttctggcctcaagtgatctgcccgcctcggcctccaaagtgctgagattacaatcatgcgccaccacgcctggcctggatgaaattcttgaggaaaggagggtaccgagaggagaaaagatgttgaagaactgaatctggggtgctcccaacagttagaggttgaagagctgaagaggaaccagtaaaggggaccgaaaaggagcagccattgaggagagaggacagccagacaagtgaagtgatccacagctacatgaagacagtgccaaggaggaaggagaaatgagaaatgaaaatactactgagaggttgagggcctgggctgagactggaacacaggatatagcagcatggagatcatggtgacattgacaatatcatgtcattgattgggtgggggcacaagcttgattgaagctggttcaagtgagaataagagatgaggaaataaagataggatatacgtttcttgagagatttttgctgtggggtgagaggtaagggaggatagctatttaggatgtgaagtcagaaaaatttaattttttaaagatgggggttatattacacttgaaagctgatcattatttagtagagataaagaaattgacagaagcatctccttaagtaggcaagaggggatgggacctagtgtaagtggtgggttggctgctgcattagctggagttaaggcattgcatgttctagatttgtacggagacatataggtgaatgcacacacttatgggaagatactgttattatcttctgcttgcctttgttttctaagaaatagaatcaagatcatcagatgggtgtgagtaaggggtcatttctaggagtaggagtgtaagttggccaagaaagtgtaataagattgctgagcagaactgaaagcacattgagattactatcatatctttaaagcaaaatcagccagtgtagttctttgtttttctctagattgtgtcatttgctgtggtgtagggagagagtctaaggattctctcgtaggtaatcatggtcatagttttgcaatctgaataatgtggaagtggagatgggcagccgtgcagtagggcacttgcaagggagcaatttttgggagtgccaaaggccaggctggaagaggtgaaggaggagggagtgatttttgggtggtgccctagaccaggctgaaggaggtgaaggaggagggtgaagacataaagtggggaacggaccatggagaggaggtcaagtcaatggatccagagggcactgatgccaaattgttgacaggcatgagagggaatgagctggaaattcctttgaaataaaaagttggcagctttcctcaagcttaatctcaaaagagacatttaaaaattacttacttttgctgcatggttggggaaaaatgtatttttcaagcatgagttcaactcattttgtaccagggtattcacactgatattcttgggtaagtcattaaaattagtcaactatttctgtgtcttcacccacaaaaggagacgtgtgagaagtgaatacttagtgattgttagattccactgaatctcactgctttgttgcagtttaacgagcaggctaggattgcagcgctgtcatttcagttgggccaccaagccttgaatgaggagataaaactggaagataaagtcttagtaggtacaacaaaagaagcttttgagagatcgttggatagatgtcatctatttggttgctaaataataacacacaaagaaatctctctactgtttatcatgtgtacttatcttgagaagcatcagtgattaaaaaaacaactttgaaaacataaaaatggtgaagtgtggcaatggtatcatgtggcaacggtaaaatgtgtttacccatgtaaatataatgtcacaaatgaatcttgtcattatattttgtagtatcttggaggttactggccagaactattataatagtcagattcatttcatatttatttaaaatccgcggtgttttcacatacattgtgtttttaggggaaattttaccaatgattaacatatattgtctagaagcagagccatctgaattgaaactcaaatataattgccacttttattaaatatacaactggcagactttgaaaatgttatctcagcatctagcattggcttcattttggtttctcattttcctattttattttgttcagtttagcaggggacagtggggaacagggttacaaattgcattttttcctgcattattggtttttgtcaagtggtttacaggccaaagtttgtggatctgccagaggctttatcccaaaactataggcaacagctatttcttgaaataattttagatagatttctacattgatttatgttttggggtatatgatgcacaatcccttaagtcttaatatgactattggtttaatatggcagaattaggatcaggttcactcattgtttattataatttacccatgcttgactacccaataaaatgtcttccctttacaatgatctttttctattgccatattcttcttgtccttaaaacaacaataacagatcctcaaacgtcattggggttaataaaagatgtttctttattttcagatctttaacaaagcttctccttaacccagagggttttcagaggagtaaagagtggaagtcatttgtacatgaattggcttttgaaagtggccctcattattttattttattttattttatttttttattatactttaagttttagggtacatgtgcacaatgtgcaggttagttacatatgtatacatgtgccatgctggtgtgctgcacccactaactcatcatctagcattaggtatatctcccgatgctatccctccccccctccccccagcccacaacagtccccagagtgtgatgttccccttcatgtgcatcattttttatgaagtggccctcattattaagccatgtctctgcctgttgattgatgttaactatctgcttatggtctgagatcagtgtgtactgcaaatgtttgggaagatatcttctttctgtggaggtgaaacttaaatatcttctataaaatatgcctcgatttcagaagtagcaattgtagcaatgcctgatgtgaccactttattactgccttagaagtacttttgtggtttgactgtggggagggaacgggtcactggagattttgctatctctccaggtttcatgctttgggaatcaaaggtaggtaacagtttggaaaaactctgtaggggctaaagctttttctaaaggtttttacgtctatatatacctctgtatgttactgcttcaagcccagcaactagcaattttagtttcactgaaattgtgttttctttaaatacacaagataatagaattgtaactggaatttacatgttatatataaagatatattttatttaatcttgtcagaagggttttttttttttttttttggtgcttttaagctaatgtggcatctttctcttttcaaagagtggcatctccaaggaatagctctgcctggaaggtgtttgtggctgtccacttaaaagctgaaattaggtcagtgttattttgtcttgagataacaaaaataagaccccaagggagtagtgacttgggatttcatttaagtacttaatttacaggaaaaaaaatacagtttccgatactgaataattattacactactgaataattatatattttttcttctcccggtgttcttatactttagaggcaattttttttttttttttgtaaagatcacaaaaggtctgattagtcaaagaatgaaagaaatgcactgtggctccaaagtcccttatccaaaacctctgggacagatgtattttggaatttaagatttttgtgctgagaatgatggtttccagcttcatccatgtccctgcaaaggacatgaactcattcttttttatggctgcatagttttccatggtgtatatgtgccacattttctttatccagtctatcattcatgggcatttgggttggttccaagtctttgctattgtaaatagtgctgcaataaacatacgtgtgcatgtgtctttatagcagcatgatttataatccttggggtacatagccagtaatgcgtcattcccagcaaactaacacaggaacagaaaaccaaacactgcatgttctcattcataagtgggagtcgaacaatgagaacacgtggatgcagggaggggaacatcacacaccaaggcctgtcggggaggtggaggacaaggggagagagagcattaggaaatatacctaatgcatgcggggcttaaaacctagataataggttgatgggtgcagcaaaacgccctggcacatgtatacctatgtaacaaacctgcacgttctgcacatgtatcccagaacttaaagtaaaatttaaaaaaagattttttggagtttagaaaaataatacatttggatttagcagggtttagtgcggcactttttaatcacacacactaatatttctgtagtgaaactgaatattcacactgagataaagactatgaataacttcacatcagttcaggtaaggttttgcctcctattaagtcttgataacaaactttaaaaacttaaaaaaataaaataaaataaagtttattttcaaaacttttgaagtttgcgcgtacagctagcttgtaggtctggccttgcttttctttagattatatttcccttattagtcttctaaacacattaaatctgtgtttaccaacgctgtaatattttgccaccgtgaggatggtctagaggccagcaccatccacatcccttgggagctggctagacatgcagaatcacaggtgctaccacgaagctgctgaatcacaatctgcattttaatagaatccccaggtgattcatgtgtgcgttaaagatcaagaagcattgctgtagtattatattggctttaatttagattccaagtcttaaagggaaatgctgatggggggatactttagttgtttaaatcctgggaaagtgagcccagattacactaatatcatttatttaattatgtatgtatgtattttttttttttttgagacaagatctgacggtatcacccaggctggagtgcagtggtacaatcttgactcactgcaacctctgccttgtggggttcaagccatcctcccacctcagcctccagagtagctgggactacaggcatgcaccaccacacctagctaatttttgtattttttgcagagagggggttttgccatgttggccaggctggtcttgaacttgtgagctcaggccatctgtccacctcagccccccaaagtgctgagattacaggcgtgagccactgcatctggccgaatatcagttctttttaattttttattcaatatttcctccgtctctccctcccactcttcctatttttttttttttttttgagacagagtctcgctttgtcgcccaggctggagtgcagtggcgcaatcttggctagctgtaacctctgcgtcccaggttcaagcaattctctgcctcagcctcctgagtagctgggattacaggcgcctgccaccacacccggctaatttttgcatttttaccagagatgggatttcaccatcttggctaggctggtcttgaactccccacctgttgatatatgtgccttggcctcccaaagtgctgggattacaggtgtgagccactgcgcccggcccactcttcctttctctcctccttccttttctttttctttctttttaaaaataagtctcataatacttgactttaaatggatcatttagtctatttatttacatttattatattcttgatatatttggatttcttctcttttatactttctgtttattctacttttgtttctttctcttgttttatttatttttttgagatggagtcttggtctgtcactcaggctggagtgcagtggcgcaatcttggctcactgcaacctctggcctcctggcttcaagtgattctcccacctaagcctccgagtagctgggattacaggtgcatgccaccacgcctggctaatattttgtatttttagtagagatggggtttcaccacgttggccaggctggtcttgaactcctaatatcaaatgatccacctgcctcagcctcccaaagtgctaggattacaggcgtgagccactgcacctggctctttttcttttaggttgatattttttttctcatcctattccttcctctgctagtttgttatataccctatttctctcttttagcagtaatcctagaaattgtagcatgcatactttatttataaaagtctaaattcagtcagtatcttttcttcctcctaaacaatagctcagaatgttttaactcccgttttcctctcttgtgctgtatactattcttgttgtgtgtttattctatttttaaaaattattaatcatagatgattttttaaaacttatttttttcaagacagggtcacattccataagccaggctggagtgcagtggtgcagtcacaatgattgcagcctcgacctccctgggctcagatgatcctcctacctcagcctccagagtaactgggactacaggcacacaccaccatgcccagctaatttttgtatttttagtagagacggggtttcaccatgttggccaggctggtcttgaactcctgggctccagcaatctgcccgccttggcctcccaaagtgctgggattacaggtgtgggccactgcgcccagccaatcacatatgatttggttgtttaatagtggtgtttatctacatttattcacatatttgccacattagttgcttactacgtatttttgcattttagaccttctacttggaatcaccttcttcaacttggattctttagaccttccttaactgagagtctcttcatggcaaactgtcttggattttgtctaaaaatgtctttattttgcccttattctaaactgttactaaactatacattttgttttttgttagtgtatctgatttgctggctgtcattcattgtgctttatttctctctctctctctctgtctctctctgtgtgtgtgtgtaagggagagaatttgctaattagttgattaattttccactgtgagctgttcatttttcttacagctttgttatgaggattcttccaggtctgagttacagaaggattctcctagaaagtatttaaggttgcttctgctatgtgcctgggttattaccaactgtgactcttcacattaaatttttggcttcagggttttgggactctaagagctgtatgaactcgcactgcaaactcatatgagttttcacttattatagtaaattctcaggtttgatttttttcttcttccatccatggccaagatttgagacaggcaagtttccttgcactccaggaatgtagcttgacttactgttcctggtgttggtggtggtgctgctggagatgagatccttttagccatcctatctttggcaggccctgggctttgtttcaccctgaactctgaaccctgaatcctgtgggcagggcttctgctagcccatgtggctccactctaaattgatgcaggcactcagcttgttaaagggagcactggatggatttcagcaagcttcctgttccttatggttctgtctggtaggccttaaacctaggctcaagtactctggagttaaacaagtggcccaaggcaaaagccagcttcagtgcttaacttacttcgcagggattgtatgtatgtatgcatgtgtatgaatatatgttatgtatacatatgtatgttttgtgcgtgtgtatttcaccgttgagtgttaattactcccttgttacaactcattgatgcatttaaataaaacatttaaaatattttattcatctcctctcatggttttcagcaaaaatgtaggtcagggtaaattaccagatatattggaccagctggatgtagtcgcctttgatttttttttagttctaccacctatgtatgtatcaataaacaatgtattctttagtgcttccttatttttaaacattatgtgaattgaataacttatgtaatcttttgcaatttggtttcccgcaacatttctatatggagtatggttcgttcatatttactttataccaatatatgaatttctttagctattcaacacaatttaactattcagattccactgttgatggacttttggattctttccaatttttgctattggagttttccagttttgctgctaagaacactctcgtacatgtcttctggtgcattgtccaggattttctctagaatatattcctgggggtagaattgatgattcattgagtaagcatgtgttgtaccttactaggtaattacaaatggctttccaaagtagttgtaacaaattatgcttccattagcggtacacaagagtttctgtggctccatgtccttaccaattcttagtattgtcaggtttcttaattcttgcctattaggtgggtggacttaatacttcttagtttagttgttataacttgttttttaaaattaacatatctatgtgcatattcgtagtcatacatgtttgtctggtcatttaggtacttatgcaatactctagtagactcagaatagaaattagccatggcaacatatatattacattcttcatattgctacatttgaaaataatcataattatttgcagaaatatgaacagaacatatagaattaaatgttttcacgatgtcttgtattatctttcatgtttcatagcaatctctgtgttataggccacatcaactgcttttgcattgttctgacttacaggaattgcagatttattgttctcagtgccatatttaagttccttctctgtaacaatcaggtgtaatacttgtaaatttttttaaccttagtacaaatttaaaaagcagaaatttctcttgcagcttcctgtgtttcaggcccagtgctaagcacatggcaagcattgtcccatttagttctctccaccatgcttcgggcaggtgctgttgttaagcccctttcatggaggagtgaactaaagcatggagaggttaagggtcttgatcaaggtcccacaatcttattctcaatggaccttctccttctctaatctaaaaccctcattttattttgggaagtggatgtaggtctaggaagcttgtttgtgtgtgtgtagtttgtttgttttttttttttttgagatggagtctcgctctgtcgccaggctggagtgcggtggcgcaatctcggctcactgcaacctctgcctcttgggttcaagcaattctcctgcctcagccttctgagtgctgggactacaggtgtgtgccaccatgcccggctaattttttgtatttttagtacagacggggtatcaccgtgttagccaggatggtgtcgatctcctgacctcaggtgatccacctgccccggcctcccaaagtgctgggattacaggtgtgagccactgttcttggctgtttgtgttttatattaggaggcagagagcacttaggggaagcagaagctctggtctgaggaggcagtggtttacttattagttcacaggccttttaggtaatcactggtccttcacttaattaagcaacttaatatatgtcttacggattaagttaattttaaatcaatgctaatttttatgtcaaaatatattaagcagcatcacattaaagtcaaaggtagtcttgtaattattagagcaataggtatcgtgctgtcgttctccaatgtggctgcacattggacaacctgaggagctttaaaaaatactgctgcctggggatcactcccataagctctgatttatctcgtctggggcaccaggagttttaaaatttctccaggtgatctaatgtgtagccaagcttgaagattactcgatagtcattgattatgtgcgtgccacattcagattggtggggttcaaatcctccttctgccactcactagatgtgtggccttagttaagttttgttaacgtttctttatgtcttcatctgtaaaatggggatgaatgataaaaatactgtctgcatctcagagcattgttatgaggattaaaggggtacagtaagtccttatttaacgttgtctataggttattggaaactgcaacttttaagtgaaacgatgtataacaaaaccggtattaccatagattaattgacataaatgagagttaagttcctgcagcatatttttggtcctaaaagtattatcagacttctacataaagaccaaaacatttctaatattaaacactgagagaaatctaggttatacatacatttaagaaagattaattcaatcatttactcaattattcgactccagaatagtgggtggtccgagcctgtcctggcagctcagggtgcaaggtgggaccagccaaggacaggacaccatcccatcacagggcacactcacgctcatccacactcacactgggaccacttagacatgccagttcacctaatgggcacagctttgggaagtggagaatgtgaagaaaatccatgcagatgtggtgagaacatgcaacctccacacagacaatggccttggctggaataaatttttttttctcacaaattttataatgaaacaatgttactgtaggacctgctgtataatatatacatattaataaaatgcttggaatagtgactggcacaaaatagtcctttactgtgagctattttaagtagactaagaaaaaattattactattattggatattctctcaaaagtatcttgggggctaagattttaaattaaatcaaattttgcctagtactaagcccactttggtgttttcttggctttgtttaatttttttctccatggttttatttaaaagttatttctaatcaccctgtcaacttagcagatatctgttggaatcatttaaggtgtttgtttccaaaagactgcagaaattaaatcaagatatttgcagaggaatgactgacagcttgcaggtagactggagaaagtgcttcctaccataacagacagaaaaaatggtagtacaagagtcagcatttcttatttatttttctatgaggcagggtctcgctctgccgctcagactggaatgcagtggtgtgatcatagcgcactgcagcctcaaacttctagactcaagggatctcctgcctcagcttcctgagtagctgggactataggtgcttgccaccatacctagctgattttttgtaggggtgggtagagacagggtctagctctgttgctcaggctggtcttgaactcctggcctcaagcaattctcttgccttgacctcccaaaatgttgggattacagacatgagccaccatgcctggccaattgagcatttctttaaactggaaactagcacctttataataatttcacacataccattattgttgaaaatagtcagattttcagaggaaatctctattaacctaagttgtataaccttttgaggttgtaccagtgtagagcctgtttttccgagcatctacatgctcaatgctattttttcagttatccagcatccccccacttgtttctatcctatctcatatgcaagagggtgtaaatgtttttgtgcattgcttttacatttttatttatctctcaagtgggcaagtaagacagtcatcaacagaggttgcatttggagatcatattctgttttttctttaaactatttgatcatttcagagaaactttattctcagttctgttttgtcttcagctgtcaatatccctgactccaggccctttatttagcttccattcttactgatgtggaaacatacttttaaatgaactgcctttaaaaagaaatattttagtaaagtgaaggatctttttgtaatgcaaataatgttttgttcaggattttcttgagaaatctgccatgttctctaagcctttgcctccatactggatgtggctttgccttttttgttgtgttgaagggcatgcacagatatagtttctgattatttttctcagtctgatttctccaattaggcatattatcattagaaaactcgcccattttcccatggtgtttaaaagtaaaccaggacttgtgacactatgctactcggcatttatgaaatgtaatttaattactttgtttccattgtgaagactcggtttccttatttcctatattcatttatttattcattattggtatacccaacaagataagtaaatacgatacagccttgcatttgacaattttatggtgtgtatgtatttatcatgcctgaactgtgactagacttaagatgaagatggtacctaaatcaagctcttttatattttgtctttcccataatctagtctgtcttttctttcccacaaaatagaatgggatactttttattataaatatatgacatgttcactataaaagagaggcagtaaaggaccagagaaaatgacctgtgatgccaccacctagaagtaatcactcttgttaacatcttgttatttacttgtacagtttttttctgtgttcataggctgacatttttccttgcagatgttctctctctatattcatacaaagctgcagttgttcaagtcccaccccagcctctggaggtccaggatgaatgcctccctctttctgtcctggtaccttacgtgacctccggacggcagtgtcagtgttggaaatggcaggctgctgcaaatatgctaaaacctcatcagttgtctctattcgtctgaccaaagtccgtgggaagagcaagatgctggtgatatcctggagctcttctgacacaaggctctggctagccttgatacattcctcaaattcttccttccaattctgaaaccttttgttttccagacaataaaaccctcccaaactcctacctagacattctctctaagcagtcctgggagaccacatgtgacttgacttttaactatctttacagcgtttacattttgctccttctttttgtcatgccattactagagggaggatgggccatccagagcagcgtgcgccctccacaggcaccttagcctgttcttcactccgccatgattgaaagaggagaaaatattctatagctgttccttttctgttcttggctttttcactcttactgaccttacaagttttatttttccatttctgaatctcaattattttcatttctcctattcagtatagtttttaatagatagcattgcattacatggatgtcccttatttaatcaactgtttggtatttcttttctgtttttcaaaatctaatgaacactccagtgaatatccttttgttcgggatttatctctagaaggaagattactggctaaaaatatatgtacatttaacattcatatacatatctatacacacttttttttgagacagcgtttcactctgtcacccagactgaaatgcagtggcatgatcattgttcactgcagcctctacctcctgggctcaagcaatcctcccacctaaacctcctgagtagctgggactatagacacgtgccatcatgccagctgagtttaaaatctcgttttgtagagacatggtcttactatgttgcccaggctggtttcagactccttgggctcaagtaatcctcccacctcagcctcccaaagtattgggattataggtgtgaaccactgggcctggcctatgtatacataattaggctatactgtctataaaatttggctatctatagtcaaattattttatatgcatatatccaaatatacctataaatagccaaattatacatatacagccaaattttatatatatatatatataaatgttatatatatatagccaaattatataaagctgtatatatagtcacattatcctacaggaaatgatgtaaatgtaccaatttacattcctgtaacagggcattagaattccctttttccagagccttgccaacactggttatttataaccctttcaaactttgtatgaaagttgtatgtattttaagataaatgaaaacttatattgatttgtaattatttattggtataattgaacacctttccatatctttattgtactaatgtgtatgaattccatcttaatagttttgctaacttgtccattgaggggtttcctactgatttgtaatggctctctatataaaaaggatgttaatttttgcctattttacagtaatagtacaaatattctctcatgttttctattagtcttttaacctttgtttagttttttttcgttccttcataaatgctaaattttatgtcatcatatctttcagtccttttctatattatttctggctttgatggcatgcattgaaagcccttttccaccccagagttatcaactcgttggaaaatgatgttgaaatgtcacttttaatatttactaaacactcttgcctaatttgttctattttgaagccctttaattctgtttctttaatctgcctgtcttttttttgtgcctgttccttactgtcttgactactgcaggcaacatacttacatctaaagaacaagcacacctattctgcccttttgctaaacaaattttcagcctctttttcaatgattattttttcaaatcaatgttaaacatcacgtaaagtttcaagaaaacccctaggggtattagtatttagagtgcattaaatttttagctaattcatgggagaatttgaagtattatatcttctaatttaagttagagtacaggaattgtctgtctttatccctctaagtacattcagattctcaagaatagtaccaaaattctcagatccccctctaccagtatttttctcccactgatggctcttcaaccctaaaatgtcttagtggtatggtttggatctctgtccccaccaaatctcatgtccgatcgtggtccccactgctggcagtagggcctggtgggaggtgattagatcatggggaggcttcttatgaatggcttagcaccctccactttgtgctgttcttatgatagtgagttctcatgggatctggttgttaaaaagtgtgtggcacctccccaaaccccttgctcttgcaccggccatgtaaggtgaggatgcttcccctttgtcttttgccataattctaagtttcctgaggcctctccagaagcagaagccaccatacttcctgtacagcctgcagaaccatgagtcaattaaatcttcctttataaattacccagtctcaggtatttcttttcttttattcttttctttctttcttttttttttaagagatggagtcttgctctgtcgtccaggctagagtgcagtggcgccatctcagctcactgcaacctccgcctcccaggttcaagtgattctcccgcctcagcttcccaagtagctgggattacaggcgcccgtcaccacgcctagctaatttttgtatttttttagtagagacggggtttcactatacgttagccaggctggtctcgaattcctgacctcaggtgatccacctgccttggcctcccaaagtgctgggattacaggcgtgagccactgcgcccggccaggtatttctttatagcagtgtgagaatagcctaatacacctagcctgatgttacacttaggatcctcttcattattcttctgaatccaagcctccaactttatctacccatcacggttttagcttatattttgattttatttcttacatcttcccttatatttattattttaatattttgtttctcttttctccttctatacttgtactagatttatcagaatctgtaaatctcttttaaccctattaatttgttaactcagttaaatatatctattttgccaatgctcatcttcctatttttaacagtcatatatcaaactgtatttctcaactgatgtaccaaaattaaaggacacctagatgccctccctcagctaaagtgtttactactgcatccaaacccatgaattctccctaactgagagaggatatttagagggcctttgtgccttttttttttccccctatttcttccttgaaaattctggagctttttgaaataatttagaattttacttttaagatattattaaatttttttctacagcatgcctctgtttaaagaatcaaagctttttaaacatatcactagtcacatatattatctgtgtagacttagctatattatcatatatttatttttataaagatattgctcagcactattcttttacagttttatttatcttaactgacaaatgaaaattgtatatatttatgtatacaacatgatgctttgatatatgtaggcattgtgcactggctaaggtaagctaattaacacatgcctcacctcacagacttatcatttttttgtgagaacacctagtgagaacacctagaagtcacccacccagcaactttcaaatacattgttattaactgtagtcaccatggtgtataacggatcttttaactcattcttcatacctcactgaaattttttgtcctttacccaacatctcctcagtccccttacctcctctagactctggtaaccactgtttgaactctgttcctatgagttcaactttttttattctacatgagtgagatcatgtgatatttatctttctatgcctggttcctttttcacttaacattaatgtcctccaggttgaccatgttgtcataaatgacagatatccttcttttttaaggctgagtagtattctgttgtatacacataccacatttcctttacccatttgtttgtttttgaacacttaggtggatcccatactttgattattgtgactaatgctacaatgaacacgggagtgcaggcaactcttcagcacactgatttcaattcctttgggtatatactcagggattggattgctgtatcatatggtggttctgtttctcattttttgaaggaccttcagaccatttccataatagctgtactaatgtgcatttacatgagcagtgtacaaagattcccttttctctatatcctagccacacattatctttcgtctttttgataacagccattcgaacaggtgtgaagtgatatctcattgtggtcttaatttgcattttcctgattagtgttgttatttttttttcatatacctgttggccattcatatgtcttcttttgagaaatgtctattgaggtcctttgcccattttaaaaattgttatttactttcttgctattaagttgttcgcattccttatacattttgggtattaatccctatcagattatgatttgcaaatatattctcccattctatagattgtctactttgttgtttcctttgctgtgcagaagctttttagtttgatgtaatcccacttatctattttttgcttttgttgcctgtgcttttagaacctgatcaaaaaattattgcccagactagtgtcttggagcttttcccctgtgttttcttctagtaattttacagtttcgaatcttaggtttaagtctttaatccactttgagttagttcttgtatatggtatgagatgagggtccaattcatttttctgtatgtggatatccagttttcccaacaccatttatttaagagacagtcttttccccatgtgtgttcttggtacctttgtaaaaaaatctattgaccattgactatgtggatttatttctgggctttctaccttgttccattggcctaagtgtctgtttttatggcagtaccatgcattttgattactgtagctttgtagtagtttttgaaatcaggtagtgtgatgtctccacctttgttctttttgctcaagattgcttggctctttggggtcttttgtggttccatatgaattttaggattgctttttctatttctgtgaaaatatcattggaattttgataaagactttgaatctgtagattgctttaggtagtatggacattttaccaatgttaattattccagtccatgagtacaggatatctttccatacatgtgtgtcttcaagttcattcatcactgtcatatagttttcagtgtacagatttttcaattcctggttaaatttacccctaagtactttatttatttatttttttgctattgcgaatgggattgttttattaatttctttttcagatagtttgttgtatgtggaaatgctgcatcagcactaattcttacatattttatcttcttgagatcttttctgtttactttttatttgattgagatgctttcttagataccagtattggtatactttcttgagtttgtttctaaattatcttttcctcctcaaatatgtatttctgctgttctggtcttggattgcagttctctttattcagatgtgtgtgaacactgttctattgttatctgtggtcaagcattgcagacgagaagtctgatggtagactaattattttccctttttaacttacttctcttgtctgaatggaaggctgtagaatttttctctttgtctttgaagaaatttctctagaatatgtccagatgtcttttttatttagcctgactagaatgtctgagcctttttatgctaaaaatgcaagtctatcttcaactcagcaaaaacttcaaactgaaaaccgaagttttaaaaccagtgaagctttcttccacttttaaatattattaccacacctacttcttctcgtaattttttactttttttttcctaaaaaatgtagaaagtacagaaaataatgcggaaagttctcatttagcccaagcagagagttaaaaagataatcttttgtcatatttgttttagatctttttttaacagtatggttatattttaaaatgcctagaagactggagttaaagtcattcagttatttcttaatagtacttagagagttgctcatgaattggaggataatgaaatatgagacatgccagagcaggagaaggaaattctaggggctatttggggtcttttgtggttccatatgaattttaggatttaaaaaaaaatttctgtgaagcatgtcattggtattgtgataaagattaattgcatctttagatccctttgggtagtatggacattttgacaatattcttctaatttgtgaatatgggatatcttttcatttcttgtatcttcaattaatttcatccatgttttatagttttcattgtagagttcttttacctctttggttatattcattcttaggtattttttatttgtagctattgaaaaaagattgctttcttgatttctttttcaggtaattcattactggtgtatagaaacacctctgagttttgtatgttgattttgtatcctgcaactttactgaatttgtttattaaactattagatgatagtttaatgataaatgtttaaggtggcagatatactaattaccctaatttgataattacacaatttataaaagtattgaatcatcatgttgtaccccatacatatatatagttagttattatatgtcaattataaataaaaaattatatactacgttggttttcaaaattaaagtaataattaaaattcgcaaatgatgggaaaaaaaccggaagttcttgggggaaataagcatatttcacagtgtcatggaaattgagtcctgaatgtcaatattgtttcataaatacttgtaacatacaatgcaatagggatactacatcaggatgcttttggctccaagttacaaaaaaccccaactcaaattggcttaaagagggaagacatttgctcatctcacacaaaaggctactcagctttgcctcaatccaagccatcatgtaatcacatggtgggtatagaaatttgaggtgtacttacacctgtgtacatacctctagatgtaccagtgtcctcaagaataagaaatgccatttgccttttgtgtttcttatttagaagtgagaaagtcttttccagaatctccctagaaaacttgcctataaggtctcagccacaattcactcatacgctcattcttgtaccaactggtggaaagaaagaatagaattcacgggaattctattgaatctgacacagattgatctgacatagatcaacggttcccaaccaggtggagttttacctccagaagacatttagccaagtctggaaacatctttgtgctcgctggggtcccctactactggtatctagtgggtagaggccacagacactgctaagccttctacagtgcatgggatgcttcccacaatacagaatgatctgattcaaatgttaatagtgtcaaggttgagaagccttaacatagaccagttaggatctcacccttcagggccaaggaaagggctgtttttcactgaagcacagggctaaggaggggctatgtggatgttgtgtagcccactgggaatgcccactgccatgacgtccctcggatggagctggtcttctgagctgctcagaaagggaagctcggatttgtgggttttaggctactaaaaattaaccaaccacattgaatttcatgtttttctaattcattcctagtcttcttgcctgttaaactttctgctaaagataattctaatgaatttgagaaggtatttataaaagaatatctgtgaggctgtgtgttgcttgactggcagccaaaagaaatgttgcttggggaaaatggcacgaattaaacattgattgcccatcagtcttgtacttggggtctggggtagtctggaatacaggtagggagatcattcaagcttcacagagaggttcactagtacttataaatccaagcattgggagttgagaattgccagaaatagtcatgtaatgatattccatgttgtataggtgtttgcatttcttcctttctaaaaacacagtggttttggaaataataatatcctagaacagtggtcctcagctttttttggcactaaggacaagttttgtggaagacaatttttccctggatcttgaggggaggggaggatggtttcaggatgaaactgttcccctcggatcatcaggcattagattctcataaggagtgggcaacctagatcccttgcatgtgcagttcacaatatggtttgcgtttctatgagaatccaatgcccccactgatctgacaggaggtgaggctcaggtggtaatgctcactcacccaccgcccacctcctgctatgcagcccagttcctaacaggccacagactggtagcagtacatgacctggaggtttgggacacctgtcctagaacatcctggattaagcaattaaggatctctgcaaatcctagctccattgctcaactttgaaaagttgttggactgttttcagctttgggtacctcatttgtaaaataaagaaattgaattacaggcacttacaggtcctgcaattccccgtaactcagataaaaaatagatccctttctcccttcaggagaactcatgactttggtagcagctagagttagcatttgctcatgcttttattgtgtttagcaatcaatgggaagtgcatcaggtgaaatctctcaggcctgcatatgtctggtcaaagctcattcattgattttttttttttcctgctgaaacttgcacatatataaaaaacgaagacactaaatttaattttcaccagctcagtgtatagtattgtggctgctcatgttcctgaagagcgagttgttctcaaataataaactaagctgtataatctttaaaatatttgaccaggtgggaagcctttctgtgaggacaatgtgtttgtgcgtttggtgcttaagcttcaatcccctggccacagcttggatttatttgcaggggaaatctgctacgtaagaagacaaccactttgggcaacattatcttcatcatcagcatgcacgtgtggtaatgacctgttatgagcctgacttggaataactttcttcctcacagaatggtggatactccatatgtgtagaattactgagagtaattatctttgcaacagtaaggcgtgagggtaagaaatcaataaagcagaagggaaagatattaacatttatcgaccactttctgcatgacagcagaaggcggtcaataaatggcatactttattttaatcgtattaggtgattattgcagtattatcttaatttatgtgtgaagaaattgtggtccagcgaggttaagtcacttgctcagtgtccctcagtattaagtgataaagcagaggtatcaacctaggataccctacaaggtttggcttccatctggaagcactgagtacctgggcccagatatgagacagggtcccagcccagagatttgttggtttatcattccttcagcaaacacagcttacttccaagagtgtagaaattggggctgtgcttcatagcaagataataagcatcagaagggctgggtgtggtggcttatgcctgtaatcccagcactttgggaggccaaggcggttggatcatttgaggtcaggagttcaagaccagcctggccaacatggcgaaacctcatctctactaaaaatacaaaaattagctgggtgtggtggtgcacacttgtaatcccagctacttaggaggctgaggcaggagaatcgcttgaacccaggaggcggaggctgcagtgagcccagattgccccactgtactccagccagggagacagagtgagacaccatctcaaaaaaaaaaaaaaaaaaaaaaagccatcagaggagctacagtgatgctggtgaggcagacatttcctgactcatagcaggttacctttgtttcctcgttataatgagaaaaagttgccttccctggacttcctcctattcatcttttttttcctgtcctcttcttgcttaggatgccaaggctgtgacatttatttctgctctcttccctttgagatatgctgaagtcatttaaaaaaatgtcaggaataaaatgcactaaatgatgactgtcttagaaaagactccagttaagctgtgtgcatccagaaatgcaactgtgctgaccagtttctgcctcccttgccctactgataacatgatgggagatgaagtcgtttttcaaaagtgttctgggtccagagacgtttgctcgacacctgtgccctccattggtctaaaggcattagagtttttctcccacaatatttgtctttgttattttgaatttatgacaccctggttgttggtgtttttctttgcattcatacctgactcttgacctccaaaagaaccagtacatacattttactttaagctgggcatttttgtaatactatgcaaccttgaaaataatcgcagtgatattttgcttttttataaggccttctatccttctttgctcttgcatctctctttcccctttatgacagtatagcagaacatatttcattcttccctgagccctctgcagagcaattttgtaactgatttgagccatgtttttgatggagtatctgctctctggacctttccatctcctggttgcaactgtgaaccaccctgcctccaataatctacatccaaaatgctgagcaggagatttatggaatttgtttgaagatattccctgaactctctgaagctaactagttcctttgcaagtaagtggctggaaacctaaagatcttgtgaactgggttctagaagcatgggataacaaatgtaagatttcagactggaagttaaaagcgagttttcctcttgattcagtttctaaccagtcagctaaatggtctctgaatagttgtagctaatgagcaccatcccccaaacagtcaattgtcttgactattaaatacttaaatccatgtattttcgctggagtgtttattactatgtgttcttaggaccataattataaaatgttaagttaggacgacacagaatatttttctctgagtatttttgcctctttcatcagataagatgaaattcatttttattttattttacattattatgattattattttgagatggagtctcactctgttgctcaagctggagtgcagtgccacgatcttagctcactgcaacttctgcctcctgggttcaagtgattctcttgcctcagcctcccaagtagctaggattacaggtgcatgctaccatgcccggctaatttttgtatttttagtagagacagggttttgccatattggccaggctggttttgaactccttacctcaagtgatctgcccgccttggcctcccaaagtgctggaattacaggtatgagccaccgcacctggccgaaatgcatatatatatatacttttttaatggaatgcaatggaatattgtgaagtagtaaaacatgaataaactatagatacatacaacatgggtcagtcttactaatgactgtgagtgaaaaaggaagctccagagaaatacgcgtattatagcttggttataaaatttggaaacttgcaaacttcaacaatatactttttttttttttaaggaagaaaacagacaaaattcagaatagtggttatagttggggtgaggtgagcccatgagtaaatactggtaatgttgtaatttttggactaaatcatggattcgcaattcttcattatattattaaaactaagttttaaaagacccacaaatgggccagtgatgatagtttttccagaattgatagccatcaattctgatcatccaggatccttggaaataaattgcatggatgagctcattcatcacaaatctggggtctttaaagtttctgctgttcccagttctttggattcatagctatgatccttagagggcaacagatctctcccttctcatggcagaaataaaggtcagatgagaatgggagagccatcagatagagaccactgtggaggagtttgcgctttgggctgagcaaagagaagaccagaatcttttggtaccatctccttctgcatttgagatgaaacttagtcttttaaaatacatgcagccccagtcctctgtgttgccagtcacctgagctacctttgggggtagggttttgattaaatggcacgctttgctcatgagtaaccttcggggcacattttgttggtaagaaataaatgcatcactcatttgaatcagagctgcaagtgccatctgtgatgcactcctccttcccattatcacacaaatgtgtttctgtgtgactggttcctggattttgcaggctctcttgccttgcgccgattgctggctgagaggtctcagctcagcgttcaccacgtatcactatatttctattaatacttctgctcttcttggcaaaacagaagtggggcttcatttgaaatgatgggctggggagaggggaagggaaccatctcactcatagttattgacatcaagctaccatcatctcttgttcggataactatgagatttttctgctccctttatgcccccgccccaccccttcccagccactttctgtcctctgccagagtgatcttgtgaaggcttcaatcagaccagatcattctcctgcttaaaaatccccccgtcgtttcccgttgctcttagaacaacatccacactttttatcctgcagtagggggctctccatgctctagcccctgcctatgttcccctcctcatcatgcctttctgccctttgttcactatattctagtcaccctggccttctttctgctcctcagtcactccaagctcattccctctgcaagaccttggcatatgccatttcccctgtcaagaacgttcctgctctaggtcttcgcaaagcttacatgttctcattgttcaccgaacagtcttccctggccacccaatctaaagtagtccagccccacctcgaaggacactgtctcattgcaccttttattatcatcactgcatttaccattctctgaaattattctattcacttgtgtgtttatggctgtcctgattagaattaattttcataaagagaacaagaatcttgactggttcacccttcaattccttgtgcccacaacagtgactggcacatggaaagcattcagggaataaaagcacaatggaaaattaaaacatactcactgcatgcctgccacctatagaaccaaattaaatcactgccaatatgcatggggaaaaccttcccatttttctggaataatgttacaaaggatggaaaataagtgcacatcacctggatggcatttaataaacgctgtgacccagtagtgtacatttcagtgaatattgccaaaggaagtaggccaacatcaggtaatctgagttaactttcctgtacattgtgtattcgtttcctgatgatcaaaactggattaattagtctacaatgtatctttcctgttagatacgaagattatctgctctatccaatttgtgttttcttagctgagaaatcactgttgaattttaaaagcagcttgcctggtcctcatttcctggtcttctgatggaaatggtttatggaaaaaaaaatatttactagagtcagataattagaacattttatgtattttgcatatgctaatgcgtttgagttcctttgagggagagccgcatggcataaagcagaatgaaaaggatgattcaaatttcttcacccagcctcctcccctggccagatttagcacttcctatataccaccacctcacagcttagcttggctgggagctcctcaggtttccaaaggacggtccttccttctccctcccccaattgccatccctacaccagggtgccaactcccaagtgggctgacaggaagggagattggaaacagctttatagtagatttgatgctgttataagacacgttgtaagacatcaggtaaatatagcacatcagattttattaatcataagaattctttaaaagccttcagcagagccgagatcatgccactgcactccagcccgggtgacagagcaagactccatctcaaaaaaaaaaaaaaaaataaagccttcaacagtggctaaacacaaaaccagaatccctttagatttcttaaaatgcctttgtagttcttttgtaatatgggtccttgttggacaaagttagtaatttgttttttatatcctttacattaggggtttctaacccccaggccatggaccagtaccggtccctggcctgttagaagccgagtggcacagccggaggtgagcagcagttgagcgagcgttactgcctgagctccgtccacctcctgtcagatcagcagcagcattggagtctcacaggagcgtgaaccctattgtgaactgcacatgcgagggatctaggttacctgctccttatgagaatctaatgcctggtggtctgtccctgtctcccatcacccccagaaataaagtttctatgattacaataaatgtaacacacttgaattattcatcccaaaatggtctctcccgactccccactatccatggacaaatcgtattccataaaaccagtccctggtgccaaaaaggttggagactgcttcttttaatgatcatgttcacatacggacagtgaaaaggtgggtcttcttagaggttaaagggaaagtaggacagttgccacaaagctccctttttggagagtgcccagccagggagtgttactagggcccaccttggccttgctgatgtcttcagtggtgtccttgaagtcagcatgggattggcgcaggctcctgttggggcactcggtgaaggtcctccctcctccccagtagctctcatttccagggcccttattttcttttggccatctgggactgaagtcttgctcctggtgggctatctctgttgccctatcacctttagtgatttccactaaataaccctcttttaagcatttaggggaagagggagtagcatgaacgtttattgtgcagtggggtgagaaagtcagtaccagtttcaacacgccctccagctgccttcctccagggaggggacttcacactggctgtctccacagatctgcagtgcccttgccatagctccaactcctggccttctcccactccccgctgcctgctggcacatagagcccttgggccattctctgtgtggtattggcccctgcctttgcttatgctctctgctgtaagcagctaggcttagacttccctaagaggagtcccggacaccactgaggatgcattttcccttcctcacgtgaagagagcattaggtgcccttagctttggagggagtggagctttggagcctggagacaggggaccaggaccagattacccagcctccctagattctgctgaactcatctttcagtaaagaggccagatgagctgagctccacttctctctggctccatgttcctgtgacttttgactcatctgaggttgactttgagaaggcaatcccttttaaatatattggaatccatgtagtatgaccctatccactgtggaatcttactccattttactttaaagagaatgtaaatggtttggctgcacatcactatgaaaatggcctaagtaagcagaacggagaagctgccaggagagcagaggtggagagtggaaggggccaagccggttctaaatcgttttctgcaggctcctgtcctcagatgtactcacttcatgggaaccaaatcacatttaactgctctccagctcttaaaacaggataacttgagccatctgatatttgagaagaatacagcaacccagaagatgtattaatactctattctctaattttccagaataagtcagatcattgacaaatgacatacttgggctgtattaccttcctacagaaagactttcactaggtttagtaattagctatagcttcagccttttgttttgttttgttttgttttgttttgttttgtttttgagacagtctctctctctctgctgcccaggctggagtgtgaaggtgccatctcggctcactgtaacctccgcctcctgaattcaatcaattctcctgcctcagcctcccaggtagctgggattacaggtgcacgccaccacacccagctaagttttgtatttttagtaggtatggggtttcaccatgttggccagtctggtctcaactcctgacctcaagtgatccacccacttcggcctcccaaagtgagcttatgtctttttgaaggatggctatgggaaaagtccacttgaaggatgttttgtcatttatttacttactgattaattaagatgggaaagtcttgctatgttgcccaggctggtctctcgctctgtcatccaggctggagtgcaatggcacaatctcagctcactgcaacctccgcctcccgggttcaagtgatgctcatgcctcagcctcccaagtagctggaattacaggcacctgccaccacgcccagctaatttttgtatttttagtagaaatggggtttcaccaggttggccaggctggtctcgaactcctgacctcaggtgatccacctgcctcagccccccaaattgctgggattacaggcgtgaaccattgcgcctggcctcagctccctttagtttttaaagatagacttcctatcttataacagttttagatttacagagcagttgcaaagatagttcaaggagttcctgtattctctgcatccagtttcccctattattagcaccttaaaatagaatagtacattggttacaatgaacaaaccaatgttgataaagtatgtcaactgaagtccatacgtttttcatttttcctagtttttacctagtttcctttttctattccaagatcccataccatattacttatagttgttgggtctctggatcctccacagcaatttcttagacttgccttgtttccattatgaaacacttcagacataccaaaagtgtgtgtgtgtgtgtgtgtgtgtgtgtataaagaataccaatataaccagcattcagccctggaagcagaacatgaccaacatgattgaagcctcatgtatatccctcttgatctctttctccttccctcttcaaggacgaccaatatcttaaatttggtgcttttgtcccaggcatgttttgaaacgactatatgtagtgttgctttgcatattttattttatcgagacaggatctcactctgtcacccaggctggaatgcagtggtgtgatcatggctcactgcagcctctacctccccgggctcaagtgatcctcctacctcagcctcttgagtagctgggactaaaggtgcatgccaccacgcccacctaattttgaaaaaaattttctacatatgaggtttcacatgtcgaccagggtggtcttgaactcctgggttcaagtggtcctccctccttggcctcctaaagtgctggcactacagcagtgagccactgcccccagcctgctttgcacattttaaaacaatataagtattataagcattgctctacagtttgcttttttccccccacataacatgttttaatctgcattgctctaatgtatctagtttctaagtcagactctgttgtatgaatcccctctcttgttgatggatatctaggtgttttcctttctgttgctgtcatggtcattgcaaacagtgctgaacagacacctttacaagtcaccttatgcacgtgagcaagcattctacttggggagaggaattttggggtttcaaattttatccttaacaaagcagtttattcattcattcagtaaatattgattgactatgtaaaaactgagccaggttctagaggtaaacagaacagaaataatccttcatttatcatgagtttacaatctaattgggaaaatgaacattaaagaagtaattaaagatatgtatgtactatacagctgtatcataaaaataaagaacaatgtattgtgtgccatgaaaaaaatataaggcttattaagggatgtttcttaatgtttcttgtatcataaattacctaaagaatttctggacaggaaaatgctactctcctactgaatttatgtgctttctttatcgaacaatggaagcaatgtaaagcaaagtgtttcttttttgccttagctactaggagtagctctcatgtagatgctgtgcccagctgcagtgcctggaacagcccagctacatttagtatgtttatattttggctttttaaataaatggttttcatattgttctatgtcttgttttgcatgctgaatcattttgaatgtaaatgaggtatagctcttggagagaggacaagatatcattgataagtggttggtgacccccacttttcttttcagagacaaatgaccttgcttttacttggtcttgctgtatttatatagggatcttactgtatttgcatgcttgcttaatttcaatataaatttatgaaatttattatccatcaagagtcaatttgtcctctaaatatttcacttagatgatgattttttttaatcaccaccaacacatacacaaacagaactccttagcaattccatttggctgtactgctatctttaggaacatttatcttgctttaactcctctcttttttacagacatttagttttctgtgacattgtttactttcgttataccttaattatgggattctgataaccatggaggagtaggagagacaataaatggggttttgtgggtgattaaatgctaaagcaaagctgagatctttgataagcacaacagttgtttctgccagtatattccaaaggcaagactattcttgcaattacacaacaagcaaggggggagaaacacctcccacaaatcactctgatatgtttcttaaccactgtgcttttgaaagcctaatgctctttcttctgatgtttttttgactgtcagcctgagtagttggctcttccttggtacgaggctatttaaatgacaggtcctttctcagtgtgaatgtgtcagctatctaaatgagtggttgaaaatgtacctccgcatcagccatgtggaccacggcatggtctgaagaaaattatgtttgagcagctatgattgagctcaattttgcaaaagcttactgagttttaacaaataatttagccctatcaagcagaagtgcatttggctgcaggtaatagaaaactgaatcattggtggttttagcaagtaggttttctttttctcacatgacacagattggcaatactgtcagagacccagtttcttttgtgctttctgctctattttttgtagtctttcagcctttatcgttgggcttattgtctcagggttgcaaaatgactggtctgactgcagattttctaggagggaagtgcaaagtggtggtgctggccacagctttccttctttgtcaggacagcaaaagtttcatcggaactccccagtggacttgctctcttaattcaaaatggctgtaacagtgtcacgttggctgcacctgtttcaaagaaagttcagaaaattgggtatttcacagacacattaagatttcaaacaaagacgagagcattcacaaggaacagagagggaacgtatgtggatggggcaagtaactgccagtcatcagcctgttatgtactgtacacatagagttttgctgtgcagcagcaaatataaaaatgaatgtcatcaccatgaaagtggaaaaccgtatttcaatgtcatgcaaatgccataattgaaatgaaaagataggaaatgctggtgcattgtctacattaatgtatttggttgttgactttattgcataaaaagtatcagtggggacgagatagttttgctttgtttcagaagattttgcttttgtttttcccagctaagaagggaaccttaaaaataatgaggagggccgggtgcagtggctcacgcctgtaatcccagcacttttggaggccgaggcaggtggatcacttgagattaggagttcaagaccagcctggccaacatggtgaaaccccatctctactaaaaaatacaaaaaaaattagctgagtgcggtggcacgcacctgtaatcctagctacttgggaggctgagggagggagaattgcttgaacctgggaggtggaggttgcagtgagctgagattgcaccactgcactctgcactccagcctgggttacagagtgagactctgtcttaaaaaaaaaaaaagaaaagaaaaacacacagatgtatgaaatagagcttattaattctgtatatattcacagaaaacgcatacttttatgccttgattatctttaggtgatcatggggaacaggagcccaaagataattaacaactgtgctaaaacaacaaaacctcaattgggctacaaatgtcaatatcatgtacacaggtggaaaagactcttctttgatttcatatttttcttttatttccttggcatccctgttctggttatgtcttgctgtgtactctagacataggttttgtgggttgactgagctcagccgggtggttctcactggggtctcttatgccctggctcttaaatggcagctggggctcctacacatggcatctccatatggcttaggcttgtcacagtctggtggctgggttctgaggctgaagtttccaagagaccaggggggctgctgcaaagcttttaacctgagcttgcaagtcatgaagcatccactttccgttggttgtgctggacagcccagatgaaggggcaagttcccaaggacgtggatacctagaggcatggttcattagggaccaactttggagacaaacaaccacagtctccttccttctcttcccttggggattgaaagggttatcaaaagctggccagaaagagaagcaaagggtgaggataccgctgctgcagcacgtctgtagtagggaatgaacccagaatgtgaagagttgccattctagtaccctcgagtgtccttttcatgccattggaaacttgacaatagtaattgggagtgagttgaaatcttcagctttctacctttgtattgtcctttcagagcaaaaagaagtaaacattaacttaaaaaatgcttttgatattaatagttacaaacaaaaaacaaaacatgcaacaattccaagctcaaatcaaaaccaacactgagctttgaggtgcaatttctattctatgtgtgtggccatctcctcttgtgttagtggctgagcagagaatgctccattccaaaataaatagaattaattttcttaacagcatctttctttgtgccaagaacacagggttacaggaagcacatctgaatgtaccattggcaggttaaatcattctctttactttggtctttggtgggtttttatgtttgttgcttttcatctgaatgaatggcaatagagcaagttttaaaaatccttagggatctccagagattcctgtcttgctaagaaacaggaaggccgcaattagcagagaccaagaatgaagaggaggagaagggggcgggtgtctttgttgctgtaaactactagttttcaccattctgcaccttgggctgtgttgctgctgctacctggaacacccttcctccccctcctctgccgggaagactcccacttagcccagatgcagcccagctgctggcttctgcatgcagcccacctcttcttgctggacagggtggcgtcttgtcccccacacccacaattcctgtgcctatcactttgtctctgtattccttcctcagattgtagctccttagtggcagggaccagctcttagcctgatatcatcagccaagcaacgtgtaggatgcagaggtttggcaaaactttgaaagcgggaatgtatagtcaactatgtcgatgtctgggtcatttttccaatgtctggtagcaattgtgttaggtggcttatacctctcctggacccacacatagcaaattctaaaaataacaaactggaccatataagcttttccaaaagcctggggtgggggagatgttataatatcctgacatagctgtgctgttgttcatttcacctctgtcacctagagcaaccccctccatgttttccaaaaccgcccccatcctcggggtctggtttgggacccctgtcctcctggaggtcctctttgaaccctctggacccttctctcagagccctctggtaccttgatgtcacagcatttcctgtaatttcatttccctggcctcttggctaagataataggctcctgtccttgctttttctctgtcccctgaaaggggtgaagtcgtgtggacatgtggcaggtgccactattgtttatctgctgaacactagcactccccgtgccttcatgccatcaggcagggggcatttgttcttttgacggtgtggacaggggcagagtttagtggcattgttcttttttagcttaatgagcacgaactgtcagagcttggaccaaatttttcttgcagatatattttgattgacaggcacaggatttttggagataattgaaagagttgccaacatttatcaggagactgtacataaaaatacagagttccagtttccctcaaaaatttggaagttttggcaaaattgagtcccaattaccaaaaattgcttctaaccaagcagtaactattcccttcacacagaatgagcctcccttccctcatttcctgtaaaatggtactgcatgttctcctctttcatttgtgtcacctgcctcattggtgggtaagttgttctagaaaatgtctatcatatgtgctgctgtactgctaagtgcgtagagccctagtacccacagggcacacacaaacaaacctggtatacaaagaacttctgtgcggatttctttcttattgtgcacattttaaggggcatcagtctctgtccatgcatccttagaattgtatggctttttcatgatttgatttattcaacaaggatcgaacagtctgtttgtattgagtatttactatatattagttactgttctaagtataaactcattgatctcacaactctgagatgggtgcttttactatctccatcttacagatgagcagcagtttttttgttgttttttgaaatggagtctctctgtcacccaggctggagtgcagtggtgcgatctcggctccctgcaagctctgcctcctgggttcatgccattctcctgcctcagcctcccgagtagctgggactacaggtaccagcctccatgcccggctaattttttatatttttagtagagacggggtttcaccgtgttagccaggatggtctcgacctcctgacctggtgatctgcctgcctcggcctcccaaagtactgagatgacaggcatgagccaccgcaccctgcctagaagcagctttaataccaggtcacacagccaggaagtagactagctaatgtttcaccttaggcacaggtggagggagtcacacatctgtaagatttgttcccaggacaatatcattttctttaaatgtctgttttgggaggacttcaatgagctctcagatagaaacacccatttccagggagcattcttaccctagaaaaagcttgggacagttgtattcagacagctctgctgttgaccatgtaaggaactctctgccactcttcctcatagctttggcggggattatttgtctttagacttgttcctttttgtgaaagtgacagtagtgatagtcattagtagttagtagtcatggttacttttgttgagcacttacagtgccaaatgtagtaagcactttcaaactgtattactctccccgtttctacttgggaaactgagtattactgtgtgagtgatggggacttcttgaaagatcctaaacatgggaatgtcgtaatcaggttgctgtttcatggatttggttccgaaagccaagcagagagcgggtcaccagcacagtagtaagagtcaggaaaattggttgagactgttgtgtacaggggagagttgcttggggcttgaactaaagggacggtgaagagaggggtaggtttgagagagacttagaagatagtaatggcaaggcctggtaaaagacgggagtgatttccagttttacagtttggacggcagcatggataagaaagaatataaggggctgggtgtggtggctcaggcctgtaatcccagcacattgggaggcttaggtggccagatcacttgaggttaggagttcaagaccagcctggccaacatggtgaaacctcctctctcctaaattagctaggcgtggtggtgcacacctgtaatcccagctactcgggaggctgaggcaggagaatcgcttgaacctgggaggcagaggttacagtgagccaagattgcacgactgcactccagcctgggcaatagagcaagactctcaaaaacaaaaccaaaaaaaggtagaaagaaagactgtaagaaggctaagaaggcatcgtgcggacaggggagtgaagtgtcacaaactgtcagtttgatgtactctgtgactttcagttgaagatgtcacaagattacgacaaggagctcccagtgtcttcacgtagttttcccagcttactcagtaaatatttgttccctaaatgaattcatgatttccatagttactcagtaaatatttgttttctaaatgaatctatctgtaagcaactcaagtaatatcccctcctaccatttatcttaatgtttgaatttcatctccaaccacttaaatcatagtctctgggagatgggagctaggcattgacatttaaaaatgtatgttcggccaggcacagtgactcatgcctgtaatcccaatactttgggatgccaaggcaggtggattgtttgagttcaggagttcaagaccagcctgggcaacatgacaaaaccctgtctctaccaaaaatacaaacattagctgggcttagtggcatgcatctgtaatcccagctacttgggaggctgaggtgggaggatcacctgagcctgggaggatcatctgagcccaggaggttgaggctgcagtgagccgtgattatgctactgcactctaacttgggcagcagagtgagaccctgtctcaaaaacaaacaaacaaaaacctttgtgtccacagatattctaatttgtggccaggtctgacagccactgcttcagttttaatgaaacaacagatgaaacaggtctactgagatgttcttttactcatccatcaatttcatttttgagtgtctaccactgttttgagctccatgaaactcaaaagtaagcattgatgtgttcacctctgtgttcctagtaccagaactgtgcctggcacagaataggtgctcaatagatagttgtagaataaatgaatgttttatgattctgagcacttagagaatactgcgctctagtaacatacaaccatcagtgtctgtagctgtggcaggaggctttctgcttctgaggtctctctgtctggactgttgtgctattatcctctcatgtttcttcaaggcagaggggttgctgcctgggaaaggtgtacactttggagagtgaagtcagactttgctaagtgaacgcttggatacgtgttgtgcatctctgttcccaagtaccttctctgctatggactgaattgtgtatctccaaaacttgcatgttgaatctctacccccagtgtgatgttatttggaaatggggcctttggaagataatcaggcttagatgggtccacaaggctaaggccctcataggggaattactgcttttaaaagactaggacattctctgatcctttggaagtatatttcctttccatcctcttctctattacctgccttccacctgcatcattggagttggcttcttggtgttgacaaaccttacaatactcaggttgaagacaagagcagccgagaaggagcttttgtagggagtggttgtcagtgtctggtgctttaatatttccttccgttgggatttggaaaaggcagtcccacatagaaaattgttccagccgaggaacagcaagtctgtctgtcaatctctgggtatattgaagacatctctctgagtatattccaaatgtactcatcagtgacgtactgcttctccagaaggtccccttaggaagttgaaaaagattctaattcctaacacagtagctcctgctattttcctatgtatgtttttttctcgcttttatcttctgctttaccaaaatacatttacataaacaatattagtatgtgtacagaaaatatgaataaagaaataaagattaaaaaccttagaagaaatgaaaataaaaacttaagaattggaaaagaattctaaaatctcaaggttgaccaagctggagggtttttttgtgcatatttattgcagttctaccttgtgccaggttttagatactttcttttaatcacagaactttacaagatacgtattatctctattttatggattagaacatttaggctctgaaactcaagggcatgtagctgctacatggtagagtcaagattttaatttagcatgcctaactgtaaagcacctttccttggtctaaaggccagtgacagttcctaatgaaagttttcacacgtacacaatgaaacaagaaaatgaagacagtgtagaagatttttgataaagcaaaatacaattaactttaagaaacctgttcattattttaaaatacctatattggctaaagtttggcaatctaacgtcagacccctaatcattatatatatatttttttcttaaaagtctactcgttcgtgaaatcacaagttcacactcagggttcgtgatttaatggtggaacaaaacagaatatttaaagttgggaatgttccagaaaagctagatttacaagattgtcttaaggccccaaagaggaaacaaagatttggcttgctgatcagagttaaacattgtgtacaaaataccttaggaggaatttgagacctccgttatttcagacttaggaaatagccctttcttatctctcatataatggtacctgtctctcaggaagctaggcctcccttgcagtggtaatagctggcctgtggagccccttcacattgcattacggcaattccagtgcctccctttcccgttaggaatctaagcttgtactaccttttaaaatatcttcaagagtcaatatgtggatatctgagtgtcaaatctggcatgcactgtatttaagtatcacttaggaagaaaagcaaaaccctcagccccttgaaatgatttttaaattaactttttggtggaaaagtcccattttatctgtgcaacttaataccctttgtgcaattttagccaacttcttgaaaacacaggaggaaaacaacaactttcattatctcttttgctctgaatagcagcaatcatcaaaccaacatccaccaccttcttgttctcctgaacttacgtatttttgtatatgcaacaacttagggaaaaacataatggcaggaaagaaaaccttttcccctaagtaagaaaaatcacagaaaatcattagtgtgctaattaaggaacaaaaatcaaattgtgaaaggtttcttacccagattgaaatgaataggcctgggcttgttcccacagtggagacagggctcccggaagtatgctggaagcatgcaaggccacttgccgcctagactcagaaatgacacatcgtcacttccaccatgttccattgattaaagaaagccattcaggccagcccagattcaaagggtggaggaaacagaggttgcctataaaagaaggattttgaccatttttacaatttaccaaaggagtgacttggtcgaggatattaactaatttaaaggagttaatgtaggtgaagctcttagaatgcctagtgcatgacaattgttgttttgctattttttattattattactgtattctctctaggcgtttcccccaggagcttattgaacgtcctttaatcttttgttttgtttttaaaaatgatgttggaggaacaacggtgacttttcaggccctggaaatgctacatatgggatggtatcgtagaggtgtttctttgcctcccatgggcgcccccggttttgctctctccccctctaggtggcgctgtcggggatccccagctgtcccacgttgtcttgcttttcctttcctctctgtcaaaacgaattctcattcttgattcttaccactgcagtgtttaccaactttgagtgatatatttcccttttaaagaaaagcagtcttgtgaatttagttgttgttttatatttttattatgttacttaaatatgtacaaacataaagctatgtataaactaattatgcttgctcataacttttatgcatttataaaataaaggaaatgaaacttgaacagaacagatttaaaaattaaaacttcagaatttcaaaatagcagcattaacctaacatgacagatgatattatttttactaaaactacatccagacgcaaagccaccgtggcctttgatgcctcagttaccccacaccttctctgtttggactcctgcaagctcttcgaatacagtgtgctgtgaaattattatcaagttgattataaacacaaatatgagaactgaagttacctgacagtgcttggttataagatggctgtttaacttagtgctctcaaattttactgtgcaggtaactcaccagggatcttgttaaattgctcactttggtacagaggggcaggggtagggtacagaattctgtgttttaaataagctctcaggttatgcctgttggctgatctgggaatgacactttgagtacaaggatctgactatggttccatcatttgtttagattattaaacacacaaatatttaagaatcagtcgaaaacatgtttctggataggtccttggtctctagtctagtcactgcactaaaacatacaagcagttaggttgttagagcattatactagccctatgggaatcagatccagacaccaagcatgaagttgcatgtattgagtatcaggcatcagccagtaatatagggagggaatgatgattgtacaaagacctccctggacattccagatgcaactcacagatgatgactccttgaccagtgggacaggcctgatgtggttttgcctctaataaatcaaatctttccatttttacccaagtaaaattttatttgtactttccttatgatcaccactcacattttgcctggtcttacagtttaaaatgtggtacagctttctttttctatgttaatattctgagggcaaggatcatgttctattcctttttgtacttttcatacagcaggcatacagacatttgtggaattgaatgtattagctagataaatcttgagggtgccctctgctatttgcataaccaagtttttttctgaaaattccaggaattttgctctttctgttatatttcagactcgttattttatttactactgctgcttttttttcttcctaggaaagattcctaagatttaaatgactaaagcttagtctctgatatttgaacataaaccacatttttattgctcttggctctcaggtgcgctttgcttttaatttttatctgagaataaatgttgagaagattagaaacgcttatttagttgataatctgtgtgaccagaatttatcctttctaaatagttccatagcagtcttcgagagagaagttctggtagaagaggaggtagagtgagttgttctttaaaaaggaaatgcaagtttgtagagagatacccaggtgtgggctttatgcatgaaatatttttcctatgagaaaaaggaaaacagtgcctgaccttatcaataaaccattgtaagacgtcttcagcgtaggtcccaaggacattccaactgttcttttggactgagaaactctcaggtagtggttgggagaaaaagatccagaggtcgcagtgggatatttaacaaacatatgaatcagctgtatagcacatcagagaacagagagaccagacataaatgcataataaggcaatattctcatgatattgataagaactttttttctaagttctgttgatctgtctttctacccattcaatcattaatttaacattgtattgagaaattaaacacagactcaaactacacaaaataagcatagtttaatgcaaagattcccaaaatatggtctccagatcagcattgccttggaagttgtgaaaaaagcaaatgtttgcactccagtggagatttactaaatcagaaactatggaggtggggtgtttattttaacaggctcttccgaagcttcccatgcatgcttgagtttgagaaccagtggcttagcatgaactagtatgaggtggacactttgaaaccagcacctagctaaagaaatagacctgccagtcacttcagaagcccctccatgtgtcccttcccagccataattcctttctccttccaaattacccactctcttgagttttccagtaattactcccttgcctttttatagttgtgtcactgaattgcatatccctagccgcaatcatttagtcttttccatggatattaacttatctttcagtctatgcattcccccattgtcccctccttttccatacagtgtatctgatgaagaacttggactgttagacctgttggaggttctcagagtggattttgctggttgtgtactcatggtgcagtgtaacatgttcctctgaacttcctgagtatcagcagctggatataggggtttcatcaaatcttagtcctgtccttttgctaagactataggtgggactgcgttttttgtttttttcttttctttttttcatcaggaggcgcaggaagtctagttctcactgtattttgatgttaacagccatagatactcaatacttagatcgattgagagaagcataatggtgacagtctgtcatttcattttcatttattagctggaaagtcttagatggaataaatttagatcactatatggctaccttgtggtagatttcacacttgaaaagccggttgaatgctcagttttccttttatttacctaattttcaagatactgaattgcttccctgtcatgttcagaaggggaccaattaaagaaaaaaacaaaaaaaaaacatgaactactaggtttaaacgtagtggaagagtaatcaaaccgtagcaaatcatccctattgaagctcaaattgtcccatttttggccagtgggagcctcttcaacttggctcttgattccttttggtataactctagcactatttgattccttccttttttattacaggctcatcttgtgtatttcctgccccagaccaagagtcagccatttctctgagaatgcaccctgctcccccagttctttttgataggaaaaaaatgtcaaaaccacaaaccagattctcataactactgacttgattcttttttactgagtcttttcaatgggcaaaactgggaaatatccacttctatatctatatagctttttctatacctatacatagatgttatatgtatttaaatatatttaaagttaaaatacctcatgagtttatactgatatttccaattcaggactacagggttttaacgtcttctgtatggcatctatatcttctttttcctgcccaaacaatcttgattctcaaggacatagagtatgctagattagaatatgtcataattactcatttgcatgcttccacattacacacacaatattaatactaccaccaccaattatgattactaaaaagaattaaaacatttttgtgcatatgctattctcattttcctctattattttatagttatacctaatctgtttttatcaggtaatagttattaatgctatactctcttccatttaacccccatttaatgttcttagtttcatatatttgatggtcatcaccattttcacgtcaatgacatgacacttggttgtccaaagctcattctgtagtagtcgccttaggaagaagttatgggaacagaataccttgtgttcttacatgttgaaagaatgttttctctacttaatgttcatttttgcttggatataaaatccttggcttatattttctttcattgagtaccctagatacattagatcatatccttctggcataaaaccctgtcaaattctagtgataatccagtttttattttttcttacaagtcacattctctttttgcaagaagcccatagagattttttttctttaaagtcttgtcattttactagcatatgtcttgatgctgatagttatgggttgttattctcacataagtagtttctttttttgtatcttaggacagtttttcttgatttatagtttttaaaatttgttatgttttcttgttttactgtttctgccttctttagagactcctgttgtccttatgttgcatcttacttgtctgtcttcaaaatttatcaattcttgaaggcttcttatctttcttaagttcttttgatttttttaaaaaaatttaatttcccccttctacttttgaagttatttggttttattattcactcttaagtttcttctagttaagcctttttaagaacatttctaattcttttctaagctctgtcaccttatttctgaactttttctagttccaatttatattgttccttcatgtctagcgtgttttcttagtgtcttttggcaaatctggaaattgtatgttagaattgtgatctgattttggagccagttttcttggtgtgctttcattatctgtggaaatgttgttttattcgttttcctcttttatccttaagcaataatgtgtggaattttctctccatgcttttctgttgctcattttcctcacgttttagaaagagactttgttcagatggatttttctaacttcatagagctctgtcttctattgtttttatgtaattttttttaaaaaacttgctttgtaaatttttatgttgttttttccttttccactgttacctgaatcttctctttttttttctttctgttttgctcaattttatttttttcccagcagcttctctccagtgtggtaccttgttttgagagcaggtgctggctaattgtgtaacaatttgtgatttatccttacctatttgtatcttgatgtttgtgaggataccttgtctcccagttttgttgtaaatgtccattaatttttgaacattctgtttgatttcattgctctgtctttcgacatgtagggattctaggagttccaaaaactgtgtcactgctaccactgccatctcctcaggaattcctcagtttttcaaatgatgatttttgaaattttagagtctataacttgagagatatagcatttttggagctgggacaaaaaagtttttaacttaattatgggaagtaatgaaaagaattggcttctaaaatgcaatgcagagatgcataaatgtattctctttatcttgcccaattacagagcaaaatagatgacaatacagaaataaacatggtctggagtagaagtaggttaatccgcatgctttagattgacttacagtatatacactttatttcttcattcagtgaataaatttatatagtgccttacaatggacagatactgtacaacataaaaaatatgttgacccttgcctgtctggcctaccttgaaatgctgtgtataacaaaattacacacagaagacctcagatgtggcaaagtgaagtgagagggaagtgactttcccaataccacacagtactttgagaattagaccacaagcctggatatctgtaactcccaatccaagacttcttccaccccaatattcaatctcattactaagtgtcaagaaagtggatttgttaccaccaaaaaaagaaaactttctgacattgagtgtgtgctgttttttgaagaatgttgtgaattctctgttcttaaaaagtcagtagtgcagctttcaatgtagagttcttttgttcaggcttacacaactatcaccattcaccagataacttgctgtattccagacatcattggctgctttgtatacatattcttatttaaccctcaccacctggcaaagcattgtcctcatctctagtttacagaggaagagacttattttaactcagagtatgttgtccaaaattaccctgctaatagactggtgattctgtggaaacagacactttcttcttttatatgtaaagtgttctgggtaacaaataatacactctcttctcatcactgtgggcaccatggtctgggtgcctcattggcctctctatcccctcccaacacatacacagaagagaggagaggagagaagcatcctaaatgcttgactctctcggcagaaagtctactgtgtctaatggtcttgtaggagggaggcagcgacatctctctccctgccttcttcctttccattcccctctctactaaattagctccctgagcatcagagtgtaaatccagtttctcttacttgtgcaaacatggacattcttatgccactttgtgtgtaaaatttttacatgaagtctataacctgttgctttggtatgtaaggctgtagaatgagcaataacgaaaaccagaaatgtttgggggaaagaagtttttgtctgatcttctatattcattgacccagacaagtgtcacaaggaccatgagagtctggggagcctgggacattgcccacactctgctaatgaagaaactgaaccacacctacatctttgtctagtcacacctagcagcctctgaccttgctctccttgcctcactctgatccctctagaatccattgcacataccaaccaactcaggccctaaaactcttcttttgtgaggttactttccagtctttaacctattggctttttctcattgttcctcaaatcaaatctgaactccactgtctgcaagactctcccgttcttttcctgaccaccttggctgacagctcttggagaagagggcttagattgataataatctgtgatcctttccttccaccttgcctagctctgccagttcatggagtaacattttcttttccacagttactgtaaaaagaaatcgattctttttagctaaagtaaatgacatccaactctccttacatggaaaaaaggcactaaagtgctgacagataccatctcaggaatggatggatattcttgctgtttctcttccaggacaatcagaaacaaatttaactggtgaatggccattccatgtggaagggaagtggtaacatagggcactagattaacctagtgcacttctcagtaggattcatggtatttctatgtaatttccacttacaaattacacatctaatagaatcttaaatgggaagacaaggatgagtcatatgcccaatccacatttatgtcttcaaaatacgctttgaacaacaaagccacatatacatgttaaaaggcctagtaaacttctagaacactagaaaatcctgattgccaggatctgttagtcactccactccagacagggttttgacaaaatgccttttcccaacagaggttaccatcttcacaagaagaccacatttgtatatatgtggccagcagcattcgccagggtacgtacctcaaggaagcttcaaatggccattcagtgcgcactcaaaagggatcctcagaggagcattcagaccatttgcttaaatgattgtgtgctcattaaggtgggcagatctgcagtctcaactagagatctggtagttaatctgggtccaggatgtttcttaactaaacatgttaaaggagccggataggttgctctctactgccaatttatcggttttacttttctccttggctacagtgcaatttggctctttggtttaatccccttgagaagccagaatccattggcatgcggagctctgggtcttagagcaatatggctctaaaatgtacgaggtttattctgatggtccctgtcacattagcagatggtggcatttaccatgttgatgggagaggagtccttgtgctctcagccacagatggcccgggaggctgtcccagcagcagcacctcaccctctccaacacatgccatgtagttagttgttccctctctttgttcctataccacttacgtttgcatttctttcatgcagttcgttggtggtggttatagtcatctgttttgatgcgtgctccccatattaggctgctaaggttttaggggcaggtacctggcttctcctccagggattaagagatgcaacgctatgctcaaggtcacaaaggtgctgagtggcagcagggtaggattctaagcctcattcatcagtctccaaagttcaggcttttaattagaaggcctgtcatatcatagaaatcacaatggtcctcttagggcaaaataatgggtgtgaaatcgtggatggtccaacgataattacaataagaatcgtttatttgtttcttagaaactgaactaatcattttacaggcatcatttcagttagtcctcctaatagtcctatgcatgaggaatgtcatcaccattttcagatgagaaaattgagtgtcatagaggctaaatgacttgccaaccaggtcacacagctagtaagtagctccaagtctaacccagattgatgtgattccaaaaccctggtcttgggcatctgactgagaccccccaatgtatgggtgccttgctttatctaggctcagatcctggaggtcatttgttgttaccttgaatataagaaacacacagggggacaggcagactctgaaaatataaagttcattcccctgaatcaaatgcagaaaacagttctcttatgggttgtcccacttttcatttgaacttagtggggaccacgggaggggctgttgaaaatgaccagctctttcctctgccaggcttcctacacttacacacacacacacgcatgcacgcatgcatgcacacacatgcacacacacaccccacttcatgcttagacagtgataaagtgagtagctggggcaagccccccgacatgtggatgactatggtggtggtgatggtaggaatggtgccttatattagtgtaccttgtacgtttacacatatttatttgatctacctcaaggtaggtgaccaagtattatcagtccctttttcctcatgtaggaagaaactgagtgtcagagtaattgagatggagcagattcagactcaggactcctgtttcctgatggagtgcactttctgctaaagtaatagctttcaaactgtggtgggttgaggagccccagaagccatcataataagtgagggccaggggactcaaagacctacatcctgcttcaactggagcatctctgcttttatttgacgggtatagagggttctgcatgtggttttattttatagaagggtctgatgttctaacagtttgctactgctatgtaacaaaccactaccaaaagttagttaattattattgcccatgcctgtgtggcttggcagggctctgccagactgctctgctgcaggtggtggctgtggggcagctgggatggctctgttcctcaggcctgtcactctccttggacgggggatagatggtgcatgtcctgcacatctttcaggcttagacttggaactggtatactgtcacttccaaagcaagtcgcatggctgtgcccaaagtcaaggggtagggaagaacattgctcataatgaggctatggcaagggaatggacgcagagaggggtgaagaactggggacaataatgcaatctgcaagtccatgaaaaaattgtattatcactgctctgtttaaattaggctattaaagtccttcaagacttatttatccataaaatcaagaggaaatggctgttgtattgtaaaagacaaaggacttctacccagagataatcaggtctgaggactgttgcttctgaatggctgccagtttggattgtggtcagtgttctcatcttttcacagctttactcaggtagggtggatgtataagtgtgtgtgtcagacagagagagaggtgcaaaatagaagcacgcctctgtctatcagccttgtcagcttcgatccttgtttagtctgtgctttatcttctcccgtctgtcaatgatgtcccccaccatttactgcaggcgggtctatagatccagtctctcccctgccagtctctctttgtttgttgccctggtgtcactgcacctctgagctctaagtctttaccttctgaaagccattcctaggacaatcattaaaacctatggtagttgataatttctgaccctaggctggctaatttgccttcataaactgtcagattctgctaaggtcattgaatgctgtcatcttcataatgtggttcaagcaaaatggataagagaccaaacaaggagaaatctccctagaacacagtatgccagcattgctgtatctcaacaattaaaaaatggtgcgggagttacccagtagaatatttagtgaggtgtactctatgtggagttcataaatacaaatgcaaaatatttaatgcacagaatcagagttgcaaaataagatttaattctagaggattagggagacagaactgacttaaggctgtttttcccagtaagcttaattacttggatgacaatcattaaacattgcaagtcacctatcccaagtgatcgaagggcttttcaccaaatgtctgagtgagaaagtgattatcttatagaacaaacaagtatgataaagggaaacaatcagacaagtaattatgataaagaaaaacaagaaaaacggcacatccagcctgttttgtgggaagaatcacagaggcactatgtaagtacggctcctttatctaacagatcatttactaactatctggagtcaaagtcaagtttatctacatgctgaaatctatttccttctaataagattccatccacttggatctcagttatgtggcaatcttgacatggaacgtgtctcggaatatggaagggcatgagaaggcaccaaatcttcaaccctagcgctcgctcagggtttgattagagaagcagaatcacaggattattttacaggatttcttctctggatttgacttacgcagctgtgggctctaattaagcagacaatggaaagttgctgtgtctctctctgatgctgggacctgaggccagcagggtaggcagttgggaagggaaaatggacacgaagctggggaagcaaagacaaattagaacccatggggataagctggaatccatcaagatggactgaaacccacattggtctcttgctgcctttcaaggaacttccatgatggaggcgacttccaggagaagccgactgcccttctccatggaactcagcctgcatctgcccaggagtcagaggaggtgagggaggagatctgggaagggctggacaggcccatctgcttcctgccccctcagcctgctggtgagccagcagataacccacaaaagcctcaacagcccctggccccccatcaactttcaaaggcaccaatgcaaaagactatagctactgcttcagttccttcttccaaatgtcatatgaaatgcctcttaggggtctatactaacccagaactgtgcaggagagagaaatctgggaaacacagttccagcttagctaggttgacttgctataagtcaaccacacctagtctcactaagcccatttgtcatgtgtggcccactcagactgaaagaatctttgttggttcactgttttataagggccagcctttaccagtttgtccagctagggcactaagttcttagatgcagacatcagttctgtattccctgttaaggatctgcttccttaataggaatctttaaactcctgaatttgtaatgacacattcaaaagcattatttgagactaagcagtaatagtgtatggcaagctggacttacagtcctgtgtgatgtagagatacctaaacataaatgggcatggatattgtacacacatatgtgatgcaaataatatacaaatattgacataggatgatctagagttgataccagacagtcctcatcagtgcactgatgaaaccccagaagaaaagaggtttagccagcaagttaacccatgctgatgagcatctaccatgtggcaggtagcttctagaggtgcaggggatacaacagttaatggtacagtgtcagccgtgaggctcttacattgttttccaggttttctcaaccatgacatcattggcattttctgttgggtaattctctgttgtatgcatctgtcctgggcattttaggatgtttaacagtgttcctggcctttgcctactagatgctggtattcctccctctcttcatccccatccccgctgcagttgagatcataaaaaatgtcattaatcattgccaagtgtcacatggggcaaaatcatcctcagttgagaacctgtgtttcagaagagacagaaaaataccactgagatactttcagatgctaataggtgctcttaagaatataaagtaggctgggtgcagtggctcatgcctgtaaccctagcactttgggaggccgaggcaggcagatcacttgaggttaggagttcgaaaccagcctggccatcatggtgaaaccctgtctctactaaaaatacaaaaattaaccaggcttcatggtgggcacctgtcatcccagctacttgggaggctgaggcaggagaatcacttgaacctgggaggcggaggttgcagtgagctgagatcatgccactacactccagcctgggtgataaagcgagactccatctcaaaaaaaaaaaaaaaaaaaaaaaagagagtttaaagtagagtgatatggttacatgactaccaaggtggttgaggaagcccttgccgaggaagggcctttgatttgacatgcaggcagcccctcagagatctggggacaaaatgcatcaagcaaaatgaagagccagtgcccaggtcctggaggggaacaaatgtggcatgttgaaatagcaaaaaggctgggagacttgcagcatgggtgatatggtttgggtgtttgtcccctccaaatctcatattgaaatgtgattcccaacgttggaggtgggggctggtgggaggtgtttggatcatgagaggagatccctcatgaatgtcttggtgtcctccctgaggtcatgagttcacacagcatctggttgtttaaaagacctgggatctcccgttctctctcttgctccagctctccccatgtgatgcattggctcccccccacccttcacctttcaccatgattgtagcttcctgaggcctcaacagaagcagatattggcaccgtgctttgtgtacagcctgcagaactgtgagccaattaaacctcttttctttatagatgacccggtctcaggaattcctttataacaatgcaaaaggactaacacagcaggtgaggaagggaagagaggagggcatggggtagggaaggacagccacaacatgggggaccttgtgcatgggtcatggtgcacgatctacatttaactctggctactcagggcagtcatgggagagatgtgatcggggagtgatgcaatctgatttatgccttaaaaggaccacgctggctactatgtggtggatgcacaaacagctcttccccttctgcctcctttgccttgtgacccacaaggacccatgatacccacctgcagctggctgttgccatctattcggagttgtcaactaataacagacaatctcctctgccctgtgacccacagggacccatgatactcacctgcagctagctctttccatctatccaaagttatcaactaatagtagtctctgtgcctacaaatgattaaaattgggcttgaaaatatggcaccattatcatcagcatttcttgagcgctggccacttgtttctggtgctcgtgtgtgtacatgaacatccttgctgtgagtgctgggccccaccctcactgccatttaaaaaaaaaaacaacaaaaaacaggtgtctgcagcctctggtgaacatcagcttctccgtaaggctataatgggagacaccttcatagattttgagttcggctaaaataccctcctgtccagttactacctataatgctcttttcccttggatcagaaagccttttctctgtggattatttccctccatctataccccacattactaccccatgccttcataaggttttactctttactggcgttatgtccatttatatttgaattacacaagcatgaccattcatgctctttactcatagaagggcaccctgcccttcctggaaaaatgatttactttcatattggataccatttgaatatacccagctgtctgcgtggaaatagagaagtagacagaaagaagcctcctgctacagcctaggagcagaacagtaaacccaggtttccaaaatatctttctgaggtcattacagggtcatagccctggacagcactattcctaagtcatcctgaggcattctttgtgtgacaggcccaatggcatggcaatggatttcataatgaaaataatgaaacattgagataaaaagttaatttcttcctggaagagtctatttaataatgcaggaaaatgttacactttttagttatacttaattataaaatgctagaaaaataggagtggttttggtgttgaaagagttatttatctgagagaactatgaattatccagaatgcttctctaaagtttcctttttcccaaaattttattatttggcataatttcagtggaatcttccaaaagacattagtccattcttttgcttcagtgcatgtttttttggatagatattatctatttttgtgtagtgttgtaaggtttccaggatacgtaaaagttggaggatatatggttggtgcaaaataattccgtagagtaatgagattgaattgggggaggtggtttaaggaatacaaattcagtttgcctaaatagatgtaaaaaggaagggaaggaataacatctgaagctaaggaaggaaacttttgggctggagcatgactagataggagtcgggtagagctttttaacacagttgaagatagctgtggacgtagatcatgggcaaaactggtaatgtgaggatttaggaagcacgtttttaagctactgttgagtttcataggaaaccataccccactggtcataagagacattcaccaatagttttccatgggccttttgtgctagtggtagttttgttgggggcaggatttacaaaaatgaccatgcatttgaaaggtcaatgatgaaggtaagtttgagaatgaattttccatgaatgtcctgcaagttttattctttctgtgaacagcttgaattttcatttggtttgaagattaggaaaataacagtcatatatactcacagatcaaattcaagtactgattttagccatctatgagcaaaggccattcttggtgttagacatgaaacaaacgagagagaaagaaggaaagagagagagaaagatgtgatggactgccttggttctcataatttagaagtgagactataggtatatgcacaaggagctctgatgtgaaacatggatatcatatatgtcctaatggaaatgcacaaatatcctaatgggcttaggaagatttctagaaggatagggattccaatctggtttaaaagaaaagcctgaaaccttggcaaatgaagtcagcaaggatattccggtagcagaatgagcctgggcaaaggtgaggagtggagtgttgcctattttgttttgtgaggatgatagattcctgtaactggagctgcggaggaagtagatgtattggagattgtccttgaaagtatccagactgactcagacagcaattgtgaagttcttgctgatagatttgtactgtattttccatgcaatgcaagatccattagagggatttgagtaggagattgtcatggaatatttagaggatataattcagatttaaaccatggaatattttccttgatactattaaggaatgatagattctttgagctaaaaggagcactagagattatctattgaggtagtttccaaatattgttttagcacagtggaaaccttctttcaaatgacatcttacacaaatgccccagctacaaaacagatagaagagcagttcttgtggaatcatgatgggaagagtcttgatttgctgctttctgtttcttcattcctgtagcaatccctgaggtacctctgtagaaagcacaaaatcatggaacaacctgccgttttaaagatgagtaactcaaaagaaatgaaaacatattatgaaaccacacataccataacatcaccagcagccttattcataataactgaaaagcaggataccacccaaatgtttaacaggagaacggataaactgcgttgtgttcatacagtggaatagttctcagatgtgcaaagaacaacttactgattcatgcaatggcatacatgaatctcagaaatattaagtaaaagaagcatgacccttggatttcatttatatgatacacaagaacatgtaaaacgaatctagggggaaagaaattaggaagtgatggcctgggtggcagggaggagaactgattcaaaaggagcacaagagaactttctgggatgttggaaatcttctctatcttattttgcgggatggttacatttgtgtattccgttgtcaaaactcatcacgtggaacacctaaggtgtgtattttattgtatgttaattgtatcttaatgaataaaagttgagtttgaagattcttggagggagatttgctcagttcccatagctaggcatgagaaagactagcagctagaacttaggtttacaggattcctggtccagctcttttaaccgcatctctctccctcagagtcatcctcctcttcaccaacacagcatcaaggctggcttctccctccctggacatcctcttccctgctcaaaccccaccgtggctgtgaagtattaacttgacgacactgtgctctttgactcagcttttaaactttcctccagtgaaaccagaactggcaaacacagctacacttttcttgtaccatgctttacctgtattgccaacctgctgataaatggctccattccatagccttgagggtcttgaatagcttaaacattttatagttccatgggaatgagacaggggagaagacaccagtggcttccattgtaggcctgtctacactgaaggaatgccaactgcccacacacacttgttgttagatggcctggaggctcatctgcacagacgtgcagtttaactccattagggatcacagagtgatcacacactgtgctgtgctctttggtatatatatgaaaagcatcgctaagagaatgggagaggtggtgagagtttattgctgccttctttctcatggaagcattggacagcagggcagccctagtgaattgttgactgctccataagaatatcttgctcatttaacctcttctgtactaggtcttctgcctggagagtcctgggctacactgcccatccccagtatcccatgtattcatgtcagattcttgcagtctcctgaggatctttcaaggactggaactgcatcttcaccatctttgtgttcccagtgtctgcaacggtgccttattctagaaaagaacatcttaactgggagctgttttgccaggaccatcatcaaaaatgtctgaagatgtttttggttgtcaaaactggggacagggtgctactggcatctggtggataggggccagggatattgcttatcttcctacagtgtacaagacagttccccataacaaaaaattaccccacccaaaatgtcagtagtgccaagatcgagaagcccttctctagattatactttattgtatagaagataatagatcaaccacatcctcaaggctgggaccaatgctttgcattatgatgggtgtcttggtttcttttatttccactcttgattctctaagcatcatattcaagctctgagatgaggtgtatctgactgggtcaggtagccactgagcaaactggaataggcctttctgcagagtttgaacccaagtcaatgttgcctcgactcaagctcagatacctcatctaatcatcagtagccatagtaatagtagcccttagcacagaccactgatatctactgcttagaaggggtttgtgggggtagaaaatgaggttatattaagtttacttgcccaaagtcacacagccagtatgttttggagccagattcaaacccaggttgtctgaaggctccaaaagtcatcatttatcactgtatattttcttcttagctttcttgcatttcctttaatgttcccatctctccctagtgaaactgatttccctcaccaggaggttctctaggaattttggtccagggcttagattcttaaataagagcagggacatcaccatgtttgttatacgctgtcatttcacctcctctgttctgaatcagaatgaggccagcactctgggttctaagttatcgttttttttttttttttccattctatatactccctaagaatcttttttatgcttaaggtacaagtttaaatatggaaaaaaaaatctagattgaaatgaaaagccagacatttcctagttatatcactaattaactgtgttactagtgataagctgcttataaatctttcatcattaagataagattaccttctagatcttaacatttatgatcacagggataagttttttgttttgttttgtttgagacagagtctcactctaccacccaggctggagtgcagtgtcacaatctcagctcacttcaacctctgcctcctgggtttgagcgattctcatgcctcagcctcccaggtagctgggattataggtatgcaccaccacacctggctaattttgtattttttagtagagacacggttttgccatgctggccaggctggtctcgaattcctcctgcatcacctcccaaagtgctgggattacaggtgtgagtcacagtgtccagccaggatagttcctttttattgtaacatatccattttttcttcatttatacctccagtatccaacaagttaggatgcaggaattaagaaagaatcgtcctaaagtaggaaaggcaagatttgatgaagttggtagaaatcaagaagcacagttttgtaagctttgcttgggtgtggattgggaagctatttcttatttctccaagagtgtttagcttctcagacaatttctgcctcagtttccccatattttaatggggggaccaaacacagcatggtcatgcatgacatgtgaccgtaatgaaagtgtgactagcacattggaaacctggtgtggcagaaatcacacttagaatcaggtcaattaggagtcaccttagttttcttattgaaaattatgtgtaatgctgaaaaattaataagagagttccttaaaataacagactgaatttcgaagtttaggtgataattattttccgaagtctgacctgcccaagaccttatataagcacgttatggaaagcaagagtggtatatctttactaataaataagtatttctccaaactttgaaaaacattctgaagcttcaggttaaaaatatgtaaatggaaatgccctccacttgactgtatcacagctgttccctgtccctcatttgctgaaggactgagtacaccccaaactggtcagagcatgatgactttcagtaatgacctaaatgaccttaaaatatcagtaagtgacagagtattcgaagtcacagtctataacattcgcttagaatttccccttaagctgctggctgaagcactaattaagatctgaaatggaaggtaggtgacagatgctttgtgtcctgcagcagaggcacagaatgctgttctttcacttactgtttaataataataataacagccatttaatctgtttgctgatacagtctcctttgctttattatgttgtttattttgtgtgagctttcgatattagttataaaaatgtcactgtgtctgcagctgcatttttcattttagaaactcccagagatctcatcaatttaacctgccttgtacagttcgcaggaaaccactacaggcaaagataggcttaatcaaggttttttcttaataacgaacacaatacacaggaaagcagggcaacgaatgagcctttgattctaggtaaagacttattatgtgaaaatctatatttaaattaggggctttttgctaggattcttaactgcacaagacaaattactgtaggatgtctctaaacagcaagtgtgtcttaggcatttgaaatataatttaatctattaacagtttaccctagattttaagccattcattgttggcgaacacaatctagattctttaaaataaaaatagaaaagcatttgcagtaactggccattattatagctatagaaatcaaaggtatttcttgtataaattttgaattatatattgtttatctctccttaataactttcactatagaaagagctctctttcttgctcaatttacataaaagtatctggaacagttcagtgacaacagtgttggaaattaaggactgacttgagactgaagctccctccataactcccatgcccttctccagtactaagtagtataaaggccaaaagtcagataaacaacataagagaaggtggcagtgctagagatggggatgaggctgtttcatataatggaaggacaccagttgacattttccaaagattttccattataatcttttgcaaaggttctctttcactagttaacaaatataaaagatgccaactcccaccagactccagatgcttgtaatagaattagaaggccctccaacctttctttccaggggtcctgagggggacgtctttgttggcaccccaagcctgagtcactcctagcacctcaggaaagcatgtgttgtgtggcttcaaggataggcatcctaggagattttaccacctatccaggtgccctggctgggtgaaaactgtgcatcttatgcttcctcaatagtgctgtgagaatgctccactgccagtttgaggtatcaggtttgggttttcaggattgcaagactgctgtgctgtgcgtgtactggtgagttggctccctgcctttcccagcacccccatgcctccttcttcacatcccctttcaagtagaatagggaactgataacccaaccaggccccttattcccatcagatagcaagctaatcactgagacaacaagctttgcagtagagaaaagattttattcaccaggcagccaagcaaggagacaggagaatagatctcaaatctgcctcctcaaagatgaggtttaggaatatttatggaataaagaagcagtgtggtctattgtggggggaaaggtgattggaggtgggggaaaggtgattggaggtaagaaaaagggaggtaattggtgatctgcacagacatagtcaaaattcatggctcttcataggatgtatgttcatgaaatggcattgttagcatgatctgagggtggagtttttgtcctctgatgtcaaaagtcaaccaacagacattcatacaggcctagttgatgggttggtggtctcagccagtttgaactgggtaagaactgacctcaagttcctataaaacaatgtaagcaactgttaccatgatgacctatacattagagatgttacctatgaggaagctagtgagagtttagatacttttaggtatataggttttaagatcaactagaagtaagcaactaaaagcaagtgaggcaggttaagtttgtcaggcctaatcaggttagccctcgctttcagagtcatctgcccaagtacagtaaacagatccagctactacttagatactttgagaagtttagggttgggctctttcttcttagctttccccttcatagaggaaagtccacatttacttcacatgctaacttgtttgctgttagtagaaatctgcgggaagtttgccagagaagggtagcctttggggattggccaaccagctagcagggacctctgctgtgagtggcccatgctgtctgggcagctctgttaggtaaaggagaaagccatttggcttgtgtagactgcagctctgcaggaacctctccccaccatctctagccaccacctccagagtacagtaaattgtagacttagatttgctgtttccagcatagatgtcttacactttctagagggttccctctgctcacatagagccgttggttaagtggtggtgctcattttccatgccctgctggctagtccttggacattgtgagcatttttgtctccaatgccactgaattccttaaggccttttgggtgggtgctaaatatttaggcaactcttactaagaaaatagaaaacacttgagttctctgttttgcatgtggctatctttacatcagagccttggaagtggtcaactgtatgtagccaatttcatgaggctgttttaactgggaggacattgtcacctggctgggcttatacagctgagtcaataaggaaaacgcagcttttgttggcttgcttaccttttaaatcagtaagtaatgcacaaaatgggtccctcaccaccactacttcctttaaacctcatccccaactccacatcccatcatcatctctcatctcatctcgcagctttagctgatcccatggtggggaactggggaggcatgaggttgggggtatatgtgtgtatcatatattacttgggagaaaaaaaattgttttaggttttattacaaagcacccaagttaaaagagcagtgttaaaattgtcttatcaaaatatcccgtaccattgcattttcctgtttaaagagactgccataaactctaggggctacccaagtgaggagacgagattatgattaacaatcaaagtgatggggaaagttataaaaataggaaaaaaatatttagatataaagtcactgacctatgaaaccaccttgcaaatggtaggcaaaagaagtagtattactgaaaaagtatgaattgttacctttactctgaaattagtatgtaaaggagcactttgtttactgcactaaatctttgtctccagtttttaaattatgagatttatattgcctaagtatagactgaatacattttaatatttaattgttttttctcaaactatggtttgaaaaacaagataattcttaagctgggtttcattactttgaaaactaacagtgttttctaagagaacacgttactgatttaaaaatgtaaagtaataaaaatagtattcacataaagtttcagtagagttttagcacagaacacaattaaccagggcttaaaaaaaaccatttaattttgaggcaattgtagttatttcttgcagttgcaagaaataacacagagttctagcgttagcatttaccctgttccctcaatggtactatcttgtaaagctatagtacaatatcccaaccagaatattgacattttatagttaagatacaggacagttccattaacacaaagatcctctgttacccctttataactacaacccctcattcccatccctgacccctggcaactcctaatttgttctctgtttctataacttatcacttaaagaatgccacataaatgggatcatataatatgtaacctttgagatttttttttccctcagcataattgcccaagattcatccaagttgttgcacgtatcaagggcttgttcctttttattactgagtagcgttctgtggtatggatagaccacagtttaaacatttgaatgacatctgtgctgtttccaaatttttgcttattataaaaaagcaagcaggacttttaaaaaacacacttatagaaatgcttatggctgtgtcttattacagaatatttataaggagagtaagattaaagagttagagtcacttaggattaaaacaaatgttataaactatgacagtccagctcaaagtagcttgatttcataaatatattctctttatggtatttcataaatgccataaatcaaagtagcttgatttcataaatgtattctcttttgattaaataatcaaacttaagtaaattattggccagtgtccacaatagaatttgtaaatagttacattgtgttcatgtttgcatttctgttctcaacctgaatgactgctcaatatagtacactatattcacttttattaagcactgctctcacatctcattgtgtttgttgaacctggaaatgtgatagcatttgattgtgttgattttttttttttagctgccaagacgaattgttagatgtttttaaaacattatatacccttatgcccttggtgtctctgatgaagcagattcattaaataaacactcacttatgaatagcagagccagcacagtcatagtggatgaagtttataggttattgacggacggtaggaaatcagttgaaagatgcccggaaacatgtggttatgttggtaggaagtagaaaacgcctgcctggagtccttcagatcccacaacgtatgcgtgtgcatcttctcaggctccgtattagccctggtacgcacagagacacacagcgaccagcctattagttgcctggcagatgccgtcagtactggtcattttgtgaatgcttttaatatgattcacagaatgtctgtagtcagtcacgttttagcactgacagtaaaatgtcacctcttcagcagttttcttttaaaaaaggtgtaaagcctcttaaaaatttttgctttaaactcctatcgatcgtttagaaatcttattagcttgctttgggctttcttttagagttggagaaattaaaatttagagaccaggttgggctgagaaaactgcgtggagaaggggaacttgagttgaatcttacttacaccagacagtagggacactaaagaaggcaatactgctggaagataaaagttgacagctttatgaaagaaggaaacaagtgaatgagataattcggctgagagctcccggaaagcaagaattctttttcatctgtgccctcagtccctagttggagtacagcccaaagtaaggttcaataaatatttgtttaatgaataaacaaatggatgaacaaactgaaataagtgttgatatttgttatgaaatatgcctttctcagactgttccacacacctcaccctggctgtgccaagtttctatggctgcacaacaaactactccaacacttagtggcttataacagcagatggaggttcacaggcttccactggacagttctccttgacatctgttctgcagtcagaaggcaactggaactgaggtttccggtggctccgcttgactacagggatgttgggctgtctccttctcagggcctctgctctttgtgtggcttttccagcagagccgctgaacttctaacatagtgtggctcagggcttccaaaaagcacaaagggagaagcttccaggcctcccaaaggctaagacctggaactgtcactgtgttgctccctcttttagttaagcagacaagggggccagaccagattcaaagggagggaaaagaaaccccacctcatgatgaggcaccactgttttcccatcgataactggtatcaacccagcatcctacagctcaattcagttctgacactcaccatcccgacttagtacagaccctacaggttaagggctcagtccccttagactgcccccacttcagatgccagctgaaagtggaatatgcccaagttacccacacttcttcctggctgactacaaatgtgggggttgggagaacccccaggtttggcaattcactagaatgactcacagaactaaggaaagtgctatacttacaattacagtttattataaatgatacaattgaacaaccagctgagaatttatgtagggtgagggccagaagggtcttgagtgcaggaacttctgtccccatgaatgggacatatcactgtcctggtacatcatattttcaccaaccagaaagttcctgaaccccattgttcaagagtgaacaatgcaggcttcattgcacaggcatgattgaggaaataattggccattgatggttaactcaatctccagtccctgtcatttccccagaggtcagggacaaggttgaaagttcctctaattatgtatccatgtggctggcaccttcctggaaactatctaagggcacaccttgagtcaccttgatagcataaagatacagctcaaaggggttcattatgaacaacaaaagatgttcctgtcactcaggaatttcaaatggtttttgaagctctgtgcctcgggaactagggacaaagacaaaatagattttgctgttctatcacagggttgatgacaaagaatgtgtggccatctttaatctgtgacactggtcctctgcagactcaagcaaaatagatgaaattttacaaaggactgttttcctatcatttgcttagaaaattaccctacatgtttatcccactttcccctagagcaggtttctggaaagctaatgctatgtcttacgtatacataaacggatgaatgagacaaagtttgttgcattggtatgtgtgttggggggataggagggtgatgggagagcctcctggaatagtcttagagttggacactgtttccccttgtgactccttttgcagctactgccttgatcccctcttgtgcctgctaggctctgccttggggaaagctcaactcttctgtttccctacacttgaccgactgtctccatcgttgccttgcccatcttgtgttgtgtccacccaaacctgactcagatctactagttttcatctttcgctcacggactattctcttgagccagattcctagtcccctaactcaatcatcttattctggcttctccagtgttctttcaacccaatcttgctaaaaagctattttaatgcccgactgtggatttttggcatcgttatctcagcaggcctagcttggaggttcctctgggatttcctgctggagtcttctttttaggatttcccagtctacttgggatacttaaggaaaattatcaccttgtcttaggaagaatcttattatctcaaatcaaatatttaaaattgcaatgctcccttatctggaattttattttgtaagggacattttctgataagctgccaatgacagcctatgatatgaaattctgtatgtccctttgggttcaacagtaaccttaatgggatagttttgtctccctgtctcacctcaggtaacagaaattgtcaagtgcaaagaaacttttgtatccttcccacatccagagctagcttggagtttgaccttaggcaacaaccaactaactgtgccttgaagataactctctggggagttaattaggatagactgaataattcaaggggcagttttggtgaattaaattgggaaaagattttcgagtgttaaaggttgaagcattcccttcctattatttcagctcttacctctactttctcaatatacattaaagaaaagcaaatctgttcaatagatttgagataatctattaatttagaatgcttactagaagcccaccatggggctaggctccacaaagtttgaattgtggttatactgtcggttgttttttaaaaatgtacagcaaaatcctaggcgatcttcatgaactactccagaggccaccatcctagaaatctaaactcagctctcctttaagattagtcattttcttatccaaacaccacagagctttttacatagctttattacagtgcttcagatattgtcttgtaattatttgtttctcaacctgtcttacctattggacctgattaatttagaggtgggaggctgctggcttcatttccttatccaatcatttaaattaagcatctgacaggtaccaggcactatatttggttctagtgttccaaaggaagtagacaatcctcattttgtatgtattcttcttcttcttcttttttttttttttttaggtggagtctcactctgttgcccaggctggagcgcagtgacatgatctcggctcactgaaacctccacctcctgggttcaggtgattctccttgaactcggcctcccacgtagctgggactacaggcatacgccaccatgcccggctagcttttctatttttagtagagacagggtttcaccatgttggccaggccagtctcaaactcctgacctcaagtgatccacccaccttggcctcccaaagtgctgggattacacacatgagccaccacgcctggccccattttatatacatgctgtatgtttgttgcatgtgtcaatcattttgaagttgcatttccacttcacacactctttttttttaaacggataattaggaaattcagccattttgaagttacttgactctggttatggttgttttctaagctctgttaacacacctggtcaaaagtttggaagtcagacatgttttgtttgtcgtttttttttttttttctctgtcagacatggcctgcaccataagcttctgaaaaactctttgaggccagagacttggcttcattgatcttagtatctttggcaatgttttgttcgtagggaagattcagtaaaaggacatttggcatcagactaaaggaaatgtgttccattagatgtttaaatcacggtggtttattttcaaagccatagttttgtagtgtttctttacaacgtgattgaatttaaatgcactgggatgacttcctccaagaagaaggaaactggggggccgagaagatgtggcaaaagcagaaacatgtccatctctcattgggtagggacatcattcatttatttgttcccgtatcattttgcagattccttttcaacctgtacactggctgtctttctctcatccccaagtttcaagatctctggtggtatttcttttccatatcctttacctaccttgccttgctcctccacattcccaattccttcaatttttttttcctctctaatctgctgttttatggatgtcaagatatactctagttactcagctcttaccttagaattgagacttcagagtttcccactaagttccctttgcgatacacaggaaagggaacattaagaggagcacactgagactttaagcaggaaaatcggtaaacgctgaccatactgaacaattaagtctactattacttactggttttcttcttcagagcataaaccgggcttccctttccccagacttggctactgtcccctggcttgcaataacccctggctcctcaaaactctatgccttatacatatgcctttccaagtactcttgccatttggaggatgggaagatactatgtcagagaatcccaggatctgattggatggatataattgtgactgcctcttcctccactgtcaggtaagtctctgaatgtgcctggctgctctgctttctctgagtgccttctgccatgagccaagcttttctgtcaccataagcaatccactcatctcttcaagcagggacacgcatctacgtgattggtggccagatcaaatttctgccttctagaaggcatctttcatatccagtctttcacccttaccagtaatgttatggtctagacttcattgacatggttcctccatggaagatcataatactgtttcccaacccagacatagcatctttctcaacacagaactctaggcaactgctttcattgattggagttgtcattcaaattcaaaatgaagcctacttggcatccctagcagctagtcttctcttgcctagatcattcctcttcatttatttctagccacttgcctcaaccccctcgagtttaaccattgccagttttgattggaaaacctatttattgaacatctctggtgatttttctgctgtacccagttacctctgaatgtgttgcccatctctggaagaagaggtattcctatatacacaccccacattcactgagggcttctctgtggttagttcataactctctttcatatgtggtagccaatgctccattaattaggaatgatgttgaccattctttcttctaaagtctgcacatattccttctggagttgtctgtcatgatagtgtcacacttcaacaatgttgaggctcctggtaaattctacagaaacatttccattttcctttgttttatgtacagaaatatagttattaattaggtccttgggcacaaaaatggaggcaggcatgtgccatttaacatgtgtgttagggttctccagagaaacagagctaataggagagagaaagagagatagacagataagaggagacttattatgggaattggctcatgtgatgatgaaagctgagaaactccataatctgcagtctgcaagctggagaaccagaagagctggtggtttaactcagtctgaaggcctgagaaccaggggagttgatggtgtaactaactcccaagaaccaggagctccaatatcccaggggaggaggaggtggatgtccttgctcaagaagagagagagtgaattccccctttccccatctttttgtcatattcaccttttcattgtattcaggcaggccctcaacagattgggtggtgtccgcccacattggtgagggcagatgtacttgactcagtctaccaattcaaatgccagtttcttctgaatacaccctgaaagactcatccagaaataaagttttaatagacatttgggtatcccttaacccagttcaactgacacataaaattaaccatcacaatatgcttcacatatgtttttaaaatagcttaattttttgtctataagtcttgtacatgggtagtggttgagttagtatcttatcccttgagtttgccaaccccttggatagggtcagtgtcttgggttctctgaatggcatttaacacatggtcacaaaaaccttggtctgaagaactttataatgataaagttcaaggtactttggtgtcttgaggaactccctggactgtgaggcagagactcgcttggctctagtcctggtgctggatctaactggctgccattgtggggctcccctaaagataaaggaactcagtttcctcatctgtgaaatgtgaggatggaattcatcaccatgtcccctcccagctctaaacttctctgagtcttgtttttccctgctctgtatcctccactttctggcatgttttttatatttactattataaatgtgtccctattttataagttgttacagcacgagagagaggtaaggaatagttaacaaaattgtattctgagtagcctaatattcttttttttttcctgctaaacttctttttcctcaccttctcctaacatttttgtgggggtgggtggactggtgggtgactgtagtgatattgatattcagagaggagtgaaaaatgcaaaattgcaaggttaacaacagatggttatatggtgccattttaggagtgttattaaaagaacaaatctattttcctgaatagtaggatgtcttaagtgtttaggcttaaatctactgttgaaatagaaaaagaggaggaagaggaggaggagaggaggaggggaaggaggaggagggggaggaaaagtcaaggaaacacttagaacatttttgcatgatctcaattttcttcttgttccaaggtttttaatttggacagtggtatgtgcttcagattgaatgcaaggaaatttgttgcaccatttgcctgacagttatcattttccttgacgaaaagtttttctgaatcttgctttgctggagctacctcttcccttgccctgaataacctcacttgcttaagtcatcgatgcagtggactgacaccacctttctcttaaggaattaccctgttctctgggtaggtctaatttacactcccactatcacccaaagaagagacactctctatattgataactagaaagaaggaactgagactgttgtccaaggacatcttatctttagcatagagcgaatatgtggtttatggtaggtgttcaacaaacttaaaaaaaaaaacttgtattagtctgctctcatgctgctgaataaagacatatcgaagactgggtaatttaaaaggaaagaggtttaatggattcacagttccacatggctggggaggcctcacagtcatgacagaaggcaaaagtcacgtcttatatggcagcaggcaagagagaatgagagccaagtaaaaggagaaaccccttataaaaccgtaagatttcacgagacttactcatttccatgagaacagtattggggaaatcactccccatgactcagttacctcccactgggtccctcccacaagacgtgggaattatgagagctacaattcaagatgagatttgggtagggacacagccaaaccatatcaaaacttaatcaaaaataattgaaatgtcaggaaatagagaaacttattgagcttttttagggaagtggtctttgaacctgttttgctctgcccactggagtatgctgtccatcaaattgttagttcagtgaattatggtacaaacactcagttacattaatatgactattttcttgtatgctaatttgagaacctactccctggagatatgttatcccatgtaatttccaagtgaaatggagagaggatgccttagactgttacttctcatgtttttcattccaatcttcctcagtgcccctctctataatcccaatcctatacatttttaaacaaaggaaagccactcagatcacagtagctcatggacattggtgagaaacgtgaggaaatgtagaggatccccaaattctcacacataaactaaggtgcagccactgggtatcaagcaaggtttcctcactggtttaatgactccagttttccacattgacatttgtgctgggagccttacatatatgattttgtaaaaccctttctgcagcccttcatggtaggtagcagaatatttaaccctattgtaagagacaggagaaaccaaactgctttttctattctcacccgccattctacacagttctccagcagaatcccactggatgtcctatagtttggcccggttctaacactgtctacctggagatagcctcagatctcacaggtaaagggctcagccccacaagactgcccttcacttaaaatgccaatcgcaagtcccagattgtggtctgtacttctgagcaactggccataaattgggggttcccccaggccctttgtcatgtttgattaatttgctagagtggctcacagaactcagggaaatgctttacttgctactgcccatttatcacaaaggattttttaaagatacaagtggacagccagatgaagagatagatgcatagaacatggtttggaagcatcctgagtgcaggagcttctgtccccatggaattggggaacactaccctttgggcacatggatgacatgcatgtgtttttgttcacaaactgagaagctctctgaacccagtccttttgggtttttatggaggcttcatcacataggcacaattgtttaaatcatttacataaatatgattgatcaactcttccctctcagatgttgaaggtgggactgagagtcccagccctctaatcatatggttggttcccctggcaaccaacccccatcctgaggctatccaggagcccccagccacaagtcaccctaatactatacaaaaggacgcttattttggagattccaagggttttaggagttgtgtgccagggatgaagaccaaatatatcttattataaatcacaatatcacacctattataaagcactacatataaagtttacactccaagaataaaagatacaaatatggaatcttcaaatgccaagggcctactggatactgtgaatgacaatataagctacatcacctgttattgaaaaccagaatgcaagtgtaaacttgaccagggaacctgcggagatggagaagtttgacacctctccagcagcatcatagaaatgaacatcatgagcgcattgagggggagggttaatgtcttcatcgttcttcctctggtagaattatatttgcatccttcctggtggaaacttgatacttcactgtagtgcacctgtacctgtttttttttttttttttttttttttactttcttggagggagagttcttctatctcagaagatagaagaaatagctggaaactctatattcctgtgccctagcacaggagaccaggggtctccaactggtctgtggccttttaggaactggaccacacagcaggaggtgagcagtgggcgagtaagcaaagcttcatctgtatttacagtgactccccatcactcatatttccacctgagttctgcgtcctatcagatcagcagcagcattagattctcattggagcacaagccctgttgtgaactgcatatgtgaggaatctaggatgtgtgctccttatgagaatctaatgcctgatgatctgtcactgtctcccatcacccccagatgggactgtctacagatgggactgtctagttgcagaaaaacaagctcagggctaccaccgatttgatactatggtgagtatgtaatgataataaagcgtacaataaatgtaatgtatttgaatcagcccaaagtcacccccaccgacccacccagtccatggaaaaattgtcttccatgaaaccagtccctgctgccaaaaaagttggggactgttgccctagcaggtagagcaagggtatttcacttaggcttgaccaatcgaatgccttcattctggattttggatctgggagaagtcttgcagagacgaagcaacatttgagaagggttttaaggctagtttgagtttagtgtgctggtcctggctgccatgcattgagcagatagttcctgtggtaagacctgctgcccaagccacccttggtttctgcctagttttctaacacttctgtcaattctccattcttgaatagtcttctaatataggccttttctgctttaggtagccagacagaactgttccttgcaaccagtgactgtctaattcagtcacttaatgttttgtagctttgttcagttactgggcacaacccactttctgctcaggcggcttggagacagccatgggccatatgaatcgctattattttaactttcatagtaagaacttgctccatgtgggaaagcataattattttggtttctgagtttaataagcagaaagcaaagaagaaaaaaaatactgtttgcactgagcattaaaatataaggaagtaaagttgtttatagatagagtttcagctaagcaccaaaggtttatttatattttttgccatttatattttctgcctagttctgcctaggaaccagggaaatccatggcaaggagaaaataaagcatcaaagaggatgaaaatgttgaataaagtattagaacccagaacacttaaatctttaacatccatagtaagagtccttcacattactcaggcagactttttttttttccacctcttggtattctgtgcctacacttgcatgtttaaataacgatttaaaaatcacatgagaaatgatcaggctttctttttcccacttgactctcagttatttcaattctttgagacttgttaaagaaaccgtttagtgttgtaaatgccaccaagtctctacctagtagagattagaaatcctctcaccaattccaagttaaaaaggtcctgacatattttgatggaattggcccatgttctcatttaccagtgaccagctcatctccatgctatgatgctccccaggaaatgtgcatggtttttgtagaaggtggcgagaagcttcatgggcaccagcatccacaacccacttcttgaaaaacaaaatcagatttatatttagctgaccacctggcaagatctcctgtaggaagagaaggaactatacccctattactatttcagcttttattcacaaagtctttatatttgaaaaatgctttataatcattttaattagtggtttctcaccaaagccctggatgtggtattattggcaccattttctgagaagaccgtgtgccattgagatggaattgacacaagatgttaatgggttagaagctggtactagaatcagaatgataggccataggactcagcaagccatgctatttactgtcatcttagagggctaggtagggtggagggaaggagttgatgactgattgttataagtgaaaagggcagcagtgacccaaaacaccattgcaaatgttaacagaggcctgttacagagttaaagctgggttttccaaaacaacacatctgagtaaaagcgcccttggtacattagccagtatggagccagcacctgagatcacactgtgtttgcccctttctgcaatggctattggtgctggttgcttgtcttggcctaagagttttcagctgggcttttgagcaagctgcatcttgaatctgaggatgcgggcaagccaggcacagaactgtgagggtccttgcaatgggctgctggtgttcctgtcattcataagcttggacttggtccccactgtgtttgatttgggagaggttctttgaccatacaactcttaccgtgtaaatgtgctacaatccttgtcaagacatagcaaactatatttgaacattgttttaccatttactgttgtgtgcatgtgggccatattttcctagtcagatggtgagttctgtgagggcaaaggctgagtcattctctatttacattttaagtaggcatccagagacttggttatattctgagtctgtattattgatcaaagccctcacctggagtttctggggccattcactgacccagaatctggtgacattgacacagggagggaataacatccagctacagatggttaacacaggtctttagtgccccaatccccattttgctgactcatctatgcctcaagaactccaatcttcatgcagattctgttgcccttgagtactcagttctgtctcttctgcatacctctgtggagccttggatcctgtcagactcttcgtgttgctgaagttctcagtcctctctctcagccgagtgtaatagtgccccagtgggcactgtagggacagaactgagtttcttcttttcttttaggagttgattctctccgggtaatatctggagctctctaaagtttcagagagaaatacgttccttataaaccttgtggttgtcatgctggtgactccttgagcctgtcctgtgctggaccgtgaggaaggacacaaggccatccagactcctggactcacagtgatttcttgtcctccccaaagatgcctttgcctggtgcactctttaatagcccatcacttcttgctggctgtgtccccagctgagttcctccaggatatggcatcaactctgaacacatctctgtatattccctcttaggaccataagattcatgttaaacttagtgccagaaataaccttgggtagccatgttccttatggttccttagattacattcctagattacacattttacattaaaaaaaaaaaaacaaaacccaaagcacctagaaccgtgctggattcttgataaatgcttgtatccattaaatacatattgaagtaacttctactccagtgacccctctcttgaggcttactgtttacctcctcactttggggagctacccagccaggaccttctgagagagaaaagtggtatatttagtagtcaccagatagttactgttaacggtgctgagttcttaaaaaaacctgttaattgtactagcttaagactaaagtatatgttcctctcctcgtagagtgatgatgatggttttataaatactggttggatagcactgtaattaatgggcacaccagcttttattttggtaacaatgtattcttataccacatttaagaggtttctctttcctgtggtcataaagtgattaaaaaaaaaaaagagaggagagagatgacatcctttttaataaggcatcccaagcagtctaagtacctatgaattataaatgaaaacttttcagtgattaaaataaatataccaatgcagtccccttctctgcgtcattgcttcgccaggcctgcatgaaaatcactcagaggaagtcccaaggggccctgagatcatttgcatctgttccatgtgtttctctgatttatatcagagtgcatcaagggcagtggccttccagctggtttgggaagagggattcttttatccagaggaggcatcagctgatggtcagttagggctctggagtgcagctccatgtaaacaactagcctttgtagtaatggccatataatataacctagtccatgttttgttccctcaagaaccaatttacaacatttaatgttcaaggatggttccattcctttctttgtttacacaggtgaggctttatttagtagtgggaagtgaagggcagatggtttaaggggttcttaatgctgcaggagaggcccataaactgaagtatccaagaaaatccattctaaataagaggcaaacagagtctcagatggatataaattagtattattcttaggaatccttccttcccatttctcagacttatagcaaagctcttactgatatcagtggccattgtgcaagtgggtagcagggaaatcaccctcaatgaccaaatggaagtacatgaggaaaaagatggagaatcctggataaagaagacaactggctgggctccatggctcacatctataatcccagcgctttgggaggctgatgcgggtggatcacttgatgttaggtgtttgagaccagcctgaccaacatgacaaaaccccatctctactaaaaataaaatacgtaaattagtcaggcgtggtggtgggcgtctgtaatcccagctgctcgggaggctgatgcaggagaatcgcttgaacccaagaggcagaggttgcagtgagccaagattgcaccactgcactccagcctgggcaacagagtgagactccatctcaaaaaaaaacacaaaaaactgtctttttctagccctatttatttcaccctacactccatttaccttttatttgttgttaattaaataacattaatttttgttgtaggattatacgtaagaaactattggccttttgctgattgtgctggaatttaaaagttgtagggattgtgggccattgttctaaaatggctcattttgccaaacatgattaatggcttttggggtgcagtttatgtcaaggcaaaattagtggacacttcagcaaactggaatgtggttctgagctaaggggatattcacttagccattcctagacctttcttctatcagaacacgtctttaaggttgaatatccaacattttcaaacattttagtcttaaattctacctttagagtattattgatggtctgattagataatgaaataaattttctctcagcaatgtctgtaataaaacataatgcaggaaagatagcatttaataaaatatttgtttaatgttaataatatttattaccatcagattagaatcaagttaacatcaaattagtaagagatatgtcagtcacaggacttgtagggatgcgagaaaaagaccaccagagaaactgaagaaacaactggaatcatctttgaagaatttcaaactcatcattgagacattggcgagactgggaaaattatttctgaatcttgaaagaatgatgccccaagaccagatcatttaaccattatgtgtctggagagccatcatgcttcctggtatatttactgtggaaaaccctgactctcaaaaattaaaggaaaattacaactgtaataaattggcctgaattgcatggattcataagaccactctctttccatttcttcctacttaatgttgttttcacatagtgatcacttagcagagtttgggaataataactggcaaaaaagctaaaattcttagtccctaaaggaaaagtttgcaaacttattatttaatgttttaaaacccctttcccccgatgaatgttaccctgtccctaggagaagcttctctttcatgagttcatagatcaacagtggaaagatgattgtatttttgagccttgaggttcaactttttctcttctaagtcttttattctgcaagagcccttttgaatgatttaaaatggcattctccatttattcgtatttatcgaaaatctatttggagcaaggtattacatttaaagacagagaagaaatggttcatccactcagctaatatttattgtgtgtacactatgtagctacaagctgggaacagagtggagagcaaaagaagacaccattcctgctcttctacagttgagtctggtagaggagacattcatgattcattttttttttttttttgaagcggtataaccacccagtgggttcacattgcctgctgccttcacagagccaatgtatcgagacaggggaattgcagtgaagaaagagtaattcacacagagccagctgtgcaggaatgagagttttattattactgaaatcagtctcctgaagcattcagggatcagagtttttaaagataatttggcaggtaggggctcaggaagcgaggagtgatgattggtcaggttggagatggaatcatagaggggtcgaagtgagtttttcttgctgtctatgttcctgggtggaatggcagaattggttgagccacattactggtctgggtggtgtcagctgatccatggagtgcagagtctgcaaaatatctcaagaactgatgttaggttttacaatagtgatgttatccccaggagcaatttggggaggttcagactcttggagccagaggctgcatgacccctaaactgtaatttctaatcttgtagctaatttgttagtactgcaaaggcagactggtccctaggcaagaagggggtctacgtgggaaagggctgctagcaattttgcttcagagtcaaaccatggacagaattccttcccaaagttagttcagcctacgcccaagaatgaacaaggacagcttaaaggatagaaacaagatggagtaggttaggtctgatttctttcaccatcataatttcctcagttaaaattttgtaaaggtggtttcaatggagcctcactctgttgcccaggttggagcgtactggttccatctcagcttactgcaacctctacctcctgggttcaagcgattcttgtgtctcagcctcccaagtaggtaggattacaggcatctgccaccacactgggctaatttttttgtggatttttagtagagatggggtttcaccatgttggccaggctgatctcaaacttctgacctcaagtgatccacctgccttggcctcccaaaatgctgggattacaggtgtgaaccaccacgcccagccatgaatctttagattactcaagtaaatgtaaaattataagtgtggtaaatgacaggagatgtatagtagaggaatctcatctgtctagggataaagggctcccctgtggaagtgatatttaagggaagattaaaggattaagaacaattaatttgggaagggatggtgtcttagtctgttctctgttacctgagactgagtaatttattttaaaaactcagaaatttattttttacggttccagaggctaagaagtccaaagttaatgggctgtcatttggcaagaaccttcttgctctatcatctcatggtggagggcaggaaagcaagagagcacacatgccacagagagcaacagagggccaaactcacttttataacaagcccagtcttatgatacaaacctactctcacaataatgacatcaatccattcatgagggctctgccctcatgacctaaccacctctaagttctacctctcaacactcttgcattgggggttaagtttccaactcatgaacttcagaggacacattcaaatcatagcattctgcctctggtattcaaaattcacattcttctcacatgtaaaatatatttatttcataccaattgctctaaaaatcttaactcattccaacatcagcttaaaagtccaaagtccatagtctcatctaaatcagatatgtgtgagactcaaggcatgattcaccctgaggcaaattcccctccagctgtgagcctgtgaaattaaacaatttatctatttttgatacaatggtgagacaggcataggatagccattcttattccaaaatggagaaataggcaagaaaaaaagagtaactagtcccaagtgagttcaaaacccaacaggaaaaacaacataaagtcgtaaatctggagaataatctccacacccttaatattgtctcccaaacatgcttttttcattctttacatggccaggctgaaaattttcaaaacttttactttcttcttcccttttagttacaaatttgtctttaaatcatttccttcttattttactgtaagtggctgaaagaagccatgcagcaccttcaactttgctacttaggcatttgctacttagcctagttcatcactcttaagttctgccttccataaagtcctaggacatagacacaattccaccaagtttgtaactgtatcacaaggatggcctttactccagtttccaatacactgttcctcagatccatctgagacttcatcaggatggccattactgtccatgtttctaccaacatactgatcatgacgtcttaagtaacctctaggaaatcccagtttctctgcagttcttttcttcctctgagttctcaccagaatcacccttaatgccccattcatgacaatctatgcttcttaaaatcttgctcctccaaattcttccagcctctacctattactaaattccaaagcttcttccgtgttttcaggtatttgttactgtaataaaccctcttctcgataccaattttttgtcttagtttattttgtgctgtttataacagaataccagagactgggtaatttataaagaaaagaaagccagcgtctggcaagaaccttcttgctgcatgatcctgtggcagaaggcagaagggcaagagaacatgtgcacaagagagaacaaaagagggccgaactcacttttataacaaaccactcttgcaataatgacattaatctattcatgagccctcatgacctaattgcctgttaaaggtcccacttcccaacactgttgcatggggattaggtttccagcacataaactttggagaacacattcaaatcgtagcacatggggtacagaattatattgcagatacagacagcagctcatgccaatgctgtgtggtaagagaaagcacagggctattgaaagaatgaacaagggtaagggcactggcacccagagggcaaggaagagtacaggtgggatgaatccagagtgggaggtggagactaccaccaggctatgcaggaccttataaccactttaaaaatttgagaagtctgggtgcagtggctcatgcctgtaatcccagcactttgggaggccaaggcgggcagatcacgaagtcaggagattgagaccatcctggctaacatggtgaaaccccatctctactaaaaatacaaaaaattagctgggcatggtggcaggcgtctgtagtcccagctattcaggagactaaggcaggagaatggcatgaacctgggaggcagagcttgcagtgagccgagattgcaccactgcactccagcctgggtgacagagcaagactccatctaaaaaaaaaaaaaaaaaaaaaaaaaattgagagataggagggtcacttgaggccaggagttcaagaccagcctgggcaacatagcaagaacccatctctacaaaaaaatagaaaaaaattatttgggtatggtgatgcaaacctgtagtctcagctactcaggaggctgagggtgggaagatcacttgtgtccatgagttcgaggctgcagtaagctggtattgtgccactgcactccagcctgggcaacagagtgagaccctgtcttttaaaaaaatgagggttttattcaaagaacaatggaaaatcattgatgggttttaagcagtaaacatgaagggaacacatttgtggtttgcaaagattgctttagtgcctttggagaggagtggtagtaagatcatccagggtgctattgttcccaggtgaaagatgcaataattcaggtggaccccttaaagaaagagatatggatgagttctagagatgtggaagaggcagaatcaatagaacttggtattgattgaatatggtgtgggggcagggttattagcatggcccctagatttctagcctgctgagtaggatgaatggtcacaccattcactgagatagaaagctgagataaaacaagatttaggaggaaagttgacttttactttggacaggttgaattcaaagtatagtatggtgtcataaagtaagctgttgttacatagcctaaaaatgagtggatttttaaaaggtcaagatgggcagaagtagagcattccagttatctaacattgcatgataaagtcccaacagttatggcttaaaacaacatttactgtgctcattaatctgaattttggcaaggcttggtggatagcttatctccgcaccacttggtgtcagctgggggagcctgaggctggggttggaatcataagacagcttgctcactcaaatgtatggcagttgatgctggctgttggccgaacttgagcaggggttgtggctggagcacctactcgtgtcctttacatgtggctgcttagcttcttcagagcttggtctgctgggtttcaaggtgagtgtcacaagaataaagtgagagccagacagagactatcacctttcatgacctcgcctcagaagtcatctagcatcacttccatggcattctgttcattagacatggcccagccatattcagggtaaggggaattagagttcactcttcaatggggggagtgttgaagaatttgacaacatgttttaaaaccaccacatggcggggcagagaagaaatcagttatcattccagctggaaggaacaggttgaaacgggaaggtagaaattatattcaatagaagtggagtggttgctgttggctggcctggagcatgtatgaagggttatgaacagtgtgaaatataggttaaaggaacgtttgggaccaaattatggtggagcccaaatttcctgaaacccattattttgaatctggaaacaaattgtcagagaggaatacaaatcagatttattaaataaagataaaaagtagaagcaaacagtgactggcatgggataggaataattctacttgctgataaaataattcatgccaattttggggtgtctagtctacagatttggggtcatatatctccaaatttaaattgtagacatattcaaatgtctttagttgggctttgtaccttatgccagtcaaaaacatgagtcaaaaaaatcatgcctgtatggttcccttcggaggtatctctcctttatcctttagcagattaagataagaatcttggtctttttgatcctggctgtggcttcaaatttttcccatcttactattgggctacccaaaaggactgcatcagacaagactggtgagttgaatagtgttcctcccaaattcacgtctacctggaacctcagaatgttactttatatggaaataggaactttgtagatgtaattagttaaggttcttgagatgaaatcatcctggatttagggtgggccctgaatccaattattgttgtcattaagaaattgagaaggcacagagacaaagcaaagaagcccatggggagatgcagaagctgaccttggagttatgcatctagaaccaaggaatgccaggagcaccagaagctggaagaggcaagaaaggattcttccctagagccttcagagggagcgtgaccctgtcaacaccttgattccagacttcgggcctctaaaactcagagagaataaatttctgttttaagccacgtagtttgtggcaacttcttatggcagtcctaggaaattatacacgaagttagagccaggcatgatgtattagtccattctcacactgctataaaaaattacctgagactgggtaatttgtaaagaaaagaggatccccaggctctatggaaagcatgcctggggagacttcaggaaacttacaatcatggcagaaggttaaggggaagcaggcacgtcttacatagcccaagcagaaggaagagaaattgctgcgaggtgctacatacttctaaacaaccagatctcgtaagaactcactcactgccaagagaacagcaagggggaaatccacccctaccacccagtcacctcccaccaggccctcctccacattgatccaatcacctcctaccaggcccctctttcaaccttggggattacaatttgacatgagatttgggtagggacgcaaatccaatccatgtcacgtggaaaatatgggtgttggtttgccagatgccaaacagaaacaacatttgatctgttgataattgtgtatcctctttatcaggtctatcttaaggaaatcagagagtagagcatattttcttcatggaatggtgagacacatattagcctgagacaggagctaaggagagtgagtggtgggctccaccaaagtgccttcatacaactacactggtaggtgatcagaacaaagggacacgtagaacgaagacccgggtgtgtaacccaaatgcctaacaaagtccattcaatgtatgaggtgttgctgctgtgtgctgaaggaggaaacctgggtcttagtctctgttatggtaaatagagaagaaatcaagccttcctacgacaataggggatttttaatgaagtaaaggagacagaagaaatgtcccaaaggagaatgaagtatgtcaaaaacagattgcgcatgtaattactttctcaggccttcctgacattatcagcaggacttgtgttttgatgaaaaaacttaattaaaacttaatttttttaagtggaaaatattcagcatggttacaggaagactgaaatcagggcactgtgtaattttaattgccttcgagagatgcacttcacgtgaagactagcatgggggaaaaaagctagaggcacaaagtctgaggggagtggccacgctgaatctctagctgtgtgcttgggcgccattttccccactcttacagttgacgggatggcatctcaggtttcacgtgtaggggaggagagtgggtctgttctggagtgtgccggtcaggccatacttggcatacacattgtagaaagtgtcttgatttttattctcctaaaaagggtaaaaagagattgaggagattacatatcccatgaggcagcagtttttaaatgccactctctggatcagttctatcagaaccatctggttctgattcatttaatctgttttaggacctgtgcacagtgtttctattttaaaaataaacctgtcctactcattcttggagtcaggtgtgggaactacaggtttttaatggaagaaacatgaacttgaaaatgagtaaatatgggctacgtcctttacttcccaaggagatttgggttgactgcttagtttcctccatcaaatggggataatatgcttatttgatggggttttgtgaaaataaaagataacacaggtaaagtgactgacacatacagttaagtggtctaaaaatgataaaactgtagaagaagagttggatcaggctgcttgctaaattgggaagggataaggtagtgttcttcagatatttcaagggcagctgcatgagagagagagagagagagagagagtgtgtgtgtgtgtgtgtgtgtgtgtgcgcatgcagcctttagaggtcagactcaagtccagcaggtagaagttatagggagataaatttcaacgcaacagaaagtggaactgtctagtgaatggtccagggatgtcatcagtttgctccagagggtagtacgttccaaatcactggagcaattaaagcagctgccatattttgaggatgtacagggctgtggggcagcaattgaatgagaccacttggttcagctctgtaatagggtttctggcttcctgtggggctgtggctgacatacagttgttttgtaaactaacaacacttgaagaaggttttagcagaaaacgtttaccagtaagatatgtcaggtcaagtacactgttttaggtattctttactggggacattcttgtgaccttcatcccaggcctttcagaaaagggatggggcatatttagaagttattaatgactgagaagctcctctggcacttcaggggagggaactagagctataaaatgtcctgtgattgttctaggactttctccttagtttagctaacatctgggtccttgtcacacggctatgaaatattaggcttacagacactttgaagggtgagaaaaatggaatttattgggtaaaaaggaaaaaaagggaaacagggatgctctgcagagccagattcctgctagtgtgcttcctgcctcacagactgaatcccaggtaccacccaggaagaggaggggccaggctcctccccactgcaaatggcatgaacttcccaagacccctcccccagtgtgcaggccacttggaggttctctggtgacccctttatatttggctgtctcattatgaatgggacaggagtgcgaaattatcccacttcaaatgtcacttgctctctgttgggaaaccctatacctcactgaagcccagatgatctccctgaaccagcctttgagggtcctttttggagccctttggaaacctggtattggatgggttgggttacagggctgctcagcctgacagcctcgcattatctggtgaccacagagtttaaagcagaacattgggaagaaggtagactgggccagttgcacaaagcagagtgtgaagagtgatgggagatgaaggctgtttgcctgcttttcactggggaccagatttggatggatgctggtccaatatgagtgacacagttaacttatcagtgagatccctcattcttctcatcagtgagatagctgggtattgggggaacctgcccccagtatttcaatgtaggttctttctattttccataatatcagctggctgagaaataaagagaaagagtacaaagagaggaattttacacctgggccgccgggggtgacatcacatatcggtaggaccttgatgcctgcccaagccttgaaaccagcaagtttttattaaggatttcaaaaggggagggggtgtacgaccagggagtaggtacaaagatcacatgcttcaaagggcaaaaggtagaacaaagatcatatgcttctggggaaacagaacaaagggcaaaaggcagaactcctgataagggtctatgttcagtggtgcacgtattatcttgataaacatcttaaacaacagaaaacagagttcgagagcagagaactggtctgaccaaaaatttaccagggtggagtttcccaatcctagtaagcctgaagttactgcaggagaccagggcgtatctcagtccttatctcaaccgcataggacagacattcccagagcggccgtttatagacctcgccccaggaatgcattcgtttcctagcgtattaatattaatattccttgctaggaaaataatttagtgatatctctcctacttgcacaaccgtttataggctctcggcaagaagaaaaatatgtctctttttgcctgaccccgcaggcagtcagaccttatggttgtcttcccttgttccctaaaagtcgctgttattctgttctttttcaaggtacactgatttcatattgttcaaacacacgttttacaatcaatttgtgcagttaacacaattatcacagtgatcctgaggtgatgtacctcctcagcttatgaagataacggtattaagagattaaagtaaagacaggtatgaattataaaagtattaatttgggaactgatacatgtccatattaaaatgaaatcttcacaatttatgttcctctgctgtggctccagccagtccctctgtttggggggggtccctgacttccaacagctggggaccacttaatcagggtaagggcagtagtttgtgttcacagtttgatctccctgcatggtgctaaccaggctgcatggggatctaatgtctgactttggccacggcatcaggctccagccaactgacgtgaaagcaagtttccaaatcgtctctttctaaatagataaatgatactcagtgttcctttagccttccttattttttgcaaatgcctgtccccagtggttctgttgtttgctctgattgccgttttccccagtaagtgggaaaaccccacatcttttccccatcagtattccctaatgaggcttgttccctcaaggggaccttgatgagttacaacagcatgaccatgttcccaagcagcatgctaagaaaaacaatccccagtgatgccctgcaggcaccatttaggagcgggcggtaatgaatccctgagagaattcagtcctccgtatgaaggtgatccagagtgaagtaaacaatttcaccgttaggtggttcaccctgcatgcctcattgctggctttctggaaagccagtaaataaggcagaaaaaatgtatcattccctccagagtgcagggtcccctgtcacccacacaggactcctgcctgtcactttgagtcacagctgggctttctggaacccggattcttgtctctggttagctcaggtcttgcagccatgccaaatccaaactgtgacattgtctgaacagtagggcatcctgttccctggtttggctgagctctgcggagcagaacagtggccgaggttaacatcagataatttcctccaccattcctgagtaccctgagggcttgttacctggaatcaaagacttgtcagaactcaagatgaccttaaaggccagcttattcaacctcccacccaggatatgacttccagaactaaccacccacaatgcagattagtaatatcatacgtggttactcaatgcaattgtgtcatttcaggagaaatgacctgttaccaaagtgtcatgaaacccacattaatgagctgggctgtagtggaggtttactttgatttctgaccttaattattagtggtttggattctttacgtttatgatggattttctgattaccaattatgattcactgtaagccatttttaaaaatatgacatgaagctctgacccacttttaacaacacagtggcaaatgccaaacaattggcaatttccccttctaatatcagctgtttgaatcatcacatctactgtggtggctggggaccactttatcttcattctctggcttcagtattcttttctggtattgtcattactgacctaggtgcatatctgtactaggctgggacctcagctctatgccagtgagaaaatgaggttcaactgggaaaacggcctggagcagttgctctcaggcttgtctgcagattagaatcacctgtagacttttaaaaaatactgacacttgggttccgctcttggaaattctaatggatctggggtgcagcctgggcatctggaattttacagtctacctgagtaattccaatgagcaggtgggtggccttgcaaaccggggtctgaaggggctggtcagcaaggagtatgggcaaaatagtgctggctggctgggcgcagtggcttacgcctgtgatcccagcatttgggaggctgaggcaggaggatcatgaggtcaagagttcgagaacagcctggccaacatggtgaaaccttgtctctactaaagatacaaaaaattagctgggcgtggtggcacgggcctgtaatcccagctacttgggaagctgaggcaggagaatcacttgaacccaggaggcagaggttgcagtgagccaagatcccacttggctgccactgcactccagcctgggtgacagggtgagactccatctcaaaaaaaaaaaaaaaaaaaaaaaaatagtggtggccaaggggtgtttataaaacagagttgtgatacatgttcatacattcacctttgaggtctgatttggtggtagcaggagtttcaggggaaatgtttactgatcaggttgatgagtgtccagggacaagatgtgtctgctaagagttagattgatggcaaagattgggcagattgatagttctctagcaaataagatgagatctgctatttcagcaggaaacaagtaaggaagttgaacaaaaagctagtggtatgggccatgtccacaagctgtggttaaaggcaaaggctgaagcctgattggcgtgcccacactgggctgggcactgtcagggacagccaggctgactccagagcctgccttctggttggcttctcccggcttaagtctggccctgcaggaaaaccgacaggagttttcatgccaaccaagactgagacaatcagagactggcaggtttggaaccaggaggtctggatggggaggttggctctgaatctgttgtcattatcaggtgagtcattaggaccacctggaaaagtgaagctgttcttcaccttctcttcttgtgaaagtgattcaatctcccaaacccaggttgatcataccctttaggtctaatataggaagtgttgaattaggtgatgtctctaaagaactctctctgggttccttagagaaaaatagcatttgaacattgtgcctcagcaggaaagaagatgcaatttaagtcctgcaccaaggcattcagggctcacctcaaagtggactcctaggaacaagaagcaaatgattccgtggagagggttagatgtctggccaatggaaacggggatgtagttcaggttttctagccccagaagttcagaacctttgggttcctcggtggacatgtctgttactcgcttgaaactagggaaagtctcttgtgtagaaaacctgttgcatgtcccttgactaccagtagcagcagaggtgctatgtgtggctgaagaattttcctcctttttctgagagatgatttcccaggtttccttctccacaattctgtgggcgtgtactgctgtgataagatgtttgttctctggcttataaattacaagatattttcaggaccacttggaagaaattggaacattttcctggaggcagtgggggagctgctggaggttttcggacaggcgggccacatgctgagagaggtattttgggaaaatgcacttggcagtcatgtgtgggtgaggataataatattaatacttaaccactggcttgttgggaagagtaaggggaacaatgtaagtgagtgtaaagatgcaggaccaccattcctttgttcattctttttttttctttttctttttttatactttacattctgggatacatgtgcagaacgtgcaggtttgttacataggtatacatgtgccatggtggtttgctgcacccatcaacctgccatctacattaggtatttctcctaatgctatccctcccttagccccgcactttgtccattcttttagtttctctgagacctggtgccccaaggataccatcttctcctgaccagtgtatcagtttgcgagagttgccataaaaaaatagcacagactgggtggcttcaacaacagaaatatattttctcatagttctgtaggtgggaagcctgagaatgaaaggcatcggtagggctggtccctcctcagggccgcgagggcagggtctattccaggccttcctccttggcttgtagatggtcaccctcttccctgtctcttcatgtcatcatctctctttgtgtccgaatttcttcttctcgtgaggacaccagtcatattggattagggcccaccctaatgactgcattttaacttaattacctctgaaaagatcctgtctccaaagatggtcatatgtgagatactggggttaggacttccacatataattttttgaggggatacaattcagtccataacagccagtctttttgaagactttctcttttgggggctttacacttaggtaattacaggatattttaaggggtatttcaagacccagcaacccccttctccacccaccatctcccccaaattatgttcgtcacctcctggtacctgttatatcatcactagaattgcttggttgaatcaagtaatgtttcaagataatttccgtaaacatgcactctttttatgtaagaggggtaataatagagccagtgaaatactggatgaattcatttaccaaactacgtaaaagtactgatatatgacaactacttagggaacctaagatttgggacatagagcagcctatttagaatatccggtataacattgcagggaatagcaagggctctagagctttccgcctgggttgaaatctcagctccacccttttctttctgtgtggcattcagcaagttacttaacccacctgtgattcttccttcatctgaacaagcagcataacaatagcatttacctcatgattctttagaaggtgaatgagctaatacctaatatagtgcttagagtagtgtcttgtctgtggttggctttcaataaatgttagctgctattgttgttgttaaactatttaacaaactacgaagcacattcctatctgctttcttctttgcccttgtaacagccctgtggagtagaaggagttagttacattttacagatgaagagactgaggctctaagacattatgcgaaccatctcagggcatatggcagtgttattcagaacatctatcggtaaagaacaagaattccaaaaatataggattttccccaggaaggagggccagagtgtgggctactgtgggatggcctccgggcagagtgtgagggtaggcgctccaaagagtaaggcatctggagaagagaaacaatgaaagaggcaaacgctggatgagaaggacctcaaagcagaactttgcctctcggcctctcagtcaattgtgatctgactgacatccagattgtgatcttgttcaggtggctgaactttgaacccttcttggccatttgatgctaaaggcagtctttgaatgtgatgttttcctagatcgtactggtggaatttagttgcctcagatttcccagtcatgtgccagcactgccaagtgatctccatgtgtgggttttatgatgtgtttccagtgctccacatatggcctgtgatttttttttcctatggctcctaatgaaacactcagaacactgcactgaatagaagtttctccctattctccagagtggggatccttattgcatcgtcaagcatggacaccaaaaataaatggggagaaatctctattctcttagtgatgaggcactcttggaggaagatattattaacatgactacgtcttgccaatttgaaactttgcaaatatctgtaaggttgaccagtttttataatttcaagattttaagttcaacttaaggtactttacaaaattatttttatcataataaattacagttctttacacctgtgtcttttaccgattagattgtgagctactttatgggtgagcaccagtatctacttaactttgtactaaatggctcaatattgcctggaaaatagtaggtgcccaataaatagtaaatgttgttcgatcaaatcataaatgtagatataagctaaacctcttccctgggcaactggaaatgcccatgttatgtcttaaaacacattgaattcaggtgggagaataaaaatgattttaacaaatccagtgtgctttttgaaggcagaactacaattacttcttttttccctcataatcaaatcaacctgtgaaattggaagccaataaatatgtaaaaaagtcatcaaatgtcataggagaggactactatttgattcacacgtgatctttgtcgtttaattgcgtgtggcaagaatgaatggaagtgatattaagtggagaaaaactcagtcccattggtgagttatttaccttgaccactgtgatgggctgaattgtgttcccctaaaattcctatgttgaagtcctaacccccagtatctcagaatgtgactgtatttggagatacagtctttcaaaaggtgattaagttaaagtgaaaatgaggcctttgggatgggtcctaatccaatatggttgttgtctttacaagaagaaaacatttggccacatggagagatacaagggatgcacatgcatggaggaaagaacatgtgaagacatttacaagccataaaaagagccctttcagagactaaccgtgctgacaccttgactttgaacttccagccctccaggactgtgagaaaataaatttctgttgcttaagtcacacagtctgtggtattttattatgatagccctaccaaactaatacaaccacctactttttagaatttgtagaatccaagcacttaagattacaaaaatgcatgtttattgtggcactattcacaatagtgaagacttggaaccaatccaaatgcacatcaatgatagactggataaagaaaatgtggcacatatacaccatggaatgctatgcagccataaaagaggatgagttcgtgtcctttgcagagacttggatgaagctggaaaccatcattctcagcaaactaacacgagaacagaaaaccaaacaccgcatgttctcactcataagttgaacaatgagaacacatgagcacaaggaggggaacatcacataccagggcctgttgggggctggggagctacaggagggatagcattagaagaaatacctaatgtagatgacgggttgatgggtgcaccaaaccaccatggcacgtgtatacctatgtaagaaacctgcatgttctgcacatgtatcccagaactttaaagtataataataaaaaaaagcaataaagaggaggtgatggtaataggcacagacttttgcttgcgttgaggaaatattctaagtttcacaatggggtgtggaagaatctgtgcgaatctccttctgacctctcgtggtaccatttcctcattactcagtgatgaccccagagccagtcttggatgaggcggggtggaattttccacacaggtgccatgagctagggggctcaaaacagacactgtggtgaggttattactgaaatattctgtttctatgaagtttctaacgtaattctgggccctctttctacaaccttagcaagttgctgaactacaggagtgcggagtaacaatgcctttcatgtcaattctgtttacagccaggcttgcttgcattaaactggacacatccatcaactagagtgctggataacagatgagaaaaagctaagtttgagttgtcttttatattgtataatggtgcttctattttctttgttttcttcttgttcttaagttctgtgggaaacccacgggaagaggagtctatccagggtatttgacttcaaatcatttcatctcttctgttcttcctctcatctagtcctctgtgttcttgtaatatacgcaagggcaagattaatagtagaacagaattctgctatgaaatttaagtgatgtgaattctttctcaaaattccaagaatgaaaactttgactatgatatagccaataatttgcacttgtttgcatttgacattgctcatttacattaactagcgtaaaatacctaattagtacagcagaaaaaaaaaaactatatgaggaaaaaaagaaatgattgctcttttactcactggagggaaaggttggatttatttcagctctgtgtttagaaaaatacctttgctgggcttcttggagtgtgaaaagagtggaccctgacccacctctattccctgctgggccatctggaaggattttcacaacaaagataaggctaaaccactctgcaaaatgaaaccagaggaatttcatgagttctggggagtagaaagaagtagggtgagctctgacaaggatgatggggttgggcatgtgatgtctggagttggggctaaggaggccagtccaggagatggtccctgaggtaggatgggagtggggccaggcaactgtaagacagcgatgtctcatgttattgagctttgctatttcgtaacctctatctgccacactttctaaaacctttgcataactactgggtatctaccgagaggaaaagaagtcattatacgaaaaagatacttgtatatgcatatttatggcagcacaattcgcaattgcaaaaatatgtaaccagtccaaatgcccatcaatcaatgagtggataaagacactgtgagatacacatatatatatacacacacacacatatatatacatatacatatgtgtgtatatatatatgatggaacaccacacagccataaaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaataaaaaattaaaaaataataaaaataaaataaaatctttataagactactgtacctgttagagcctcctttctgggaaattaaaactctaattgtttccacattagcttatgaggtggttggtaaaagagaatgactacaggaaatgaaatgccaatgaggttgataattcagtgggaccaacaagtcacagtcaaccagtgatggagatggtaaacctactaggaatccacagaaattttgaggcaggtaccggactctcaagagtgtgtgagattggtgaggctttggcctgagccattgaaaataaatgcataaatagcaacacttagcagaccggaaaacatgggggaaaacccagacaagagacacttgggatttgtcagtaaaaaatggagttgtgaggctgggtgcagtggctcacgcctgtaatcccagtactttgggaggctgaggtgggcggatcacgaggtcaggcgttcgagaccagcctggccaacgtggtgaaaccccatctccactaaaaatacaaaaattagccaggtgtggtggcactcacctgtaatcgcaactactcaggaggctgaggtaggagaatcacttgaatctgggaggcaatggttgcagtgagccaagattgcaccactgcactccagcctgggcaacagagtgagactccatctcaaaaaaaaaaaaaaaaatgcagttgtggaagctttgaaatccctgctgtgaggttatggaaggagaatgtttctgttcaagtatgaatcttttttgggaggggtggcaagaggaaggtatgcaaagggaatggtgaataaaatgaaaaggttcgactttttggtggttagtcacctaagaaggttttgtgggggaaataatgtgttttagccagcaaggggattgtttaacctgccctctaccagtctgccgtgcctcacccacttgtctacagctgtcctgttagttgtagcattttgttttcttttatgcaaagggattttcttatgacactcaaggagaacccaggagagggaaggcatctctgccttccagggacaaagtttcagaactgtactgctctacagtggtaaaaagacaacaaagtctttgatttgcaggttgcttgtttcacttaccctgtgaagtggagctcagttggaatatttcatctggccactctttagatgttcacggcagccctgcctggccagccatgaggtcgggcggagaaaggaagcaaggatgagtgaggagggagagaaatggccctggagtttgttgttggagatcttctctgtgtcaaacatcttaagggaatcacctcatggaatcttcgccacaacccattgatatggggattattttccattttataatgaggaaatgaaaccttagaataacagcaagaagctcagacaactatgaagtggcagggtgcagttatgtgactcaaaaccagtgttattttcagaagtgggaaatgtcatgactttgccctcccctccccttctctctcttccttcctttttgttggctatcttgagctgaatggtgataacgcttaactagtggaggtacattttgaataaacagcgactgacttaaatttataatcataattttattctagagttttaacaaatggtaaaacatttagagttatttttccgcagacttgacaaaggtgatgcctgactgtgcctgccgtcatttttttctatttataaaatcagggtaaatttgcaaacttctaaagaagcagacatggcttcagcaaccagtcagggtggaggtgagaccaggaaggttggagctcatgaaaggtcctcctcttctgtctaaggggcacttacttcattggtagctcagctgatactttgggaattccaagaaagagccaggaaccctgctaggaatagagaagcaaagaatccagggctctcactttgaattgctcaccacgtctagaacatgagtcaggcacagacacagaaaagtcagcataatgcgtatgtgcagtgattatgagatgcccatgcagcgtctttacaccagccagggatgcaaggaagaatctccggagaacatctacccaacaggtggatttgcttgtggggaacagaatctgtcaaggagaaacaaagcagtgcagtagttgcatcatcatgaggaaggatgatgtgcagagttagtttcctaagtggcatcgcctataatgagcagcgtgttctcctaccaccttagctgcaagcagttatgctgtatagccaacatctttctcctagctcacaattcaaaagcacattgctgggattccttgggggctttgcgtttatttgttgtggtctagtggtttattctggcaaaatacactgcatggatttttacagtttgctttgtgcttggacatctttccacccaagcaaaatgtttacaaatgccagcacgtcgttttctgaaaatattgctgaaaagaacaaatgtgttgtgatgtgccatgtgtttgaagagaccaggcaaccaaacactaagattgcctcttcctgtcagtgtttttgctcggaatcattctttattgtgcctgtttctccagaactctgtaatccaaaatggtcctgttctctgtggacatgtgtttattctgcaagttaaaaccctttcaagcaattcttgctgtgttaaatataacaatgcactgataaaattctgtcatacattctagaaaatacctttgtataaagtactcatattactgaatttaccaaaacagcataggtaacagattctaagatatcttagagttaattgataatatgtatctgaatgttgtaaaatttatctttcctatgcaaatcccttcaaaccatcccttctagtcccatttttgagacacacacacacacacacacacacacacacacacacacacacacagactgactttgttattccttactggtttttactgatggtcatagacgtctttcttctctgctacttccattatcttcctgccttcaaaatctccactttagttgcagttttgttttactatatttcttatttttaaaaatatataggtaaatagaaattgaaaagctcccattttttgttagattcatgaattcctttatgtaattatttttccaaaattaatcctgaatacagactagtaaatttatatgacaaagaaaatttctatgacaaagcaaaattaatgctgaatacagactagaacatttatatgacaaagaaaatagggaactgtgttgtttcacatactcaggagcttctgaattcaggaattttctagatggagaagatctcattatatggtgacaccagctagccaggtgtactactgaggtctgtctgtgttagactttagaaatagaccaaggatggagggaggtttgagaaatctaagtaaggaagcataggagaccttcttgtttgaggtcaaagaataattggaaggagtggttccatctcacaatttgaaaatgttctaaggaacaaaacgtacttttttatagacctattgatctcagaagatataacacagctggtggagggtaatgatcaatcgccagactaccaccattctattttcttctctgtcaaacgtactcactatattgtgagtgttttcactgcctaatttttcatggcaatttttgaggactggtagctgaactaatttaattctcattctctcacttgttcaccaaatcatttcatgtgtgtttttgccaggtattgttttaaatattgggcactattttcggttcagtaattcaacctattttaatcccttactagcccagttgtaaatttcaaataagtcattttttttcataccagttccctgctttcgagtctctgatgaggctacgctcaagtattacccaggattaggtcctatctgaaagctcaactggggaaggatccacatttgagcttgtttatgcagttgttggtagaattcagttcccttaggacggttggactggggggcctcagctcctagctgactgtgggccagagatcacccttggttccttgacagatgggcctgcccattagggcaaattgaagcatctaagtcagtgagggagagactctactggcaagacagaagtcacaattatatataatggaatcactgaagtgacatctcattatctttgtcatattccattggttagaagcaagttacagcacccacccacatacattcaggagggtgtgtattacacaagcacgtaaacaccaagagatgggatctttggagaccatcatagactctttcctccataccatctgaacatttaatattaatgtagtctgtatttctacataacagttctctgaaaggaaactttgctgtgtgccagataatactttttgatcttcttattttacctttccttaccccacccatgattattactatcaaagctttagggcataacatagtgctaaaatagaacacttactccaaaaatttaattaacaagcaacatgaaataaaaggccatttgcatattgtaggcaaataaaaacattatcaccaggagaagtgagtcagaatatatcaaatataatagctaatattaaatagctgggggtgagagttggaataatgagcagcctctgtacagagggcatgtcaatcaattactctggccctattggagcacctgcctagaagtccttgctgtgcctggttaacccatcagttgctgaatagtggggaggtctctggtggggattctgggaagaggggctgagcagtaattgcggagaaccctaggggatcccagcagtcactatttactaagacatttttattacctaatactctatggctaaatagttaaaagaattaaaaattctcaaatgctttcaaggttggagccagttcatggggtcaggagagctatctccaggcctgcattctactccccttctttttccatccctgccccatccctttcaggcagcacctggtgcacactcaggtgacccagcctacatgtcgaggatccacgtaaacacccctcaaacagatggtcccccgcaggcctcggaatgtggcaaggtctaccattaggaatgtaggctcaggaaaggctccttcaggccctgagagtggacgtggaatcctgatggcggggaatcccagggtcctgtgacccagagcatggtctagaactgtgctgggcagcacagcagccgcacattggctccagagcactggtcgagatgttccttaaatgtaaagtacacaaccaatttcgaagacttaatacaaaaaataaagggcgtaagatatctcatcaataatttttatgttgattatgtgctgacacggtagtgttttggatatactattgggttaaataaaatatataattaaattagttctaactgtttttttctaatatagctactaacaagtttaaagttctatgtgtagcttccatttgtggctcccataacatttctgtggaacagcactgctctagaagggagaagtacggctctgctaggacacatctcctgctaccttggaccccttgccctgtgaggaggaggagctagagcagagccctctaaagcgtggagtcccaggcaggagcctttcttgccccagggtggttttgctttaaggtgatatttatagtctatttggtctcactctgtcatggctaaatgactccaaatctctctcctttgcctacttctgggttttgcccaaggcaagaaaatagtcttcctcaccttccacctgcccacccccactgccactgccaccaccaccgcttttgaatcaatataaccaggcacagaaagtaaaattgttctgtattgacatgtatctttcaagaagctgttattctttgggtgaaacagaatctaatcactaagcaatttttctacagagagagggagacttttcactccccttccccttggtttgtagagtacattcatctttgataattgattcttcgggtggagtaatgatgtaggctcaggaatacgttttttgattcaaagggtataaaaagtgctatgtgtgttaggggttaatgtaagctctgtggaattacaatacggatgtcttctaaagaaaattcactaatctaatctctagagaaggaaacttttagagagtcccttatgactcccttaagaaattattgtggatagtatgttgctgtatgatggctttaagaatttatggtgaatgcttcagaccatggctttagtgtttcaacagaaacagtggcttacttagggtggtggtgcatcttgctcttgaataaatctgatctgagcttacaagtaggaaggagtaatgatttagatgtctgaaatctctttagtttattgtttcttttcttatcgtggcagagagtgactgttaaaactttttcctcctgggcacgtagctggcctacatttcccagcatcccttacagatggctgtggccatgtgactgagactggccaatgggatgctagtggaggtgatatattcttgtccaatcatctactctttctccttttcttctgcctatgagatgcagagtataggggcacatgggcaccacctgagaactctttaggaatgcagaatctttaaccttctcctaggtgtagggaatcagaatctgcattttaccaagattcccaggtaatacctatgctcattaacatttgagaaatattgccctttgagatgacagagccagtagatggaaagatcttgggtccctgccttgtggcttagaggagagccacccaggagtgtggcttcttgaagcagcctgtttagattggtacataaacaggaagtccaattttatcatgatgaggtcactgagattttggagttgtttgttatagcagttagtcttccctggataatatactcacaaagtatttaaacaatgccatgtacctacaatgtatccccttcttaccaataaattctgccaaccaaaatgatcatattgtacctacaatgtccaaaatgtttaatacagactgaggtagaccttataaatggtattggtgaagcctagtggacaattttaagaaatcaccaacattacaaaacgttgactggcaaacttgcgttcaccctatatatgctctgtaaatgttcctagctccctcacttttttgtctttttcttcttcaacggcctccttcacttttcagtagcagcaagattaagaggtgaaaactgccattactccagtgaatgggtgaggtcactgatttgcacaattcctatgagagcccaattaaaagaagatacagagataagcatgtacgttttcatctctcttaactccattatcttattgtcatttggctatgatttatttaggtcaacattgatttctgtagcttatttagatagctagaatgataaaaatatctttttgttatcacaaggagtacaattatttacatatttacctattcatccattcattcttagtatacagaacagtccaatcaggaacaatctgtagtacctatgacaggtacagaaaagcccttaaagattagcctctaaggtgttaatgggagagatttactgatttatatttttccctatggatctggagatacagggtattaacaagatggatgagttattgggggtgcatttgtatgtctcagggtgcatgctgtctctgataattgctgtctgtgtttgattgggcagagccagtatcttaaaaccttcactagaatttcctatattgagacatctaaagttaagaaatctaggtaatttttgcttatcggtttaaattgtgcatagaactaaattattaaataaccagcatgtctaagccttacccttttctttaattacacacatatccatgcatgcacacacatacatgcacacacatacatgcacacgtgctgaggaggaaaaaaaagctgaagggattttgtctgtgcatacatgcgtacatatgcacagacacacacaagaggcacatgtacacatgtatggacctgtgcatgaacacacaaatcccatcaacttctttttttcagccagtcattatagagaggaatgacagcttttatttgctgcaaaaattcaagtggaagaacgtcatatacaagaactaccagcctagtggtagagaaaagaggattctttgaagctctttttagtcagtctgtactagcaatagtccagtgtttcccaacttgagggtgccctcaaggcgttgaaaacataaggtaccactgtgatcgaggttttaccaaattttaactttccttcacttctcacctaaaatatcttgagggtgatctgtgctcagatttgttttaagggttggggggagtattcaccttctgaagtaaaagaaggaacaatttgtcctctgtctggcttctatcatgaaacttcataacccaagagcacatcttgacttcagctttgttatttttagtggtagaggagaggaaacagtaatctgcaaagtgtgagttcaattaccctgacctttcatattgaaatctgaattcttaataagtgttttatgtgcattttatcatttaacccttacaacaaccctatgagataggtagtgttattataccactttgctgaggaggcaactgagacacagaaattaagtaacttgcccagcatttcttgggattctaacctaggccatctggctccagaagctgaactcttaaccacactgctctcctgcagggtcgatgagcttgccatgcctcttggtcattccctaaggtgtggcattttgtgattcgggatctggctaactcatttaaatatggaagtttcacaaagattcaggctgctcagggatacaaaatggctcattggcagggtggggcttccaaggaaatcgatttcattcctttcctaatgggctgcgctagtttgcaaaaatcaagaactgtgacgatttaagatgcatctgaactcttttagatttccatagaacctcactcagcagtcctttcgagatgatgtcatagttcttttgtgtaatctagtaatgccttttaggggaggaagccggtgtattttacaaatgttatcttatccttacaacacccttgaagcttagtaagtgatattagttactgtttgggggattacaaaaattaggttgtggtttttaatgtttatttttatagcaatgagaagtggtacacacacacccatacttatatgcatatttgtaaacatgtgttatgtatattattatatacacgtatgcatcctccccccagcattgatgtgtgtaattcaggtggtatttggttgactccctcctaatattttgcaactgccactaattgtgatggttgttgcactttaaaatgttaaacttttagaatatgtgagaagtgagcaatttggcattggatctagcactgtgtcctcaagtccctttcatgtgctcagtggatttttattgagtgccaattgtgtgccaggcagtggcattacaacagtgaccgaaacaaagtcactccacttgaggacctgaatgtctagtcaaggagctagagagaaaacaaatatatcctctgtcaggtgggggtaaagcgcttctgatgacaaataatgttggctgagctatggtgacatttcagcagaggactgcacgagctctcccaggcttttcttgctctaaagcagtagttctgaaccaggggtgagtttgcagtaactggagatatttttctgccctacctggggcagggctgctgccaggatttcccattcagagtgatttgagaggatctcagtccacctgtaaagaggaaaataccctcttagatttgtagggccacagcctcttttgctgtgcctggaacatactggcagacacctttcctgctggggattttgcaaaatctggggacgtttttggtggttatgcttcggggaagggtgctgctagcatctagtgtgtgaggctggaagtgctgctaacatcctgcagtgtacagggcagctgcccacaacagaatgatctggctcagaatgtcagtagtgccaaagtggataaacctctagaaccacactccccaggggttcagtagactttcccgagtgggcatggaaaggtaaactcaactccctttctgcacgacccctttttctggcccatgagagcctatgctgtggccagtcgctgtgacagaatggttttctgcagggcatccatgctcacagcaggatcagatgccatcttcatgctttgacttgccaaggacattcaccaataaaatgcgcgttcagggagacagctgtcatgacacaacacgtttttcccatgacacacatttcttccgtccctctccaataacctcgactcttgaatgggtgagggacatttcctcaagagctgtttatctgggctttggggctgtcttgtgaattctatttaaaaatactcaaagtccctgagatctttggatctaaataacatactggaaccttcccgtcccctcctctccttggggctatggtaccaacagaagatgaaagctttatttcattttcaaaagtattttatatttctttattttgtaccctcttgataattgatcctcagctgccaggatttcccattcagagtgattcgagaggatgcccaggccacctgtaaagaggataatacactcttagatgtgtagggacacagcctcttatgctgtgcctggaacacactggcagacccctttcctgctccgagtatgcggtaagggggcaagaagctgtatggtggcttctccctggagaagcagcttcagccccttgtgctcctgcactcctgtgctttaagggcgagaacacattggattctttttttttgaggtggggtttcactcttgttgcccaggctcaagtgcaaggcacgatctcagctcactgcgacctctgcctcccaggttcaagcaattctcctgcctcagcctcctgagtagctgggattacaggcataggccaccatgcccagctaattttgtagagatggggtttctccatgttggtcaggctggtctcgaactcctgacctcaggtgatctgcccgccttggccacccaaagtgctgggattacagttatgagccactgcgcccggtgaccacatctgatgctgaaccaaaggcagctcttgggaggtggctctgagcctcccagccgcaaggtaggggagctcaaagatgttttaggagtaagcttgacaagagggtatcaggaaaaattgtttttctttgaatctccccggaatatatcatgtaattcacctcttgaggggtcctagaaagaccacttgccatcccaatatctagccagtcctggagtggacccagtcagagtgcatgaactgtgatacaaggcctatgtcttggtttttttcacctcctgcaagctaggagcctcccaactacccacagattggaagggacttggtgcagggatatggcttcgggtgacaacccacctatcagagctattcaaccattgaacagcatggctgtcagtctgaggtcgcagtgatgtcaggaggtggcagttttggcagctgacagccctcacagatgcccttgtgcagaatgaacctatcaagcattttctctactggctatgaaatggaaagtgaggcaagacattcagttgctgcacaggaaggaaagcagtcagggtggttgcctgagcgtccaggtcccagacaggtctgttctccatggaatacattaagggattgatttacctgtcttggagctgcttcacattgcagtagagggactgtgccgagtgtcatgcaatggccagttatcttgcagaacttgtttgtttctgcaattattaaaagttttcctggcagtttttttgttttgaccgagagtctttcctccaaaaatcattctctccatcctctcagaaccctggataattctctcctgtttgtcgtttgcataccatgtacctggaactcttatgttctggttaagtattctagcataagagagaggaagcaaaataagtcagcagaggatactttcagcatactgtgacttttagaatgttcagttagtgatactaacgtttcatagcctgtaccaataatcaacttttctttcccctgaagacaaagtagcatggttgtgacctatctatactgacttgttttcttcatgcatgcattcaacaaatcttaattgagtgcatgttatgttctaggcgtggggctgggctgaccctctgggaaatgacaagatgaaatgagacacattcctcctttcaagaaagtttgtgtggaatgtagaagatcattcattggttgaggagattgtaaactatcctggaacacagtggtttaggatgaaacaaagcagtgcacaaatgaacgctctagtcagtgaggctccattagaggttcctcaagggtggggactgcgttgagtgtcacgagactcctagggtcagcacagtgcccagcggctggtacgtgctttctaagtatcagctgaaatgctacagcagcacggcctagtggggagggagagagaaagggaggaagagaggggaagggattgaggaaactgacctagattatgggcagtgctggtcccccactctcagcccatgtggcttgggagaatgagcctgtctcttgatgctgtgaactatcaccaagagatcccctaccttgctccccaagttcaccaccaggcttctctccatctcagagcttattgaaaggacatggaatcctctggagggagttctccattgaaaacaaagacaataaattccaagtggcaaatctcataggtggccctgagtccctgtgatttttccagtccaccccttagttgaagtaaggcaaaatttgttttggggtttcataacagtgatgtaagtgcattgctttgaagcagtttttgagggagaggggaaaagcctgagttttggagaactacatttgtggaacccaagaaagtgatacatcttccctcctcccacccctcattgggggagatgacatggggcatacttccctatgtgctttagggggtctctacagaaagggggaaatgggattttgctccttgagtttgctgagggtaggacctgcagacttgctgtggtgccttcagagcaagagggaaagaacacagaaatagataccaccaaaagggatgaggatttcagatggcacacagagcctgctgagcgcatagccatgcaccgctgtgctgtgccttttcctctgacatccctttgcccacatataggagacaatccccttacaaagagccaagagcaagcctgaaggcttctgggagtccagtcggcttggaagtgagggaggaagctgggaaagagtgagcttaggtccgtgaacagtgatgagttcatgaaaatatttgaatctacctgaatagaaagattattttaaactagggaaaatttattttaaactggaagaggctgaaaatataaagtccactaatcttgtctgtctccatgagcttttacacatacgcacatgtgcacacacacgctcgcccatgtaatgttcacttaggtcaagatacagaccaacccaccaccccagaaggagctcttgtgcccctttccaatctctccccaagataaccattattctgacttccatcaattaatcaattttgcctattctttaacttaacataaatgaaatgatatgtgtacttttttgtgtctgactttcttctcctcaatataacgtttatgaaatttatccaagattttgcatgtatcatttttttaatgctgtgtataattccacagcatgaataaaccacaatttgtttatccattcacctgttgatggaaatttgagttatttctaatttttgtttttttcaaatgaaactgccgtgaacatcttgtgcatatcttttggtggacataggcacccatgtctctcagatggataagattcgaattataggttccataggccacatataggtaggcctatttgtatctttatatttgatttgttctattcttctgcccatgacaaaggtagtaaacagggtgtctttgagcagggaggctgaaaatgctctcttgtgagcagggtaagtagatggcttgtgctggtgcagaaaggcaggatgctggagaaatcccaggggaagcatggcaccagtccaaccagagactagggaagactcattaagaataactttttactacatgtaggtccagggaaagctgacatgggaataatgattaaaaggaatcaagtaaaggggcagagaggtagatttaagtaatggaaagatttttggtctgctttctagttttgtcctctagcacaatacgaaataattggctgtgggtatattacaggatcccttagatcttattgtctcatttataaaatataaaggctgtacagggtagttcctaaatggcctttgagctttcatcttctcataattgcatcaataatggcttagttgtaaatgaccaattctagtaataggagaaaatcgcatggaaattactgagaaaagcccagtttacttcatgctgttatcttaacatccacaactacatgtcgagagaatacgaaaatgtgttcttaggcttttccttgttcaaccagtctagccatgtgccattggtccttcaagggcagtggctgagcctcttttcttcctcccccactttttgctccctaccagacaaccttctcccataggtgctagtctgtttcctccctgactcgcattcctgcagccaatgcacctgctggtctgctggctgttgtttctcactcactgaaaaccagatctcaggatggacataggttggtggaccattttcttccagtcattcattcattcacttacagattaactccagttacagtcactgtagctagcatcacatacactaagctatctctcatactcttccagacattgcctaaggctgtggccacccagcccctgccctactgggtggagcccacacttgtgatatctcagagtgcttcctccaaccaaagaacccagccttctgcaggagggacacccctttccccctcagacagtcctgattctggcatattaccagaggccagtctttcctgatctcctcctatcctgagacgttctaggcctccttgagttccagttcgctctttcaagagctgcaccaaaacatctttacaacttgtgtttattatttgctgaagtttagctatcttaataaagaattatacttgtgatgaagtcagggccaggtcagtttgtctttctattcttggttcttagcttgttatctggtatatacaaaatgtttcatgaaaattcttcgtattgaagaaagggaagggttttgccaaaagccctactcaaggctgggaggtactgacgcattactgacacctagggataggctacctaaattgcagggtcatggactatgacaaaacagagtgttagtagtgaacatctcaggtaataccacataactttttaaaggggaaaggtcttcctaatttctataaatagttcaaactttcagacttagaatagtcctgcacttgtggcagtgccctcatagatccagaaagaactgatgttatctgatcttggggaaagtccccgccttgggtttgtaaatatccttactgacggtttctagacatttatgcacgacgttttgtcatgtgggatccagcacatatttctgacctggcgaaaactaagaatatctcaatcataaaaataaccagaaaatcataaaacagaaatctggcccaagattttctctggaaaagtaagaagctgctttgaaaggtgaaaatagaccagtgagcccccgcattggaacagattattccaaaaattgtgagcaaaggtctttttctgtattgtgcaagttaatctcctttgcccctttttgtggctgaaatgcatgcctaatctgcatatgagtgcctgccccaggtgggatggggcatgctgggattcctaaaattcagctggcttgcttgaagagggctatcaggctagatttcatgtctcaacaatttctagccggtctccctgagctggcaagcaccgctcagtttataatagtgcctggcacatggtaggtccagtgtttattaaactaacagatattcccaacaggtgtgggcagcagtgctgctaattagcagtaacatagccgcatggcagggacaggaaaggggagccttctgtgtgtccctactatatgcaatgtatgactccaatctcaaaagaagcagagaatactcagccaaatatttgcattgattcctgccaacaccatttttttgtgatttgtatgttcccttccccaccccccaccccctgtactgttaacttcatatttgaagggggttatacttttaggttatttgtgaattgagtcagctcatgtaacagtgattctcaaagtgtggtcccaaaaccagtgggatgggcatcacctgggaacttgttacaaatgcagattattgggtcccaccccagacctactgaatcaaaaatcctggaggtgggtccagcaatcagtgttataatgagcctaccagatgattctaatgcacattgaagtttgaaaaccaccattgtttaaggatcacaacaaatccaacagcactgtcagaagaacaactccttattctaatgggtcaggtgctttctgtgttggctgtcctgcagagcatctctagtgatagttgtattttcaggattagaggtgcaaaactaatgggagtttaagaaggaagtttgagcctttactgctgggagaatcacaagccaagtttatttctcttccattatttgtatggtagctaaaactgccaaggactactgtgatccattgaaacatcagtgtatcacatctcttcttacatctgagctggcattttgggtgtagtgcttcagtaacagttgtattcccaagcaaataaaatcttagccaccagaaatcttgagttggactagacaaaggcacctctccagatagcagctgttgttggaattgaatataagagatgcttaatcaatgtttgtgtaattgaatagaatgggaaatgaatggctcactccaaactttatacaagacagatgaaggcaacttcgatcttaacctttatgatacatagcattttgtactacccttgagaaaatctcagtctcgggttatcatagactcaattggctatcatgggaaattctgtctcagtgatgctccatatctatttaattgaggtttattatcaatttgaaaaatggaaaattcacctcacatattttaaatagccaagatagccagagtgtatgttgtggtttcaatatgtccccaagagttcttgtgttaggagcttggttgcctttgcagtagtgttgagacgtggggcccttgggaggtgattgaatcgatgctgttatcatgggaatgagtttgctatcttgggagtggggtcctgatataaatgatacatttggctgccattttctcttgtttcatgtgcttgcttccaccttcccccttccaccatgggacaatcctctccagatgcctgtgccatgctcttggacttcccagcctccagaactgtgagaaataaatttctttataaattactgagcattctattatagcagcacagactaagacagtgtaagaaagctcttatattataactctctccttctatttgtattcaggttttctcttaattctggaaagtttgggcagcagctgggaatgggaatttattataagacatcccttcagtgtctctacagaattgctttaattaaagtactttgttttatttgtccccatttaattataattcacatcagagaaagctattgttaaaatattttggttagttcagtgtggggaatgggattttccatcccttgaccttcatgactcagtaaggagcagataaaataattttctttgctgggtgattattatgcctcagggacaagtcatatttaagacctgatagtttgattcaagctctcataattgctgtgcagacagtgttcaaagccaaagtcttcctgatcataaggtgctgagaggacattcattttttgccatcattcagagctctgcaagagagcaaattgcttgttacttaaatgtgttacctttgaagaataaaaatctgaattgacactgctgttatttgagccttcaggtgtagggacttggagcacctatgtataccatggaatgtggcttaacaggactaaactgattccttctgcataatgtgctatatactgatttgcactgtatggagtaaaacctcttcaaccatatttgaaagattgatatttactctaaaaagcctataccttgatgatatggtaaaataatcaggttctctataaccttgaatactagtaagctgtttctttgccttcctaataacatgagggtttttagtttttgtttttaaccagcatttgagtacctactatgtgcctaatagagtcagagtgactcacattaaaattaactagagttaccaaaaatttgtccttcttacacaaatatgcaatgacaacagaatgattatcagtaataaatgtatgtgcacttgcagattactaagtgactgatttaccacaaaaaaggaaaggaacattacttagatttgttgctgtccactccttgtttttcattatggttcagtttggattttcaccacaattcagacatgaaaactattctttccataatgaaatcaggtgtgaggttttttttctcattcttttctttagaaaatgtatagcttaggccaggcgcagtggctcacgcctgtaatcccagcactttgggaggccgaggtgggcggatcatgcggtcaagagatcgagactatcctggctaacatggtgaaaccccatctctactaaaaatacaaacacattagccgggcctggtggcacacgcctgtagtcctagctactcagtggtacatgcctgtagtcccagctactcgggaggctgaggcaggagaatcgcttgaacccgggaggcggaggttgctgtgagtcgagatcgtgccaagagagactccatctcaaaaaaaaaaaaaaaaaaagcaagcaagaaagtaagaaagaatagcttatattttctattaactccaaccaagcaaaatttaaaatgctaggttgcactccttgcactccgtagtgcaacccaatagcaccatggctttttaattccctgagagagagatggtggacagggtgttctgggaaactgctgacagtaacatctgtccataccgaaagtcaagtgaaaacttggttcacatgagagcaaatgaaaatatgatgtttttaaagaggctgggaaaaagtcagagaagtgctcccactattttagatgagctcagcagcaagtttctagtaggtaagagggaaaatccattgtggggaaatgtgccaatgactgtttttggttaaaggtttgaatgggcacgatttagcagaactttacaaagctgtgtcttgaagagctttggaaaaacatttagtgttgttgtcgttgatgattttttttcatactctctgttgttcaggttatatgtgactgaaagaaagaatgatgtagtttcagttacttccatgacccaccccgggctagcacctccttcagccacatggtaaggtcccagaaacatttgatagagaccacatgaaagtagatgcttatgcagatgtgacttttgaaatacattcttcctggctttcagatgtgctattaattgcaggtttaaaagcccttttttgtttgatctgataaggtaggcttactttatgtcaccttaaaatgaggttaagccaagaattgcaagatataaagtattcaatgactactctccatttctgctgggaaaaagaccatctgcttaggtaattgcattgtaatactcaaacctggctgaattgcttctgtccctgcaaacgtctcttctgtcttttacattcacagtcatatatctctcctgcatgtagatccaagacccagtgtagccttttgtataatttgtaggattaatagactctgggtctggcctagtacttatattgtaggtctataaattatcataataacataggtataattgcaggtagagttttatatctgggtctgcagtggtttgatcattgactcactgagaacaattattaatcttcaactccaaggtaggacacacagttccaattggtacataaatagtacatacatttacattacagcagggggacattgtctttgaaagaacatgaataatacgttaaacctggaagctgggagggggacatacagtaagtgggaaaagagatattgcagaaagtttaaaaacagagaagaagaaaataaaataaataccaaagcaagcatgctgatatcttaaattaggtgcaaggaattctttttccttctgtgcctcagagctgcctctatgtggccatatgtgccttgagggggaaggagtatagtaagctttgggaatgatgattcttcatcttgcaggatgtagttgctcgtgttggctcaactcagggtaaatattctagatgattgatgtatgaaatcctaatagtatgccatttaggagtttgtttaccatcagtctccacattcagactttttcttgtgggtttgaatgttctgtagtttctgtaatattgaattcaaaggtttgcttttgattggactttcctaattaaaagcaaatttattgtccctacaccttgcctctacttagcccaatctcacacaccctgtgaggctttttcccagatgttatttctccttcttgaagcttcttataggcagaaactggacctcattcatctttttatcttttacagtgctctcgcaaatatttattgaataaataaatgacataatttatacagtctgtgaggcttacaaataccttctttaagctattagtaaaacaaaagtactggcacaaagtgatttcttgttcatataacagaagtattttactttcaaacacacacacacacacacacacacacacacacacacacacacagaaagagggagagaaagagagagaagcccaacccaacaaaccacttaagggaaaccatgaaaatggtatctttgttgagagttaatgagtttatagttaatttatgctttccctggaatacatattatactcattatgtacaagtaaactatgactgtttttacacctatcacagatattccagatcttaaaatgctctgtttgaaataaaaggcagaaggggggacttgggcatattcccttatagttattcttgtgtctcttatggaatagatgcaaaaaagtctaatttgcctttctgtcacttggcaaagtttattatttgcttaagcacaagaagataaatgttttatcctactggcaaaaagtattgtttgcacaaatgtaaaattctgttaaatgtatttatatgtattgtcttagtcagggttctctagagggacaggactaataggatagatagatgtacatatgaaagggagtttattaaggagtattgactcacatcatcacaaggtcaagtcccacagtaggccatctgcaagctgaggagcaaggaagccagtccgagtcccaaaacctcaaaagtagggaagccaacagtgtgcccgaaggcccaagagcccctggcaaaccactggtgtaaatccaagagtccaaaagccgaagaacttggagtctgatgttcaagggcaggaagcatccagcgtgggagaaaaataaagaccagaagactcggcaagtctagtccttccatgttcttctgcttgctttattctggctgtgctggcagttgattagatggtgcccacccagattgagagtgggtctgcctctcccagtccactgactcaaatgttaatctcctttggcaagaacctcacagacacccccagtgacaatactttgcattcttcaatctaatcaaggtgacactcagtattaaccatcacatgtatgtttctatttgagtgtttctgtaaatgacatgctttagtttttgacaagtcaaatcctaccaaaataccctcatagaaaactcttgatgagagtaatggttatatccaagtcctctcaataacaaatttatttcaatcaatatttaatatcacaaaataacagtatgacaaatgaaggatagaatgtggttaactagtgtagagtgtgaattatttggactggattgtgaagtagatgtaactgatactcatggatgaacttgcagtaattatagataataaaaaattaccagccaagtgctgtggctcatgcctgtaatcccaacactttgggaggctgaggtgagcggattactgagcccaggagttccaaaccagcctgggcaacatggggagaccccatctctacaaaaaatgtaaaaagccaggtgtggtagtgtgtacttttatgtaatcccagctactcaggaggctgaaattggaggattgcttgagcttgagtcaaggccgcaatgagctcaggccactgtacttgagcctgggtgacaaagaccctgtctcaaaaaaaattataatgcgtacataattttttcacacatcaaccactttcctaacaagtcattgatcctcaaaataatcctgtgagtattattctcttctatgtaaatggaggaactgagtatctaataggtgattgccacatctaggcagctggcgtggagggtgttgaagatttgagtccggtgcctttgaccccaaagcctatggctggagatgcctgccaaggcaaaactgcccttaccaaagcagattttatcagctgatcccatttctctctcactaaactgagtccatgaatccttctcaatgtagacaaaatctatctgctatcctgacctatgttatttctaagtgtattttgctgggcattaacgcagatggaatacagccgagtttgcgtaagttctgtatagtacaccaccaagcaccttaacaggagcctgcaaattgccgttgagggaggtaacttttagcatctgaggctttgatgtgtttatcttctccaggaattttgttttgcctcctttgggaggggagaggtcttctgctaagcatctacttcctttatttcttactgcacaagaacttcggtctaattggccaactttgagtgtgctgaggtgacctatttctgtctgggataataaaaacattccagatgactgacgccttttactggggacaatttgacctgattctaaccctcctgctctgcctgccaaggaagatgattactacaggccttagtaccgacctctatttacttcatctactttttttttttcattttcttgcaaaaatagcaggcttgtccaagtgcctagctactatggcaataagtgctatttaaacagatgccgatgccgaatacatgtgtcccagcttaaatgagtcagtgggagcagttgtaggatctgattgcataaatgcatgggaataatgtctgtctctggggcaacagaacttcttttgagcccttgagaggaccagttcagttgcagaaaggctgatgtaatgatcacacaccttcaggtgaaagggtcagtttctccctgaatggaaagtgtcaaaaaatggccatttagactttctgctttgtaactagagcaaatgcctcaagaaagagaaaatgaacaggaaagccctcaaaagctttaaagggcttagaaaatgtaaagccattattgttggttattcaaatatccctctgattcaaatagatgcattgattttttaaaaaaatctacagttaacatcaagaaacttgagcctcagtaaatgagcactgccttatagaatattgctgaatatgtcttgaataagttgagaaagcacttggctgtgtataactactcatgtaaaatgctattggcacaaagatgacatttttttcaaagatgcctctatcatgtggctacaagtagattgtgctgattctattcctctacaaagctcagggtcacaggtggtctattagtagttgttggttgttagctctgccataagaagatggcatggttccttaggttagatgcattcagagttggtggtggacttgagtgtctacttatgcgcagagattttcagtcttttatttccatcttgacagtagacagagaagcaggggacaggcttgaaatttcagtcaaatatcaatccagcatgaaggaggacaccctgattttaaacacccactaatatttccttggaaaaaaaaagagcctaacacatctctggctccagctcttctctcctcccctcccttccctcagcccccaattctcttttcttttcctgtcttcagaatatgtgaaatgggggaaatcataaaacagtcaatcttcattattcacagtttccatatttgtgaattcactacttgctaaaatgtcttcgtaacggcaaaatcaatgctcactgtgcttttgtggttatttgcagacatgtgtggaacagtgaaaaactggagttgttccccatgcatgtttctagttgaagttaaaccaggtgacagccctttttgtttcagccctcatactgtaaacaactctcctttttgtggtcagcttagtgccacattttaaaacatttttctgcttttttttttggtgattttactatttgaaatggtccaaggatagtgccagcctactgtccagtgttcctaagtgcaagaaggctgtgatgtgccttgggaagaaatatgagtgttagataagcttcgtccaggcctgagttgtagtgctgttgctgtgagtccaatgttagtgaatcaacaatatatactcaataaacagtctttaagtagaaacacatgttaaacaaagttatgtatttatcagttgatgaaaatgtgaccagaggctcacagacacctagccctgtatctctccccagagcaatgcttcagtatttgctcagaaccaccacaagtaatgagaacaggctaacctaccccttggagttgacgtgaggatctcatgagctaatgcccctaaaatgcatggtgccttacagtgtgccccataggtgctaactatagcagttatcatcatcatcatcatcatcatcatcaatgaaaatacgggagaagaaaaaattaccaataatcccactattgtacctcaacaactctcttcattttgggtattcccttcagtcattgtttcgttgcattcacatctttgtataactgcattaaactgcatacaattttgaatatttctttgctatcattctgtcatgtgcatcaccctgtgttgcgacacagcctccatttctgtggtcttcttgatggaaagcggtaaaaactttgttcctgggctcatgtaagagcagctctcttcaagcatagggatgacttcattgctcacgacaccaatatgccttaaaattctgtgattaattgtaaaaaagaactctctctgaacactacagagaaaactctcacagagcagagaaatttattatgtgatcttcttctctccagaggaaaatggtgtgttttaagtcagaaggtttgggtcattattcagtagaacgaggtgctcgagggattacaaaagaagagtaactctaatctttgtgagagtgatggcctaatacaggtgttagcaaacatttcccgtacaggctcagatagtaaatgtgttagaccttgtgggccatatgatctccattgcagccactcaactctgccattgtagccaaaactatggataatattaatggataatattaaacaattgagtgtggctgtgttcctataaaaccttatttacaaataaggcacaattccaaacaaaatagatctgaacaccaaagtgggcagttcgtttattgctttattcttccacaaaacttctagtatgttaggccttgtcctggttggcagtaacatcagcaagagtagcaaaacatttttctatgcctcatgaagtttatagtctgaagggggagagagcgatcttaataaaataattgtataaatgaatatataattgcatgtgttgataaatactgcaaaggaagaaaacagtgggaaataggactgtgtcagatattcaggcacgaagtttagggaaggggctgcactttgaggtggccgccagacactcattgaaataagagggccttgatcattgtgcagtaagtgatttttattaacaagaacttagtcattacatacctagctgtaagtagatgctagctctgaagaatagattttcggtggtcagtttggcattcaaccaggaccaaaagagaatcccctcattcgctgacttggggctggatttatgagtgtcgtcactccctttgtattttctttttttgtcttattggtctttctaggcagaaatgaataccacatggttgagacacgcataagattcaggtccatcaggtcttgagcatctttctggtaacttaaacataagccaggatccacatatctaacggctacatgggatatagggcctcgttcataaaaacgcatacccatacttcttaatatgcccttgcctgttcctctttagttctctcaccccctgcaaatattcttcctttttaaaccctcagtttcttcaccaaactttcccagacaacctatccccaaggactttctttatccctctttgccagccaacctgtgtaccccttttcttctggaggtgcactgaggacttttccctcctgcctgatcatctgggcctctctgggctacccgggccttgcagcttcatggttcctccctgagcctctctccctagggagggaagcacaaggaactcactggagtgggcagttctgttcacaccctggtaaatgaaatcctctgcctcattacactctgcagacaatttcagcatccagtcatgcttatttcttgaaggaaaaggactgtttttccaccatttgggtctatgactccactggggattaaggaaagagacaacattgtggaatgtgtgtgtgtgtgttgttggagacagcttttgcttgggctggtatcatgtctactccaggattttctgaagtgactgtgggacaggaagaggcccattggtggctacttagcaacaccaggcccttcacgggcagtggaaagtcactggggtaatgccccagaccctcaccctcaacaggctacacctggacagagacagggcacccttatggggctttcagggatgagatgtgttcatccacaaataagggagaagcacagagacttctacaagtatgtagaggagaatctaggagatacaatgcaagggctgagaatttgggatatacacttattactgttggtgtggtcctagccttacaacaggttgtgcagcccaccaaagcatggattacagtgttaacatgcagaaattcctgattgtacctcttttccagctgttcaatcctacatgaggcctttcaaaacccctgtgatttcttacgattagagatgtaggctgtcccatctagtaaatttgtcaaaccactactgggtatcaggtagaaatagagttccctttcatcactagcaatatgtttcttttctcaatggtttgctctcctttgctcattttccatggaaggtcttcattactcctgtattttaaaagctatcttgtcaatattattccaagcgaatttctcagtatattttaaaagggaaaactaataatgtgatcctcttgcttaaaaccctttacagcttcccaagagtgttagaattaatggggctggtactagcatgcaaaatttaagggaatgtcaaaaaagtcagtagtcaagataaataatatttaatgcactattttaaaaatgttcttggcaaactttcgtccacacctgcgtttgtaaatgaggtttcaactcacaccgtgcatgtgacttgagaggccactgcagcacggccaggcctcagtgcactctctggcctcaacgtaactcccttgaccttccatgttgtattagtcctttctcatgctgctaataaagacataccccagattgggtaatttataaaggaaaaaggtttaatggactcacagttccacatggctggggaggcctcacaatcacggcagaagatgaaggaagagcaaagggacatcttacatggcagcaggcatgtgcaggggaactgctctttataaaaccatcagatctcatgatctgtgacttagtcactatcacgagaacagcatgggcaagacccgcctccatgattaaattacttcccactggttgcctcccacagcacatgggaattatgggaactacagttcaaaatgagatttgggtggggacacaagccaaactgtatcatgtaaccaaatatgttaagctccatccatgctgactttggtggtcatgtccatcccgggcctttatatgggttgtcccctttcttcacatctctgctgagctggcccctgctcatccttcagaactcgatcaagtgctccttccctcttgttggccaccctgagccccaaggtgggatcaggctcctctgctaggtgtcctcagggtggtgcgtgggggtcgttagtgtttgtccttagaatacctggcaagcagacatgcacgtgggtcattttgtttattaacaccaaactcctccagttgattataagctccatgagggcaggactgaatttgtcattcttatcgcacagtggcttacatgtcagtcatcactgaacagttaatggtcatttgatctgatatgcttctggtataatttcatgatatcagatctggagacatgaagtcattgttttcctggtggggagtgtgacaccaccatcttgttcaccatttgcagagttctttcctgtcttcgggcaagtagattaggttatatcgttatctctgtttatagctgtctcaaataaatcctttagaagagggagaaagatggtacaaagaaaaaagaagccaaggaggaaagtgactctcagagatgctaatgactttcccaggaaggctgtcacacagcaagaactcagatatgggttttacaactcagaaactcatcctgttctaggccccaacctcactctctcaggagaaggtcctggaggagattcccctctcactttccagaaaaaggacaaagggaattaggaatcttttcttaacattaacgccttgccaatttctagacctcccctcctgctcctcccttaagacatcctatttgcacgtctctgctcttagaggctattgggtttaagcgccacaataaataaaaggcaataaaataaataaaggcaataaaagatatctcctggtaggatataattttctttctttcgttcactgtctcagagttattttatccttttcaccacgagggactcaattggaactggctctcttattagccttcaggttcaactggcttccatggaggcattgtctcctcatagacctgttcacttgacagaccttcacagaagtttcatcagtataaggacccaaaacaccatctaaatggcttcatccagccatggcagatgccctttgctgctgggttgggtttttttttttttttctttcttttttttttgagatggagtctcactctgtcactcaggctggagtgcagtggcacaatctcagctcactgcaacctccgcctcctgagtttcaagtgattctcctgcctcagcctcccaagtagctgggactacagacatgcaccaccacacctggctaatttttgtgtttttagtagaggtggggtttcgccatgttggccaggctggtctcgaactcctgacctcaggtgatccacctgccttggcctcccaaagttctgggatttcaggcatgagccactgtgcctggccctgctggttttacttctgcctgaaacccactggggtgaaaggacaggccttggaaatgttgcattagtagcaactgctccctctaatgggaggacacatcccttccccatagtcagtgcaggagtcacagaagcttgagcacgacctcaggaatcggcttccattcattcattcaacccatatttactgagccccagtgtgtgccgggtacttctggacccttgggatatgaggtgaacagctcacagatccctgccctcctggagtttacattcttatgagagaaacggtcaatgaatgagtagtcaaataagttttacttccagtaatatgtggtatggagaaaaagaaatgaaggagaacagagataaagtttggtgatggtggaaggtggcagacagggtagccaaggaaagccttgcaaacgaggtgacatttgagcagagacatgacatgaagttctgggagaaaagtttatcaggcaaggtatatggctggtagaaaactctgagtccaaggcaaagtgactatccacaatcagccagaggtcaccatggctgggaagcatggcaggaagtgggaccagggatgcatgcaaaggccaaaacaggagggagttcatgctgctcatatctgttctggaaggacactggagaaatgtgtgtgaagaggaacatgaactgacttatgctttaaagggaccattctgaccgtcatgtgcaatgaatggagttgaggggctagtcaggagtagggcagagagatcaggtgagaggctcctagaataatccaagtaaaagatggaggtgactggattggggtgttggcagtggaggtggtgaggaacggtcggtcagatcgtcatgtattttgaaggcggagttcattcaccattgttgctgtaccagttgtgggctaggaaagaaagcagtgtgggtcaagcatcactcattcattcattgacacatacttgttgaatacctatcatgaacctgcccttgttctgggtgatggctataccggtaaacagaatagtcaaagcttcctgcccttgtggaacttacactttattattttatttttatttattttgttgaaacgaggccttgctctgttgcccaggctggagtgcactaatgcaatcatagctcactgcagtctcaagctccttgggctcaagtgatcctctggccccagcctcccacgtagctggaactacaggtgatgccaccacacctggctagtttttgtagagacagggtctcactatgttgcccaggctgatcttgaactcctggcctcaaatgatcctcccaccttggccttccaaagtgctgggattacaggcgtgagctactgtgcccggcctggtttacattttagaaaaagaaacagaaaataaaggtaaaaaaacaataagtgaattataatacatgttcagaagatatttgttatggtaaaaagaaaaaaatagagcagaagagggaccctggggcaggggagcagctgcaattttaactagggcaaccaaggtgggtgttcttaaaaggtcgccaggttttgggccctaagtagttagatggaagctaatactactatttaatgagaggtctataaagattacacaaataggctgggtgcagtggctcacacctgtcaatcccagagctttgggaggccgaggcaggcggatcgcttgaggtcaggagttcaagaccagcctggccaacatagcgaaaccccgtgtctgctaaaaatacaaaaattagctaggtgtggtgacacacacctgtaatcacagttactcaggaggctaaggcaggaaaatcgcttgagcccagaagtcagaggttgcagtgagccgagatcgcaccactgcactccggcctgggcgacagagtgaaactccatctcaaaaaaaaaaaagaataaagaaataaaagtgggaagaggagcaggctggaggttagggtggggtaaacaagctgttgtcatacttgagtccttgagtattgaatttgagctgtctcttagtgacaataccaagtagatagttggatattcaaatctggggcttaggcagaggccagggctatgtatatacatttcaaagtatcagagtctagaaggtctttaaagccataagaccagatgaggtctacaaggatgagagtggagagagaaaaaagagggcccagggccaggggctactgagtcctcagagtagagagaagaaaagaggaattagcaaaggagatgcagaaggaatagccaggaaagtgggagaaaaatgaggcgcttgaacgaagagctgaagaggtagaaagcaagtcacagcgctcaaagcagcaggtgagatggtgagtgggttgggaaagtgactaggagaactttttataagcgacttcctgagcagcaagtgatcaagttaccctgttgttagctatttgacggtggtgtgtagagtcacagaaaggtggcctctccctgtgtgcccacggaaacaccagggctgagccctttgcgtttgccagtgttcatgtgttcacttaagaattaatattattctccaaggcaaggcagtgggtacagatcgcagaagagtcaataccacacacaagattttgaacttaaatttataggcaatggggatttagataaagtttttcagcaggagagtgacatatgtaacctgttccatgtaaatagtttggggagcagaagggaggatgagttggaggaaggagaggtgatagggaggccattttagtagtggagccatgaaatgggggagggggagactgaaccaaaggagatgcagcgagaattcgaaagcagagatgcgagagacacggagaaggtggacatacagcctctggtacgtgattgtgggagggtacaatgagaggaacattgaagaccactcttggggttctatcttgtgtgactgggggatggagcccactgtgggtttttgctgggagatggagaggagaggctgtcagattaaccagtttatggattaattattaagaaacagcagggacctgggatttcccctcctcactgattagttagctggtaattaggcagtggctgagaatgctactgtctgtcccccatcgggtgggaggagcagagctgagcctccccacagttgctgtggtgcatggagtggggacctagaatcactgctatcacgtgacatgccccctgttcctcctgggaacccaactctgaaggggtcttcttgacatccgattttctccttccagagctcttctgaagttcttgcctaatgaagaaaaagcaagaaaagggaaaatatgtgtaccacagaattttccttctctctggtggtgttttgcaaaaatgccatggcaactttcctcttcaaatacttgggatttgtttctcttgcatctgtcaagtgcacatcaaagttgaattttccactttggaattatgatttgtattctgcttctcccatctgggcttctgttctcctgaaaactgcctattctactgtgaaatgagcattccccaaggctgatgtagccgcttcatgctaagtgttgatgggaaacctgaagctgagttgggcaaatgtttttgagatctgtaaattccccagagacttaaattgcttgaattattgagggacattttgacctcttgttggaccaatgagaatgaaagaaaagattggttaaatagaagaaatgttcagaatccccctcagccctccaaattccaaatattttcttttttctttctttttgtttcttttgagacggagtcttgctctgttgcccaggctggagtgcagtggcacaatcttggctcacttctacctctgtctcctgggttcaagccattctcctgcctcagtctcctgagtagctgggattacaggtgcacgccaccatgcctggctgatttttgtatttttaatagagatggggttttactgtgttagccaggctagtctcaaactcctgacataaagtgatctgcctgccttggcctcccaaagtgctgggattacaggcatgagccactgcacccggccaaatgttttctagttaagttcatatacccatgccagagtgcctagctcacacttcattataaatgtctgcctcaaacagaagtcctgggtccatgtttccactgtcctgcgagggatacacaagaacacttggcaaacgaagaagggaaggcctggggctacagtgggtagggagtaccagagacccaggggacaatatatgggttaaatgaggactttatttaatagtatttttaaaaattaaaattgtgacaaaatttaggaatcagtaattatttaaaaatccaaatattctgcttctcttgaaaaatcagaagacatggcatctcggggcccaaatttctatttggcagttttcagctggaggtcagctggtgtccccctaaactcaaggcatgtggtccccagtgggtcacgcccaccagaatcctctgctgtcttgatagctctgaggtccttcagggatcactggggaatgatgttctcctagaagactttctggatcctccaggtccaggttagatgctaaccaatgctcttaaagtagctatagcaacttttattaatatagataatattttatatttttcatattatataatttttgttattatattttaattgcttcctgacttatctcagtcctcttcagtataatttagtctccataagaataagtacttgttgtgtttgttattaatctccaacatcttggctgggcgcagcggctcacacctgtaatcccagcattttgagaggctgaggtgggtggatcccttgagctcaggaatttaagaccagcctggtcaacatggcgaaaccccatctctacaaaaaataagctgggtgcgatgctgtgcacgtgtagtcccagctactcaggaggctgaagtgggaggctcacttgagcctcagaagtccaggcttcagtgagccaaaattatgccactgcactccagcctggcgacagagcaaaaccttgtctaaaaataaaaaattaacaaatctccaacatcttgcataaggcccaggccataagcagacattcaaataaattaatttactaaataaggacaatagactaaataatccctggggtccattttagttgtactattctattgctctgatgtttctctttaaagaaacagattcatgggttttctattagagtaagacactgtatttgtctctacacatacctgagtaagaatgctttgggttagatccctcttttttggttcgtaaaactagagaagagaacagatggaaaggaccttgaagttcagcttcctaatttgcaggtggagaaacaggctcagagaagatacgtggacttccttcgagtcatatagttgtaacccaggttaggacatgtgcctccagggcagagtccacctgccttggtctctagtctgaaggaacaaatgaccagtgtggtagataagaacaaagtatattcaaagcctataaaagaaaagagacagagagaggaaagtggtactagctgacaaatgtcaccttagtggcaaaaacagtaaataccgtagaggtttataggacagaaattacttcagaaacgtaacaaggtttaagcaatccagtgtttattagcaatggttctctgactggggtgtccaaatgcattctaaggggactttgagttccctttgaaaacagtgaatgtacaatttcagggattttcatcatttctgtgagggagtatgacactttcctggccattgaaggggagaagggaattgatttgtaaatgatgtgtatacacaaagtgaaggcccagtgatggaatggtgatggtttgcagtagtttggggctgtggcaattagtgacattttgtttttacattataaacagtgatgtaattggagtgaaatgccattatccactgcgtcattttaatgcagtcaattgttactggcttcgtatttagtttttacacttatgttggtgtcagaattatagaagagttgtaagcaaaagcactttgcatctagttgtgttagttttgtgtacattgatgcaacattgcaatgaaagtaatctaaaacaatgccaacagtccaagagattttatctttcttttagaaagagtctatgcattattcaagcttgttgtgaatgctgacttcctatagcacttgcatttaagttatgagaagttattggcatgagagataatttaagtggcatgagctcatctgctgtcactgcatgaattacttgggaggaacttggtgtgggagatgtgatatgctctcccctcagtaggtggctgttcccacaggcaattctagattctaagataattctgactattgttttattgactttagaaccagatcctttgtaagatgttatgatgtacagggtctaagtggtggaaggatgtgtctttcctttaatgtgatataagccagagttcagcaaactatggcccatggaccaaacacagcccacagtctgtttttgttaataaaattgtattggaatttaggcacactcatttatatacagatggtctgtggctgctttcacactataaatccttagtccaatcatttcgatagagatcctatggcttgcagagtccaaagtctttattatctgacagtgccctaggacccagggtctaaatataaccatttctgcactgtgctttcagcttctgtgtattttatttgtttctctaaagtgacctaattaatctgtcctattgggataattagggaattctagatggttgttgctttgtggaagattccgtgatttctctaataagggaatctagtctattctcaacatagattcctactttcttaaaataggatgctagaagctagcaagatgctgtttgattcaggagccccacctgccagagctagcctcaggctgcactgtgaatgagccacttgtgtttccacccgtccgccctgcttttcggaacccgcttccttcatcatgtctttgcgtcactgccttttcactccatcctgcctctcagtaacatcagtgaaggctctgatatctcacttttaccaccatttaagttcacttcatttgtccacttcttgcttcttccaagggtgtttgcacttgaagctttttgtccccactgtgtataggaagctttgccttccctgaaaggtttgaccaactcagaggagtggagggagaagggatgagggggcagcacaggacggggagtggtagggacagggctgtccctggaaacacacagtcctcctcagtgactgcacggctcattgcacctcattcctgggttgctgtacagatcagagtctacctcacctcaaaagccccacagtatttgttaaatgtctgggggattccagatacttaacaaataatctttcaatgtggtcgacttatttagggaacaaacacaaaaagactcacacaaaaggcatgggagtcaaatgctctttgggatacttgactggagagggctttctacttacacgtgcctagggaaatagtcaaaggatgaggggggttggtatgatttagggacagttcctagaaggagatacttactcctgaatgtgctctgcttaaaaaaaaaaaaaaaaaaaaaaaaaagaagaagaaaagaaaagaaattgtgttgggcgtaaccacagccttcttagccagcctgagttggcattgctcaccctctgaggattaggtcagccacagtgagctttctcaaggaagtggtgccttggggagcccgcgttggaaagcaatagcagatggctgccgtgggatgtatatggtcctgcttttttaatatgtggagaaaagagacctgcgctctctgtatgttcacatatatcaggatcattatatgttaattgcttattatggcaactgatgatttgcctcctgtttcttatgtgttctgtcagttaacatttattgggcacctactatatgtcgatagaatctgcacagtggcaggtaaagttttccctgtctttaaagagctcaagtctgataagaatgacaactcatgaataattgcaatctaggatggagaaacgggggaattctcccttagaattatatccccctcattgacttcacactaaattcgactttttaaattcagcagtgattatctaaagcctgagctgttcagattgttaaataacagtactctaagttaatctacaagaatcttaattaaagaagtgaatttgggtatgttcaaattataactcagctgaaaaacagtttctctactatgcattcccctcaccaatcccacttcccaaataaactgactgaggtgggataaaagggtccagactagaggatggcaaactccagccccaaggtcaagttacacctgccacctgtttctataaatagttctcctggaacacagaaatgcccactcatttacataatgtctatcatctgtggctgctttcaagctacaaggcagaggtgagcagctgggacagaggttgtgtgtggccagcaaagcctaaaatatttactttttgtatcacaggaaaaaaaaattgccaacccttggtctagagtaaactgaacacccataaaaagtaaaaacaacattattcaccacctctgactggcaaaatgacttaagaaccagcacactggtacattttaatagcagttaaatctagacacatttggatttaaattgaaatccaatatcctcctcttcatgatgaagtattaacatggttagctagctaagaaatatttgaccctcacgtacttaaaatatctcttgttttggtgtttgtgtacacaaattagggaatacaaattatgttcatgaagtaagtcatcttcaccaacggaaagaaatattctccaaatcgctgagaccatgcatcaaccctactgcacagttagaagaagggccacattaattacccgaggatacagaatctcttaggaagaggagtggccacagagaacaagagcatatatagtgcatttcagagaagtttctcctgccctccagattcccctgtggacctactctgagtccattctgcaagggggcatttctgcatttgagcagctcccgttcttacccattacacatccctgtgtatagggggcttcaggaagaacttacacaaccaatcgatggcctcagtttaatataacatttaaaaatatctcgctctcctgattctgtagccaaactcagaatcatcaaggccacttcctctcccaggagagtaagcaaacttactgcccagatgtcccccaaagtgtctttgccttcaactttgctgcaggctggaaaggctgtttctctacaaggactggagatgcaaacccttggaggggagggtcctggggagggcaggcacgtgttaaaaagggcagtagatgaaagcaaatgtggctgcaattgtccgcttctgcttgaacagcaagtctgtcccatgctataacagggattctgtaggatggatcctgttttttgttttgttttgttttgttttttgaggcggagtctcgctctgtcgcccaggctggagtgcagtggcgccatctctgctcactgcaagctccgcaggagaatggttcacgccattctcctgcctcagcctcctgaatagctgagactacaggcgcccgccaccacacccggctaattttttgtattttttagtggagacagggtttcaccgtgttagccaggatggtctcgatctcctgacctcatgatctgcccgcctcggcctcccaaagtgctgggattataggcgtgagccactgcaccctgccctgatcctgttttttagagaaagtagattgttaatccgtcactttatgtattgtctctaagatagcatctatcatgtatataggcacaaatgcatactggagtgaattcataaattaatagatgaattaagacctcagactctggagacaagcaaaattgagtttaaatcccatctttgccagttaatagctgttagttatctatcgctgtataacaaattgtcccaaatttagtggcttaagttattatctcacagcactgtgggtaaaggatctgggtttggctttgctgggtaccaaggctgcagtcatctcaaagcttggccaggtggggaaggacctgctttcaagctcacacatgtggttgttggctggcctcaaatccgtcatggctgttggctgacctcaaatccatcatggctgttggctagagacatcagttccttgccacctgggcctctccaaagggctgctcacaacatggtggctggcttcccccagagaggggaatctgagagaaagatccaagatggaagctacagtgtttttgttttcactgggaatgtgggcaaggcattgaaaaagatttttgtgtgagtgataaaatatacacaacattatttgctattgtaacctttctttctttctttttttttttttttttttttgagacagagtcatgctgtgtcacccaggctggagtgcagtgatacttccttggctcactgcaacctccacctctcgagttcaagagattcttctgcctcagcctcccaagtagctgggactataagtgtgcaccaccacacctggctaattttttgtatttttagtagacggggttttgccatgttggccaggctggtctcaaactcctgacctccagtgatctgcccacctcggcctcccaaagtgctggggttacaggcatgagccaccacacctggcctattgtaaccacttttaggtgtgcaattaggtggcattaagtatattcactgtgttttacaaccatcaccactatttatttctaaaacttttcatcaccccaaacagaaacttgaagctacagtgtttttgcaacctaatctcagaagcaacataccaccattctgttatattctgtttcttggaagcaagtcaccaaacatagcccacaattccagggggagggtatcttgaaggacaagaagaccaggaggaagacatcctagaaggcagtcccagaagctgcctgccatacaggctatgtgaccttaggcaggtagtaacctgcctcagtttcaacctttgtaaaacaaggatgatatcttagtctgttcaggctgctataacaaaataccataaactgggtggcttatggacaacaggattttatgtctcacagttctagaggctggaaagtccaaaggcaaggcagagtctgtctggtgagggcctgcatcctcacaggtggcaccttcttgctgtgtcttcacatgatgaaaggggcaaggggtctctctcaggcttctttttaagggcacttatttcattcatgagggctctgttcccatgagctaatcacctcccaaaagccctacctcctaatgccatggcctaggggttaggatttcaacatatgaatttcggagggacagaaacattcagacctagcagatgattttgcctgcctcatagtgctgtacttatatccagggggagcacccccaagtttctactctttaatataagattaaatagatggccccaagccatgatgtttggccaccatggactccaggcagggttttcctgcacggcttctcagatcttcatggtgcttcagcagagatcacatctttagatctctgacagcatgagcagatagagggcagagcagaggcagaactgtggcaatacaaaatatgattcctacatcttcttcccagtacaatctttatggggagcagagcttcctgtaaggaaggagaagcctcccctggacagtgttgagctcccatgtcctcatcatatctcctctgggagtggatccacccctccctcagttgctcacattcaccaccaagatactatccttgtacccattatggtttattctctttcttccatgcacattcccagtatcactttaatgtgtccgccctctttcctggtgagctgtcctgtgcagtgaataagaaacagttacttcccctggagggcttgcatatgactatgcaacgtgcaagcaggctgcttttaaaactattatttaaaatttttcaaaatggtagtatctctttccatccttgtcccctctcacaggtcaaacctaaacaattcagggtctcattccaaacaccagctcatggatgtgttctgagccatcatatattccagccatatctttatacttctgtggtcctgtggaatagtaccaatccagatccttaattagctgaaaattaattcagatgattgcatatttaagccaaagaaataaattaatattgtgtgcaaaggtttctggtgatgagtattttggaaggactgttaaacacatttgaaataaaaatagtttactggctaaggctcagaaaaaaacaaaaattattactgatcagtgttttctaaagtgtgttctgcagaccgaaatgctgtttatttgcccactgaccaaaattacattgataatctgtactaatctcatcagggttgatgagaatatggtaaaacagtcatggactgttttctgctgggagtataaattggacatgcctctaggcaagcaattttgtactatttatcagaatttaaaatgtatatgccctttggcccagcaactctacttctagaagttaatcttaaatcattcttgcacatatatacaaggggctttattgcagtactgttcatagtaagaaaacgttggaaacaacttaaatgtatgtctataatagaccaggtaaatcaattataatatgcctctactcttgaatattgtacaacagtcaaaataatgagcaggcttggtacaggggcttatgcctgtaatcccagaacttcgggaggccaagatgggaggatcttttgaggccaggagttcaagaccagcctggtcaacacagtgagacccccatctctaaaaaaataaacagcccacctgtatgtattcacatggaaagatggacatagtattttgttacctggaagaagcaagtcgtagagcaatattttaatataattacttctataggaaaagatatatacatatggtattatatatataatttctgtgtgtatgcacaatattgtgtgtgtgtgtcacacacacacagcatgttttcatgctgctaatacctgagactgggcaatttacaaaagaaagaggtttaattgaacttacagttccacatcgctggggaggcctcacagtcatggcgggaggaaaggaggagcaagtcacttcttacatggatggcagcaggcagaaaaagagagtttgtccagggaaacacccatttttaaaaccattagatctcatgagactcattcgctatcatgagaacaatgcaggaaagacccatcccataattcaatcatctcccactgggttcctcccatgacacttgggaattgtaggagttacaattcaagatgagatttgagtggggacacagccaaaccatgtcatatatgtatatatataaaatacatgtacaaccacatagatttgtttggaaggatacacaccaaactgttaatagtggttattcttcctcttgagaaagaaatagaattttctagagggtaggagggttgcttcctgctttgctgtgtatccttgcatattgtttgaattttttataattagtatacattgcttctgtaatttatgaaacaatttaaacatctcttaaactcatagacataacatatttatttttaagcaaattaagaaaaagaaccatgtaatctctctgcccaaatgtaattactattaatcttccatacctttttctatagatgtattgtttgtttttaaaaaatgtaatttttccatttagaccattttgtaatctgctgcttttatttcacaatatgggataaatgtgattattccctgcatatttatgtgccagtagatattcagttatatttctaatgacttcaatgttatggtttttaggtatatgagattactggaaactaggcatttgaaatgggcaaggtaaattcctagtgcaatatcctgttacctggcttcttgctttcatcttgttcatccgtacatctagattgtccaccctttatgcctaatctctgtcattgtcttgaataaaattttccatggctgcccattgccctcaagataaatttctagtttccttagatagattgcaaggcccctcactttccagttcatgtttcctctggcacatctttggccaacacctttatcttcaactcccatcaacagctcacctcacccaggcttattctcactctgccttccggtttcagctccaatgactccatttctgattcagttacttctctgtttctcagagcatcttccacttcttccatctcttgtttttgccacccaataggcactctcccttttcctgacaaaacagttcattgtgtgtgagagacttcgggcaaggttattaagctgtccacgcttcaggcttatcatgattcatcatctattaataggacaataatagtaccgacctcctgagattgttaattggaggaagtgaatgaatatctctcagtggattagaagtgcctggggcataataagggctctatgtgtttgaggctgcagttgctgtaattggaatcatctctcttttactcagtccacctagtttggttgaagttggttctaccctctgctctaggggttgctaaggtaatcagtaaatctcatccttctagatcctgtgatgggttcagaagagaacacaaaacccgatttgagccagtgagagtcactatgaagactttactttctgaaggagagaaactctctatctctaggcatgtgcataatgcatgctaggcttactgctattggagctgagacattgcagatggaagcccatcagagcatggaaccaacacagagggaaacacagctgagcaaagagagagaagtcctgtcctggtgatactgggatgagcctttcatgaagcgatgcctgaccagctcttcctccaattcctcagtcgtttgagccaaaatacttccttgttgcttaaaccactaagggttaggttttctgtcacttacaacccagagtttcaagagatatataccatgtcttaccaacatcataccttagtataatggtctttctattgatctctctgctgcatgagaccttaaggtctgtgaggacaggcctgggtcctatttccctttgtatctccagcttccaacatagtgcttgactatattagatgcaagtatttgttgaatgaaaaaatgtctcagaggctaccttgactatttcagcataacttgttcaatgctactggtttatccaggtctaaaagtctgctaatcgtatcagcaaggcataataggatgggaaaagaattaatattattgaatgcctgtcagtaactaggtaatgtatatgatactttacatcatgtcttttaatcagaaagcataattgctttctcccttcctgctatcccatgataggtctattactatacttccaagtcagtaaaataagaataatgaaataagaatatcaatgaaataagaatatcaatgaaataagaacaaaagtcagatgtggtggcacacacctgtaatcccagaactttgggaggctaaggcaggtggattgcttgagctcaggagttcaagatcagcctggacaaaggtgaaaacccatttctacaaaaattagctgggtatggtggcacacgactgtggtcccagatacttgggaggctgaggtgggaggattgcttgagcctagaaggttaaggctgcagtgagctatgattgtgccactgcactccagcctaggtgacagagtgagaccctatctcaaaatatataatatatgcgtacgtttagtatctaacaagaaaaatgaaaggcagataaaaagtatacatattctattctttaaaaggcaataatcatttgaatcttttgagttcaaaatgctgtgttttataaatttataaatgtgtctataaatttttctttctatttcttctacttcttcttagcattgaagtgagcaattttattaaaatctgccattttggtagtaaaacatttaaattcaaagtcaccttaagtgagtgatgtgcttgttgccagccacttaattagctgggggatgtgacacagttgtctacatgcaggacaatttcaaggtcactggtggaaaccctctcacctccccatgctgccagcttattgtcccatacatggtaacattcagatttgggactagatggccaggagaaaagcactgagtagcctcactccagaaggattttttgtgcttggctccctgacttctcctttcgttcagggagcatgcagtggtgagaacacctaaatcatgatccttgtcctccatctataactaattcgtattgttttaggttagtttctcagagcataagaatgaagactgtagtatggcccggctctttcttaagaaagcactcttgatgaaacaatctacataagtagactgaccagttaaatatggttattaatcattcagttttatctgcgtaatggtcttatcaaaactaattattgccatattaggtagatatttagagagcacccttttatggaccaaactctttgcagaatacagatactcaggaagaggatctcttgtcttgaaggagctgaaaattgagttgagttatcccagaatcgcttttttcctttagagttggaattttgacagatggagaaaattatctaataaagtgttcaaaaacttggttggcccgtgtgggttgaggattaatccgttagagccacaggcagattgagcacactattcttagctcagaagaagcaagttattcagagaaggatgagagatggcacattccctctagttcctttttgctgctagagaggtgagcttccaggggctcctagttcaggttgcttgtatttttttcacctacatttggtctccacaagccttcctttcatcgtcagatttgtccaaaatttaacacctgtgtgtgtctaatcaaggaaggacatgatatcacattatgagtgtatttaggtgagaagtcattgaggaaaataatgtttgtcatttgaaagaaagaagagtgttttatttttgagtcacttcaggtctttgtcctgaagaacagattcactcttgtttaaactctgtctcagtgagaatgtttgcggggatgggaggtagcacttcccattgcatctaatcatctagaaaacaagagactacaccttaacagtgcaaatccttttggaattgatctacctggtcttctgctttttcctttctccactctgctttgtcctgaattcccagaaatgccatcttaaaactcttctaaaactgctggctactctttcccctgtttttttctaccagtttttttgtttttgtttttgtttttttttaaaccatcatataaagagacagcttccaaatggtactctgtaattgagcaataaacaacaaacttttgtctgtatgtatccatactaccagtcaaaatacttaataacaaaatatcaataaaaaatggccaatgtgacatttttcatcttgtgtcaaaatcagaaccctttgttttaccatttgcttttaaatctggggggtacataaattcctgagaaaatactaagcatatacatcaaagaaattcagacaaatatatgtgaacagagcaggtcactgacactaatcttggccataacctagagttattcagaaaagatgtccagagacaaatcttggaggttttgaagaatcagaaagataagaggaaaatctggatacagaggtatcacagaagccaaggaaagtgttttaaaaaggaagacgaggtcaacagtgtcaggtgcagctaaaatattaagtataaagaggactgaaaaatatgtcttgaatttagagacttgaaggttattagtgaccttaacaagcattgtttttggggagttatgcagctagaagtcaaactggtaggttgaggaaggagtggaagctaaggcagttgagctgtgggtacggacacttccttcagattagctgtaaagacagtagtaatagaacagtggctgtaggaggataggggactgaggactaggaaataatttattttagatgggagatatttgaataggttcaaagcttattggaaggattcagctgaagacagaagtccggtaacaagagagaaaatataatagaatagataatgttaagttcccaagatccacaatgacccccaaacgtaagaatcatcttagaatagacttgggatacgaagttcaactgcaaaataccctatttttagacagcctccgaatttaggaaaccatgtccagcccagaggaaaaaagaagagggctgagttactattttctccatgtttgattctaaggaatgtagcattatttggatattacataaaaccttggaaaataagggaaggggcaggccgtgaagatatgtgcaattaaaattagaaactagacatggccagtaaattgattacaagttaatctagctttgccataacctgagagaggtgatgtagtcaggaagttaggttttatctcaggttggctttctaaatattgaaagctgtcaccaaagaaactagcatagaaccagtacgttacctgggggagagcacctagagccacagatgttggtgtgcctgagaaagtccagaattttaaaaataaaattagaatagctgtgaccggcagtaccctccagactcctcaattgcacacagctccctttgtgtccattttgaggactcagcaccaagacttctaagacatgaagcactgggcaatgctttggggacatgacaatgctaattatgctaaatactcatgatatgttgtctaatattgatattgataacctaagcaaagacttactttagctaagctgaccttgctgaattgcctgtgttagctgccaacaatgtcaacagagaggagagtaatggtcaaactggaggcagatagtgttatgatttatgaggggccatgaaggcagtgtttttgtccatgggagctgtgattagatgctgtgggtagctgaatacagttgagatttttcaaaaattggcaggcatgttactttggaagttctccagtgacacatcagagatttaattattacagttttgtattcttgctttctgtgacatctctcccctttgtgcttaatcaatgtttgtttcccagtatgtgtttgtcactattattaattttggaagatacaaggaaatccccaaatcagtaaatgccctctaggagtgattctctagtcttgtagttggacacaaacccacaacataacctcctttgtaggctcatgcaagaggaaaggaattcagcatagtgatggagtaggcccagttccaaggatgccactgggtatcctgtacatccagagaggaacagggcaacttcctgactcttttacgtcactttctgaaaggaaagggaacgtttcaaagtaggaccatgcacagatacctgaccacctatccctttttaaagtcccacctgtcaagtctctacaccagttgtattgcattacctgggtaaaggagtcaagtgggaaggggtggagggtagtcccaagctaatgagaccagcattcccctgggttattttatagtttatcttattaatcctagaagcttgactatgaggcctgtgttaggaggtttctccttggggaaagataatcttaccaacatctttgggctgttttcctaattcttaacactactcctgtatatttcaaactgggagctatgaaatagacaggtttgcctctcgagactttctatgaaagcttttttgatgttactcctgggagcttctcagtgggccaggaaagaggccccaaagccacactgtatactaggctaagtcaccacatgacgtatgtaagattcacagaggatcctcttgttcacctatgacgaggccagacacaggccctccaaactccctttctctgtctcataaatgattagctgaacgtttacccccctgtgatcaatctggacaaaatacttactaatttgatttgaccgctgtagtgaagcttgtctcctcctccacagcctgtaaactttgactcattcctgaagctaagcaagtgttggaactgggaacaacccctccttaatggcccttcctgagactctccattggctgcaaacaaatctttcttgttcagctgtcacatcatcccacgtgtgcatcccccatgcctagctccttctagccatgtttattcctcttcattaaaagagaagccctttcagcctgaccatctggatgtttatagatcttatggtcagagtcttttccctattgcaaaaatgatcctgtccatttggcgtattctttaaaagtaaagtctgtccttacctaagtctaggtttgtttttatttgacactactctctatattttggtatttaatactgtgtacattgaacacgatcttttcttgatgacctagcttcatctttaagactattatcacattgtgctgaagaggtagttgtcagtgaggccaattctgggtgggatattggctgacctggcactaatgctggagccaacttatttctgggatagagcagctacttttgttttatgcattttgagttacattaaactcatttggatagagtataatggtgacctttcacttggccagaagaaaaaaaactacactgtttattttcttatttttttttttttttttcactggggtctcactctgtcacccaggctggagagcagtgggtgcaacctcggctcactgcagcctctgcttcctgggctcaagcgatcctcccacctcagcctcttgagtagctgggaccaaaggcacgtgccaccatgcccagctgattttttgcatttttgatggagatggagtttcaccatactgacactgttttaaaaataatcctagaattcgtaactttctagcgtgtgtatgtataaattacaatctgttatgtttagaaattaacaagaatcaaataatgaagctaattttccaaaacgtgattgagctacaatgcaggcgtctgaccatcttatttttagcccccaaggcatgcaaatgttagaagaaaaagaatctttaaaattgcaattgatagtaaaattgcttaattatatgtataatatgtggaagaatatgtatatacagccatttatcaaaaaagaggtcaggaaagttgggtgcagtgtcacacacctgtggtcttagctacttgggaggctgaggtaggagaattgcttgagcccaggagtttgagtccagcctgagcaacatagtgagacactgtctcttaaaaaaacatggggagtagggtaaggaaagaaccaggtaaggatggaagaaaaccatccagccatgaggacttacagagcaatatgatagagaaattattctcatttcttaatataaataagaaaaatgagatttgaagatttgcaatttgcataaatttacctgacttgtaagtgccagaaccagagttagaactctgttattctattttctggtctatgactgtcatcaggacactgtgaagcctttcctttagtgagttccaggtaacacagaccagaaaacagtcctaattgtattcgttgttgttcatgtcactgtcagactctacaacttgttgcttccattactgatttcaataccaggggctgctatccactcttctcttcctccttttctaggaagccttactgttcaaatgtgtaaaaactcattcttgacttccagccaatcagccagagacatgaccttcatgcagaccatcatctctttgaggctgtgtctatttctgagtgcttggaggctgctgctttgctgacggggtagagatagaaagaaagggactgtttctctgtttctccctgttagaaatgcttgttgcccagtgccataaagaaatagcacttgaacataaatttaatttcctcagcaaggccattttttttactttctgcagaaagggtacactcaccagcagttttgccatgaaagtacaccaaacaaaagaggcagggtcatttataacctgatgcgtccaccctactgctgtgtcccgtttccattggctggaacgggacctcacattctgtatttgtcctgattggctagcaacttagaactttttaaaagaggcaaaggcagaggagaacaaaggaaggaggaagtaacttgtggaatgccgagaaaggtaaaaacaccttcaaataaggaagaggaacaggctaagacctaatgcttgcttggaccagtgtaagcatgccagggcaaatatttaggctaaattgtgggagctaagaacataaagtacattgatttctttattatggctagcagatatttaagaatgttagcacaggtctttgaataatttttgcttctaagagaagttactatttattcctaattagatggggaggaaagtctttgaagaggaacccctactttattttctatactccctcaccttcctaggtcgtctgaaggtttcctgaggttctggaaaacggaaagtatcctaaatacttaaatagtattatatgctaccaattaattgtccactctatcatctaaagatctcacgacaaacagtatatggaagtatatgtttcaccttattctgtaggtccaaattctcttttgagaattatgtggacttcagagctagtttgtttcatggaggtagctagtttgtttcattgacatgctgcatgcctcacttggtaaggctcaggcctcgtccagagcagggtatagcctttggtctagccaaccttgctggatgttgtaaagtattttagctattggattatgctttctataaatgtaaagatgtcacgggacctcaggtgtattcatgcaggctttgccatttatcctagctccaattagttaccgcaggtacagcaaaacaaatgtaaggcaccgcaccaacacgaggaattatcagtcttgttactaagaggacagaggaatccctaccatgtagggtaaatttctttctaggccctttaaatgtgaaatgtaataaggcaatttaaagatcatttcactaacatgtaaaggaaaatacaaacatgtgcacatctaattgcaggtcttacaattttggttctaaggaaaataattaacataagctcaaaatgacacttcctgcctgggaacagttctggcgaaataatgaacctgtagaaataaaattgaagagctaatcagccttgaacggcgctgaggtgtgtgtttctctctctctggttgctgttcatctcttgcttgtctctctgctttcccctatgcctttgatgagacacataatttttatgttgggcgacaaggtgacagttctctctgataattacatagatgagaatatatttggttttggaggaaaaaaatttactttacaaatgtatatatagaaataactttgaccttttggtaaagataaccaagttcttcctcagcaacagaaaaacaggcacattcggaggtgtgtgtttcattttatagtggtagctcctcctaataaaaacctttgtaaggaaaaggacaaagttgttggttcagggggctagcggtagaccccttctcctaacagctcaaagataaggtaaatcaaagtgccccccaagagttaaatgagagaaaacccacatgcagtggatagcattagccgtctgtggtgggaaaggaacagattgtcaatgaatgcatggttaaagagtttgagaacacccaaaactttaatcaaggtgatatgggagcaatctcatgaaagtagaatgggaggatggttgcatttagccattacaacctcatcagttgcattcccacaggaagactgcctggatattaagatgatgtcatcacagagctgggattctcacagtgtggtaagaagacctctagcatgagaatctcctgtaaaaatgcacatcctagggctttactgcatagacaccaaaaatatttggagtgggctcaaagaatctgcattttgtttatattcaactgaattttcttttttatagtttttttctaatttaaaaaaaagtaacacaatatgggctcattgtaaccaggaatgcaaatatgaggaaaggaaaagtaaatcttggttgatccttctttttctcttaccctgaggtagcaatactagtagcagttgttactagcaacaatactggtgagcatgagcatccttccatgccatttttcacacttacaaacatatatacatttttaagaggttttattttttgcttctcttgtttgtttttatatactaggtcatattataaaatttggagatttacttttctcaagtcataatgccaaacactccaggtattttaaaaatgtatgtacatctatatatgtattcacacacatttacacatatacatacaaacacccacatacatatgtgtgtcaggttgcttgaaaatgcagcttaaaacccatttagggctaaatactggcacagtagtccagtatcataaggaaaagttgaaaaaaactttgaagaatgacattcttttaaattctatagttttctatggaatggattattaagatattcaagcgtgtcccataggtgaacattcaggttgttttctattgttgctgcatgtgttttatttcattgccattacaaatgcctttattttggggatgatagatgagcagaaatgggatttccgagtcaaaggctatgttcattttaaattctattagtattataatatgactttcctaaaagcttgaggtaaattacagttgattatcatgattccacttagttatgtcctataaaatcaccttgagcactgaagtagcagacactgactcactgtgttaatgtattaatatgttgtatcaatatattaatattgaattaatatgttgtatcagtatattaatattgaattaatatgctgtatcagtatattaatattaaattaatatgttgtatcagtatattagttattaactctggaggaaatacagggttaggtttctgcaagctccttgtcacacatttttcaacccatcaatacataaccttgttttacatgtgtttctgtttaaatacatcttatttatttatttatttatttgagatggagtctctctctgtcaccaggctgtagtgcagtggcacgatcttagctcactgcaacctctacctcctggattcaagtgattctcctgtctcagcctcccaagtagctgggactacaggtgcacaccaccatgcccagctaatttttgtatttttagtagagatggggtttcacgatgttgtgcaggatgatcttgatctcttgacctcatgatccacccaccttggccttccaaagtgctgggattacaagcgtgagccactactcccagtcagcttatttattacatattattgataacctagcattgaactcatggccagcaatatgtcccatgcctgaacaatgcttatctaacacatggactttctctatcaggcactttacagactaaagtgcctttactaaagtctgtaaagtgcattatggagaaagtccatgtgttagataaggattcagccctgtgcagaaaatgtggcattaaattgaccaccaaaaggatactaatttacattatgagggtgaaacaagaaaggagaatgtcatcttgttctgcctggactgggaacatgcatgctgggtgaccacactgcacgtgaccatgaatgaccacaaatgatctccaaagtgccacaagtattggctttggggttacaaatacatttgagagtgtaggcaaatttgtgaatacagaatccacaaataataaggattgactgtatattcccaccagcaaagtgtttgtcatgttgattattcttcgtcttcactgtttcattttttaaaatatttgtgaaattttaggggaaaactatttcctcgttgccaactaactagtgaagttcagcctattttcttaatttattacacatttaaatgcaatctttgataacttacctgttattatattttgccctttttccaaccaagtgacttaatttttttctcatcaattcttagaaactgtatattagggatatcaatactttgttatatgttatgtaaatacttttttattctattgcttgtcttatttttgttttgggtatctttgctatatgttttaatactcaaatatatcaaccttcctcttgtgatttaaggtctcctgtcttattgtatctccaagactacatagaatttcacatttttattccaatatttttattgttacatattttgcattaaaatcttgactccatccagaatgtttttgtttctagtgttaggcaggggtctatgttcattttttttcttccagacgaacattcctcagttgttccaaataggaagagaggaaatcaacctctccatgtttgcagatagtacgattctctgcctggaaaaccccattgtctctgcccaaaagctccctgatctgatacacaacttcagcaaagtttcaggacacaaaatcagtgaacaaaaatcagtagcattcctatataacaacattcaagctaagagcaaaatcaagaatgcaatcccattcataatcgctacaaaaagaataaaatatctaggaatacagctaaccaaggaggtgaaagacctttacaatgagaattacagaacactgctaaaagaaatcagagatgacagcaaattgaaaaacattccacatgaattttttttttcccatctgaattgttcctggatctacattatccatgcctggtttccaggccctctcagagattctgtaaactacttatatcctttattgatccttttctacttagcctggataaagtagattatgattttgcaactaagagtagtaattggtgctggaaatatttgtacctaatggactgtcaagtaaatgggaacctggggttagctatttaacatagttgagtttgaaggcatgtggagcaaaacatttccgtaaatattggctttggttaattggagtgaagtgcctactgaaggcagcattttgggaaactcaagtggctgcttccgtatagtattttaagaaacgtggctgtactggctacatggaattgtgctaaaaatcttaaggaaagaaaaataaaacaggctcaaggttttaaattattgcctcaatgtagtctcagaaaacaagagaagttttgactggcctaaaagaatatcgtcttttatagcaacaaggttgatgaacttgaacatcaaacatatgctctgattctgtgacttattgaattacaggctgcattgaaagattggctgtgtttcttaagtgaaatttaggacattgggaagaaaagaatgggaccctgagaattagagtagagacatttgggaggattcagatgactcacactcccaacctccctaaatcctccttatcagcagcagcagcccttatcctctgaaggacacaaacctgtctgaagaccttagaaagaccttgcctagcttctaagaggatgccagttcctcatcactcactcctatcttattacctctacttatctatttgaagtcagatcccagtgtgtcccagagatttaatcataaagtcacaccttgggagaaatatatttcttctactactgccactgctattgcaattttttacataccaaaaaatcacaagattttgcaatttatgtctacaaaatttgcataaagttatccattgctcatcctaattttcttcctaactaaaagggacatctgtttttgcaatggctctagtagaatactacatttcccaagcttcctaatatctaggggtggccgtgggacctagtcaatgagacataagtttaattgtactgattattcctaaaaaaaagttttggtatcctaagaactgctcttccttcttctgcattcttccttactgcgtgggcttggtcacaatttctggaactatagaggtcatcttgcactcatcagggaaaggccagaagaattgctaggacttccaatctgacatttttaaacccctgaacaagtgacgacaatcacttttactttttttttctgtaattaatggaagggaaacaaacctaattgatacattcagccaaacacaatcatcagcagtgatgatgcaaaaatgtagcaaagacatagaaagcacctattttccccttgaaaaagtgaaaattcttgagtttcactgattttgctaatttagatcccataccaacactttattcaattagtttggccagagagtcgctgtgtgctagttggcttaggccagtagggccctccctgggagctggggtcaatcccattaaccccacttgtttgcagctccatgggaagaagtgctaagaagaaaaaaggagatgtttggatgtgaaataggtgagtaacatgtccacttcatccctattgtgaatatgtcattaaaatttactactcttattccactttcatggtcactgaacaatctgctggttggatttgacttctcatgtaatttataagagggatatgaactaatcaactaatactagcattgtgatctgattgctggtttagttaatacatttacatagacgattttatgaatcagcatctctgtctgagcttagttaatgtaagtactccacccccacctccaagagatctgctctgcctgtgatgacaagccaggtcttgagtctgtaaggatgttcagggccagatcccagaacagggaattctccaggtaaatggcatcctgcccactcactgcctggggaactgcctttgctgtactttttagcttctccttgaacccttgaaactgttgtagatgtcatgagtgttatttttcttcatgtaagatttcagcagtagcatgtgccctgtctccaggagtaccaaagataccatgcagggtgggacagagccagttcccatcttcctggagtcaacatgattctagaaccttcaccactatagattgtcatcacttcgattccatttaagagtgctgtggcagatgtaactagaatgataccaattgcagaaatgcagggtgagcttgcaaaacaaaaagtcattgattctgtaacccataggctaccaagtgtcatgcaaaacatctggggtatagttaacttgccaatatttattgagtacaataagatgtacatctgactaatagagatgttattagtaatactcaataggataaagagagttctggatgggaagatagaagctacactgctaagtgctaattttctttactatggatgcctccatgagcaaatcacttcaattgaacggccttcaagtttttcacctccaaaactgaatactgtactcacaatagttaaatatttcctgagcagttttatttatctcattaatttactttaaaaggcctttcttcgtatcacaaactccaactggattgtggtttctgagcaaattataacaaattttgtgtttgtggaatccaaattaatgagatttaactgcatgctaattaaaacgccttagaattctgcaaagactttcccttcaagagttcaaatttgttgatgaaattttctcgttagacttcacaatgagtgtggaaaacaaatgatcagtctgtaagccctaaaaaaagaaaaactttaagatattcttcccaggttttaataacacaacctggcagcaatggaacaacctcacaaacctggccttaaggttatcttgcaggttaactccctctcttaaagagattcttgtaatgatttaaaaccaaatggcgacgtagcattgaggttcaattagcggattccttagttgggtcttgatcacatctctgattgtcacctctaatagggcgtattaaaatttccattcattatagtcattagtctctgccagtgataaggttgtgaacaaatctgttggtgttcaacttctaatttgtgtgataatttgtttatgcttagaacacttactggttgtggatggagggggtgtgacccatttagaaactattcatgtagataaatctggaaagtttgcctggaatggctaaggcatggtgatgccacctagtctagtaatagacaagggccacttagaaggtcagatgagtcttattccagagtcaggaagagaagtggtttacccagagatgcaatggggttgcttcaaatgatccagaagggggtttttgcatggaaagaaaggttccattcggtcattgttactctacaaatggggagaaaagcacctgcatcagaatcatctgagaagcttattataaaggtaagctcttgggctacactccagacctctggggctagggccctggaatctgtgtggttagtaagcaccccagattacgcctaggcgtgctgaaattgagaaccactgcaggagacacctgagagcagagacacagaaacaaattaggtatagcaaagacatcaaaacattttgtagtaaagtattgagaaaccattcaacttgcatttatcattgggatttttgccgtcaacagctgaaatacaatatttaagaggaagaaaatttcaaatttgcaacaagccataagaaatggggcttggcaaagtgtcttactcctgtaatcccaacacgttgggaggccaaggtgggcagattgcttgagctcaggagttcaaaaccagcctgggcaacatggtgaaaccccatctctacaaaaaagtgcaaaaattagccaggtgtggtggcatgcacccagtctcagctactcaagaggttgaggtgggaggatggcttgagccctggagggagaggttctcgtgggcaagatggtgctgttgcactccagcctgggtgacacagccagaccctatctcaaaaaaaagaagaagaagaaaaagaaatggtttgggtgtgggtttttttttttatatactttagaggctttcaggttttttcttgctctgtgtggtcttattgagttatttgtgtttgagtttggtacataaaataattttagtacttcttattatatatacaagaatcatggatatgctcaactttatgtctcctatgcctgaaaagttgtgcaccaataactcataagtttttttaggacactgtacactttgtgaatctgatgaaaggcgtggaacttgattcccacaaatgtgtgtgcatcagtatataaagcattacatttaatctctggggacttagagatcagtgctctctctggactctacatcaagagcctctgacctgagcctaaaccacccagcctgctgcttcacaaagtcaagtagctccacctatgactcagccatagcaagcagggaaaggccatggtttgtgtgggaaaaatggatgaaagcaaaactgaggaattcagcagtcctcgaggcctcgactcacacctttaaatctgttggaattgccacaaaaatatttgttttcctacaagaatattagagatttacccatcttgagtggcaagcctagatgccccattcactcatcaaggcctgatgccatatttagcaaaagagccataactgaaggtgcgtttgatgaatttaataggattatgtcttactaatgacattaggctcctgggtcgggcttagcctttatatttacgttttatcactgcaaatgaagatgatattctctggcatatgagttttgcaacctcagggttagtcttgtgatatgtgaagtggcccttggcttgttttgggcccattataaattagatttttaaaaaaacattcactgtgtttattttttattttatttttgagacagggcctcatgctgtcacccaggcaagagtgcagtgatgcaatcacagccctctgcagactcaacttccctgggctcaggtgatcctcctacctcagcctcctgggtaactggggctacaggcatgcatcaccatgcctggctaatttttttggtattaattttgtagaaatgggttttcatcatgttgcccaggctggtcttgaactcctgggctcaagtgatctgcctgcctcagactcctaaagtgtcaggattacaggcatgagccaccacgcccagccaaaaaccattcgctttaggaaaaagaaaaatcaaacttcctataataccaccaccaaagatacctaacgttaataatatagcatgtattcctctagcaaaaattctatgctttttgcaaaaatagggtcatactatatttagtgtaatcaaatctggcttcttcacttatatcttaaatatctatttcaataagttccatctatcatgttcactggctgctaatattctccaatatttatgtatactttaagggtcaactaatagatgcttcagctcattccataaatgagatttttctaacatctttctatgcttatagccattaacatttgggatttttgctgctgttatggttaattttggagtctctgaagaaacaggtgctttgtagcatccagttttcttgcttaaaaggaaattcctcagagtttaagggtgtttagatgtaattttcacttttcactttgttctggaaaactaagaataaataaaaatccaaatctatagcccatgtccacccactcctttgaaagtaatcaacctcagtctctgaaatttcaaaggaaaaaactgaaaataccactgaaatcatttttaattagacatttagcagttcctaaagcaagttataatttggccttcaaaagcagtatttttaaagaagggagcattttaattggtatgttctggcttagcatattttctcagacattaaaattttaaaatctagatgtcatatcaaagtatatgagatgaaaaatatgatttcttctatctaactagctaaactgtggcacataactggacgtgtctatatggatggatctctgggagaaaagaaaaacttttctattagctatggcttgatatatctgggggcccagagctgccaattttatatcatgcatatgctgtgtagtatctcctactcaaagtgtggtccacggaccagtggcatcaatatcaactgggaacttgtcagataaatagaaccatgaatcccagcccacatatcctgaatcggaatcttcattttaacaagatccccgggtgattcttatacactttattgattgattgcttgattgattgagacagagtcatgctgtgtagcccaggctggagtgcagtggcgcaatcttggctcactgcaacctccacctcctgggttcaagcgattctcctgcctcagcctccaggcgcattccaccatgcctggctaattttttgtatttttagtagagatggctttttgccatgttatccaggctggtcttgaactcctggtgtcaagtaatccgcccaccttgacctcccaaagtggaggcattacaggcgtgagccactgtacccatgcatgctgttgaggacaccaaacaaatcaaaccaaccagatatatacacaacattcatctacttctctccactagatatacgacatttctttcaaagaacttgattcttgcaggtgtttgtaaagtgatttaaaatatgaagatgttgtatgtgcattaatataggaatgtgtgtgttcaatcaaatggacataaagagttacatatagtgaaacttctcactttattttgataataggagatttggtgagcaccttcattccttcttttcattttaatattgcatactgtgcagttttttaaaatttgttttagacacaagatctcaccgtgttgcccaggctggacttgaactactgggctccagcaatcctctcccctcaacctcctgagtagctgggactccaggcaagcaccactgcatggggcttggaacattttcttaatctggagacatctaaattaagactacaatattaaaatgatgaaaaaattgaataaagatgttcaccaaaacccctagtgttttgggcaataatgattttaaggctttgaggccccttcccaatgccagtcattctacaaattgttcataagcacaagcaaaatcgtaagttgtaatttggccttcaaatacagtatttttaaagaagggagcattttagttggtatgttcttgtttagcatattttattagatgttaaagttttagaatctagatgtcatattaaagtatatgagataaagaatatgacttcttccgtttaactagctaaactgtggcatataactggatgtgtctgtatagagggacctctgggagaaaagaaaaacttctattagctgtggcttggtatgtttgggggtcccagagcaagccagatacttgactggggaggggggaagagcaatttatgtgccagtaattacaattataaacacatgaatgtcctgggattggagaacctgttctgtatgagggtaccaggagatcttaacagtggaagaacatttaaactgaatcttgatgaataagtaggattccccaaggggaaccaggaggaaccagcacctcaggtaactggaagaatgaatatgaaaatacaaaagtaggccaggcacggtggctgacacctgtaatcccagcactttgggaggccgaggtgggtagataacttgaggccaggagttcgagatctgcctagccaacatggtgaaaccccgtatccactaaaaatacaaaaaaattagccctgcattgtggcgggcgcctgtagtcctagctacttgggaggctgaggcaggagaattccttgaacccaggaggtggaggttgcagtgagtcgagattgcaccactgcactccagcctgagcaacagagcgagactctgtctcaaaaaataataataataaaataaaaataaaaatacagaagtaggttaccatgttaacaaatacgttcatcatcttgttagtagggacccattggagggttttaatcaaggaatgccattagatttgtatttgagaaagataattctggtggttcagtagaaatagagcaaggtgaggtcagaggcagggaaatcaactaggaagccgctgcaaccatctgagtgacagaagatgaacttgaatcgaacattgaatgtagcaatagtagtgtgggactaagttcagagacatgctggaagtggagcaggcaggttagggactgagcaaagaggtagcgtggggagactagaaagacaagaaacactttgaagattctagttcggggctgggcacggtggctcacgcctgtaatcccagcactttgggaggccaaggcagccagatcacctgaggtcaggagttcaagaccagcctggccagctgaccaagatggtaaaactccgtctctactaaaaatataaaaatttagccgggcaaggcggcaggtgcctgtaatcccagctactcgggaggctgaggcagaagaatcgcttgaacctgggaagcggaggttgcagtgagctgagattgtgccactgcactctagcctgggcaacaagagtgaaactccttgtttctgtcttcccttccttgtgaaatcattgtagatacatttgggaaaacaacacaaagagattccactgtcccccaatagtaacgtcttgcaaatctatagtaaaataaacccttctaaaaattgtatgatttatgagcaattttaaattaaaatatcagtatactctcatgctgatttctaactagtcatttctctgacctcccacccctcccctcaccccttggcccctaccaccctcccacacacatacctaatggctctccagaccaggtcctgtccccatgctcccctgatcaagcagatcttgaaccttgtggggaaaatcacgtctctggtggtcactggatgcctggtgtccatcctgaccctctaaagctagggcttcccattgtgggctggtactccctacatgtaccctccatgtcctcttgtagggaccccagcttcagcagtgctctttaccatgttgttaaatatatggcaggttggggtttgattctggccacagctctccccagataactgacagagtcatttagggcctttgtcccacatttctgggaaatttgtttctataatagttaggactttggtatgctagtgacagatgcacagatcaaattaacttaagaaacataaatgtactggcttactgagttgggaagtccagggataaagctcccttcggagattctgggactcaaacaatatgatcaagattctctctcccttgcacttttgctgatttgttgacctcatgctcttcatggtgtggtttatatggccattggcagatctggagatacatccttatatctcagagtgacacatgaggcataagactcgcttctccaccatcactgcaaaaccctactggagaagggctctgtttggcctcatttacatcctgtgccaatcctgtgggccaatcacttgtgcagggcgatgtagtgtattttggatgaatcaaccaatgactcagcctgagctccttatcatctgatagacttggaattggggtatcaaattgtctggcttagtagaaccagatggaaagggaagaaagagtttttcaaaggaggagatattgacgggatgggctaggcagaacagctaatgtccattttagttattcctggatctagcgtcttctcctgtggtgaggagagaggaatgtcacatggcacctatggttgtctcttgggagttatggtcagtgttgacagaagaaggcaaggatggctgtaagcaccaagatgtttatatgtatgaggttggaatttagaggtgttcagaactaatagccttaattgtctttgtgaaattgaaaacaaaagcacttgtgaaaagacaggaaggcagggtggggagcttaaaaagctagttgagggtttgaaggatgagagagagatcacaaggacagtgtagaggactgctaagagatattgaggatccaactaagattggaaactgtagcactcaggattctccagagacacagtaggatggatatatatgcgtacgtacacacacacagaaatttatttcaaggaattggcttatgcaactgtgggggttgcacatctgaaatctctaggacaggactgcaggctggaaactctcaggcaggagctgatgctgcagtctcgaggcaggatttcttcttcctcggggaaacctcaattttgcttttaaggccttccaggtgaagagatgaggcccacctgcatgatcaagggttatctcctttactgacagtcagctgattgtagctgctaaccacatcaatcaaatacttccacagcaacacctaaattagtgtttggtgggataactgggtaccgtagccttgccaagttaacacatacattggagtgtcacagaggcctaaactctgtgagccagtctgcatgacactagatgatctatttttcctcttcagttccacagagataaatacctagcaaatagaagccaagagagtggattgttaaactgattgatgattggaggaatcttcaggctggggtcactggagtctcaaggggagatcttgacgttgctgtcgagagaatggtggacaaagtccctcagggttgtggctggactgagaagttagttccccaagcgtaaagtgacaagagcatcaaccccaccagttaaaatgaataatgcatgaataatacttatgttgggcactgaactaagtatcacattaattttaaattattatcattgttacgatttcatttaattgtcaaggaactgacactacataaagtcagagtggatttagtgggagtaagagggtgagctaaatgtggtatattggagtttatttatttactcaaccaccagttatttaataagcattgattatgagccaggaactgttttaggtgctagagatacagtggcaaacagaacagacaaagtctctgccttcatggggcttaattctgttggtgggaggaggtatctgctaataagcagacaacttcagcaagcaacactagccccaggtccagtggtaagcgtgttatgaagaatagtaaagccaagttaggcaatagagagtgatggggccagacagggctggggtaggatgctagacttataagagaaaccctttcggataaagtgacatttaaacaggaccccgaaggcatgaagggagagcgtgggctatgaatatatagggaagagcgtgttcgagagaaagaacatggtgtgtgcaaaggtgctcagaggctggaggctgcttctccctgtaagtgaggaggagaggggtgggggatgaactgggataggttgcaacaaggagccatgttgggtgtggtgggtcattataagttctctggagttcatgctgagtgaggtggcaagacagtggagagttttgaacacagaagtgacaaggttcttctctaagggccgttttggaggccgtatgaggctgtatgaagggatactgggaggacaaggatagaagaaggagaccagtgggaaactgttaccgtaatccaggcaagaagaatttgtggtctgaaagccatgctaggtatgagcatgaccaggaccatgccacgggtatgcattgctgaagcagcctgccagcgaagaccaagatggcccaggaccctagagcagcatgtctggaggggtctgctgtgttgacatggaacttcttcaagatggagacaggatgggtgggcatggggagaagaactctgacccagattctgaagtcctccaggagagggaagatggtggaggaaagcagcaacggggtagaaagaggagcattagctgcatgcaggcaggtgcttgaggctcctgcctctgggtctttgcatgcacttctttcttttctgaaacattctcttcctaatatccacgtaactcagtctcttccttcccacctcagatctttatttaaatagattggaagactgctgtcaggacatagtttatgtaagaatgaagataactctcttgcctccatccttatgtcacctggcatggggtggcatgagcagccactgcctggaaggtctacttggaagtggtgtcctcaatggagaggcggatctggcttgaggctgggaggtgaggggactctcctgtgaaaggggtaggaatgctggggaccttattgaccatgggctaggggtttcagcaggcactgtggggagtgtctttagggaagtcaggaaaggagggtagaatcaatggggatgaagtaatgagaggaccagagggaacaggtgctgggatgggagctgaggatgccagaacatgggattgactgccctgggagggcctggcaagcctgaggctggcgtgcatgcagcctgtacgcttcctggggcaccaagcagagcatgggtggccacaggagacgtaagggagcgttgtctgaggggatgtgaggaatgaccaggtgctacccacctacagagctctcaggatgcttaactcctgaagaagctgtagcctggaatggcttgtagacctgaatgtataccaggtgtaactggcagagagggagcaggccccagaaggtccttgttcatcctagtcaggtccttcatcctgtcccacttcagggcccaaagtgctctgattctaatgccagcctctttggccttgcatttgtagagaagcgagttccctatcattggaggtatctaagcaatgaagtggacagccacttagaaggagtgtgcaggatggaggcttgggtatttcttgggggctggactcgaagacctttattttccacttggcctggagcgtctgtgagtccttgtcaaatactgcctggcacttacctccatcgggacacagtgcaggcatggctcaagtgggtaaattgtttatggaatgcaaacctcgtgggacttatagatggcttatcaatgtggaaactgtattaaaaataagttgagatcagcaccttccacagcctctgcatatgaaatgtcacttacatttaaacccacatcaaaggttctgggttgattctttgtatacttgttagtagtccaatgcttaggacaccattttcaggtagctgttttttagtgtgtgtttggcagggctggttctatacaaacgttcacagtgagcagagggacagcatgatgtctcctgccatggtttcacaattagctagaagagagagggttgcaggctcactgggccagaccggacgctagaggctgtattcagtaggtggggcagtggcatggacctctctgcccatgatgtggacatcctggcagatgggctgtttcgagagcaagccatggcttcaagaccttggctgtttgtggtgatggggtgaaggaccgaatagttagagttcgtactgagtgtctgtggtgcagggagattctaatcacatcatttgggggtagcggctgtgcttagcactggttaagggaacgaacgggcatagttgtgctatgcttgtgagtatgctcacttcctggagatggggagagtcaaattcttagagtgttgtgtggcttatatattttattaagcacctgtgttctaagtccgataagcactttgcgtacactgcctttaattttccgaatcattccgttttgcttgttgaggaaggcaagcagttaagacaggctcatctcttgacatgaccccacatagtgactgtacctcagaggggtaaccattttctgagagctgggtcccaactgtgttagggtcaaaattctgatttgcataaccagaggtgaatgaagacctgggaaactgacacatactatcttgactcataagagactgatgtataaaaacagaaatgatgccagctgcttattttgtgagaagaaaaaaaaaacaattctgtgaaccagatacatatgttctctcatcagtgcattcaatatgaaggcaaatttatatgaggacataaattaagatcagaaggttgcttatcagcatgaaacagtgtaggctgagtgaggataggacaccttactgacagggttacagagctgtgatcgtcttggctccagtgccaccctgcctgctgtagggctggatggtaaggttacctcacagtgacagggacaccaccaccagtcccagccgctctcagtctctgcttgcagtgcctctaacactgatcatcatcagcccattgggctgattcatcctttctttagacattttcctcatggaccctcagtaagttgtcatcttcctttgagagcaagttttctctttgtggtatctttgcatctcaccactttatttcgttatttttgttttgtggctataagctctacagagaagttgtattgttccatttccaaatttgtgggaaaggggaagaaaagaggagaggcaccatattgtcagcctgatttcccacctcagagacgatattcttgtcctcgttttacaattgagtcaactagatggcatggctttttttcctagctcccattgccatctgacgtggtatttatttagttgtttgtttattgtctatttctcctgttagaatgtaaacttggggacagcaggtctttgccatattcttggcatctggaacggtaagtggcctgaggtaggtgtgggcaggtaggagtatgcgtggattgaagaaggatgaggcaggccctcaatcccagtctctcccacaccccaccttcagtttggtgaggtgacagaagggaggaaaatatgagaagatctgagccaaaatgaaaatcagacaaaaactcagggcatgttctgggggtccttgtgtccctacatcgtcttaaagaaccagcctgggacagtggggactggagctggtgacacacaaggacccaagaatatggaaggcctttctctggcataattgaaataaactttaatgaacaatttgtcctgttttaaatatctttatagataatatctggagctggacaaatcatgtataatctacttcctttatcattcttatttcaattatatccatctacaatgtctcagccaaagggaacaccatttacctggtagcagccacctgaattttaggcattgatatctaagagaaaataagttgctcaatggttgctcctttgtaacgccaaacctaggacttgactatatggttctgatacagtccaacaatgtgctagttgataacagcttgtagatggatatatatgtattctgcatattttgtttggtgaataacccacagcattctaactcaggtgtccagtactgcttatcaaataaggctttaacatagaaatacataaattctagaaattgtcttgcatttattgtattagaaagtgaaattggtttctttaaatctttgtaagggctattaacataatatcttgttccaaatcaaatagagctacttactactaaagacttttgtactttcttcaataattaaagcaagcaagatttgtagacaatgcaattttcatgatgcattgaaaaatgtattcttacagcagctgtgtttatcacacactttcattttcttaatatcttaaaattgcttggcaaaatgaaagggaaggagggtggtcagggatgtttccaacattctattaggatcattttcacacaaacagaaaatctgaagtaattgttcagtgggtcccctgcacccatcacgtacattttacaattaatgttttcctctgtttgcttcatcactggctatccatgtattcatccctctcttcatcttatttttggtgtattttaaattaaattgcagaaatcagtacacttcaccactaaacagttcagcatgcttattattaactcgagttaaatatttaatatatatttcaggtaaaatgtgcgcacagcaacataagcacattttaagctttccattcattgagttttgacaaatgcatacacctgtgtaatgccaatcccaagccaaggtacagacattctttttttttctccaatttaaaactttaattaaaaagtaaactttaatgtcgaaaatgcaaacttggggaaggcagaaagatcacacacaaggctgtcacttcacacttggaaggttgcacagcggccgggcagaggcgctcctcacatcccagacggtggaggggccgggcagaggccctcatcacttcccacacggtgagggggccgggcagaggtgctcctcacttcccagacagggctgcggccagagagaggcactcctcacttcccagatggcagggggcgctgagcagaggtgctcctaacttcccacacgcggtggcagctgcgcagaggcgcttctcacctcccagatgggcggcggccgggcaaaggtgctcctgcttcccagacggggcggcggcattcttaccacccagaatggtgatgctagtgcctctttccagtcgatttccaccctacgtgcacgcagagggaacccatgttctgatttttttctcagcatggattactttagtctttcctagaactgtatacagttctagaatcatatagtatgtactatttgggataagtacatgcaatacatactactttgcatgagactttttcacgcagcacatttttgaaattcatctatttttgtttgcatatgtcagtaatctgtacccattttagtgctgaatcatattccattgtgtgaatatgccacaatttttaaatctatttacttatcgatggtcacctgcgctgtttccagtttgcagctattatgaagaaaattgctgtgcatgttcttatgcaagtctttttgtaggcataagctttctgattacttttgaaactcctggaatatgtagtcttagcacagagtctacacacagtaggtactcaatgaatgtatatattgccctggcacaaaacccacatgacatgttgggttttacagtacaccagacgttttcttcctcatctgttctcagatgagcttcgtaactacctgctgaagaggcagaggcaatccacacaatggaagctgagacattacataatcgctaattgttggagctaaactagaaccctggtttcctaactcctagtcctgtactctctgactgcttgctattgagacgggagagttcccttgacccctttgcaggacttgtgaaaggggtgtggcccacttatttgactgccaccatgctcaaaccccctgcctgagagggagcatgcaggtgagcaggtacaggagctgggggaatgtggcaagaatgaaccccgtactggtactggtcaacggcagcatccagggttgtctgcgacctctggagccctcgagggcatgtgttacaacgctcatagcagttactatctgcagatagctaagtgttaaccagctcagtggcaagtcagggtgacaggcctttacaccctgccctctgggtacctggcttcctgtctggtgtccaggaagaatcaggtcacataggcttgaaggatggttcaaaatatggagattttattaagcagtgggagtggctctcagtggaaagggagctggaaaggggatggtgcgggaagaaggtgctctatctctgaagcttggccgtctctgaggaggctcttctccaaagttgttctctttgaagttaagccgcatctgtttatagtttcggacactcagttgcttctccttttcacgttcagctgcttgtctctctgccagctaaggtctgaggtttatgtgggcacaggagagggggagcgggtaggccaaaaaggtaacatttgggtgggaaaacagggataactcttctcatttagggctgtggtttccaggcttgagggtggggcctttgccaggaaactgccctcttctacccagtacttccctgtctcctgtctgtatcgctatgtcagtgccaaaccgaaggtatgtgtactttacatcctcccttccccccaagcattgctctgtgccacagttacggtctttgagagttttgggtttgtactttggctctatttaagctcctggtcatcagaacttatgtatattttccccttttatatcatcttgttttctcagtgtgtatatattgaggtgaggggaggggcagcagggagggcctgtagagggagttattgaaaagtgacctaagccaatctggtacttttgattggcaatcagagaagtcagccatgaggttcctgagtctctctttctctgccactcccagctgctctgggatcatgaaaaccagcctccaacctgattctgcaacacatgaaaacttttattaacaaggagattcatataccatgcctaaaacactcatacaacctgttctgtaaactcaagttgtcccccatccgtggtttaggcagcccggttgttaccagtggaaggtgtccgagttactggcagcaattccatatggatctgcagcaacttcaattcttgcctcctcagaagaaagaattcaatggaggggcataaagcagaaaaagagactgaagttaagtttcagagcaggagtgaaagtttatttaaaaaggctttagaacagtaaagaaaggaaaattcacttggaagagacccaagtgagcacctgaaggtcaagagccccgtttaacggtgatgctaggactttctaggattcccatgattcctcccttagggtgagctgcctgcatgcacagtgccctccttacctttgggaattgtgcacacacagtgtgtttaggaagttgtatgcatgcccatctgtggctttcttcccttttctggtggtgtgcccctggaagtcatactttgccattttgtctcttaatgcacctgcccaggaagttgcttctccctggagcctgcgtttgattaacactttaatgttaacagatgtgcctcatcaggagattgtctctccctggtgcccttggactggctgctgaattatcatttttagagaggcagtgtgataattgtcagaccatcacctgacattcctagtgggtgggggagaagagccttctcctgccccgctcatgcctgtctaactacctgtaacacagtgagcacctctcttgacaccagtaatctgatagcaggatcaggaagctgcttcttgaggacagagtctttccggaagcagtaggacagtggtgtgaaggaagttctgggcctcagccctcctctgaaagtgtttgctaggctggctaagcccagcacccttttcatggaaattttgaggtttctagccatccctcaaatctctcatagccttcatttgaccattgaaaataatttctaatatccctttatgctaattaatgaactatctgttgcagattcagatgggagagttagaagcttttatgaggccacctctgggaatataaacaccatttgggatctttcaaatgctcactaacaccactgtcttggtacttcctgcttagggtgcttcatatattaactagtaactgttgagggtgtcctaacatgaatctacacacacacacacgcttaaagctcactatggatggcggagtgtttcaacataaaacccaggtcacattggggaggtactagagtccatgtgtccttcccctaacccccaccctctaacggtggcatttccaccagactcttgagttttcagtttgagggaatcctttgaataaatatgattttctgcctccacacttaatgtggttagagctgcagccttgatcctaatctgtctgatctcccatcctcattgatagtaaaccagtgagtaggcaagtcaactgtgagttaatcggggtgggggggatttttaaatgcaagtctgatgtttaaatgtagctctgattatgcctcttggctatcagaagtgagtttcatttggatggagagccattttactgagggcacacagcacagaagctgagctgcagtgtaaagctttcaagtgactcttggagctattaaagtgccactcatttggtaactgttgctgttaattaagtttgtagccccattattaattcttggctctactattattaattatgcttctataaatttatagtaggcagtacctcagggaatttttcaagttgtatattaaaattagagataaataaacacttaagcttccttctcaatataagaagagtttggggtttttatttccggtactaggtaaatttgaaaggtatgtgatggtcattttctctccttactgaaacattttctacatggtttgcagcagaaatttctgtaacatatttaacaatgcggtttagtatttaaatatttaacccattcactgataacttgtagctaattcctacaattaaacttacgcctttggccaggcgcggtggctcacccctgtaatcccatcactttgggaggccgaggcaggtggatcacgaggtcaggagattgagaccatcttggccaacatggtgaaaccgtgtctctaccaaagattcaaaaattagctgggcatggtggcatgcacctgtaatcccagatactcgggagactgaggcaggagaattgcttgaaccagggagtcagaggctgcagtgagctgagatcatgccactgcattccagcctggtgacagagcgagactctgtctcaaaaaaaaaaaaaaaacaaaacttatgccttttatgagagcaagcagacagagaaggaaaagaaaaaaagcctggcattttgtgtataaaaaatcagagctcaagtaatgttggtcaaatatagatgcaaacaagtccatgtgcatattaacaacccctttcaccatgtgctttatttctgaaaatactttaaatccttttctgtcttctgatccagctctccagacaatagttaataaatgggttcataggtaattatgatgcattttggttcttttacctacagcaaattcctttttttctctctctcttattctaagaaggaacaaaaattgcccataattctccaggttatagaaaacgtctattggcattttgatgtagttcctttcagatgcttttccaagcatatatcaaataatttagatcacacaatgttatggtttgattttaccccttaacatttgatgtagcaattctttattattggacatttaagttgtttataatttttgtccttgcaaataatagatatatgatatgttggatagctctttaaataaatatttgagagtacctctaattatctattttaatgcctagaaatataaattttttgcctaaaggcatgaacattgttcaagttcttgatacatactgaaaaattgctttccaggaaatgacgccaatttccagtccactagaaacattccacggtgtctgtcttactgcggccatgccatttaatatagctaatacaattataataatattaacttgctaactttataatttttgaattcggaaacttgaatgagatatgctggaacatcaaatagtgacctattttatctcaacgcttcattttgctttttggagccaaaagagttctttctctctcaaattggattcagtagttgaggggctacacattaactgacagtagccatattaacaagagaaaagacaatatttatttacccatgcatgggagagctgctcagtaatgagtaacccaccgactagccagagataagggtttatataccaacttaacaaaggtgaagggggcaattagggattcagggggaaggcatgaaggtgctcttgggcttttcagtgataatgggaataggaaatatgtcttcatggcagctgaattaggaggaaactgcctttgaggggagttaatggcagctgtatttttgggaggctctgctatagtcagataagggaagttcagataagacttctttctgcatctcctgcagctcaaatgttttcaccttaaaataacctttataaagactctgagggtccaagtgcatccccatactttctatttattttaacatcacaaataaatgtgctcaataatagataaatttttcatcatgaaatgtattgaatattagtaataatggtgttttctgccgtttttgacaggtaaattaccagtaagggatgacacaggaggagaaaaggagaaaatgaagaactgtcataaggataatttttattacagatatgaatatatttgtttggaactaacaactatttttagaagacaaattaggcagaagtggtcactactgtatggacaagggtgaatagtagttgtgattttcaaaaattttttaaacatatctcttgatacagtatttttccaacttcatttcttttctttttttttttttttttttttttttttgagatggagtctcgctctgtcatccaggctggagtgcagtggtgcaatctcggctcactgtaacctctgcctcctgggttcaagcagttctcctgcctcagcttcctaagtagctgggattacaggcgcgcgccaccacacctggctttttgtgtgtgtgtttttaatagagtcagggtttcaccacgtgggtcaggctggtctcaaacttctgacctgacgatccacccgcctcggcctcccaaagtgctgggattataggcgtgagccactgcacccggccttccaacttcatttctttcaagtcacagtcatggaacatgtttacaacttctgagttacactattttggataaatagtcataaatatcagaaattgaaaattagattaattcctccttattttgatattcacctaggaaatagtttttctacagatattattctggcaaatctcagtttcttgaatctcagttccttgaatcttgacttttgtcgccacccttgatttgaacatcccttggcagctttgtggataatacagtgtgagagacataattgaaaagcatgacaagtgagaaaatgggttacatacctcaaaacaaaggctcattatacatgacaatgcaattcatttgggtctctccattgcatatttgctacaggtattgattgccttccaactcttcccacagccttttgctagtcttaaaggcataaatcacttggtgaaaggatatttctatttcagccagataaactctttcctttttgtttagatttaatatgaaggcaaaatgcactgctctcagtgaacagccttgtttcctttcgtttaatggggaagggaacactgaaacatttcctacattctctaggaaaagcaccttttttttttttcttgtctttataaccctgtatctgttgtcactgattcagctattcagtctgggacaaagcgacttttaagttctagagctatgaggaagctataaagggaatacagttcactctgtagagaaataacagcctgggagatcatggaccagaaatgttactctccaaaggtttgctagagctttactttgaattctattcatcaatatttttgttggcctggatcagtgactctaattatgtatagaagatagaaacagcagttatatttagcaagctggaaaagtccctgcagtctaccctcagaacagctaaacatacggagtcaacctgagattctgaatgctctgttcactccctgagagataatgatgactgaagagtgatagcgcagggaacagagtaaagctagaatgggaggcaaggaaagttatcagtcagacctctaggagaagtcccagcccctgccccatgcttttgttttttatttgtctaactttttttttttttttttggagattttccatttcaggcttttgttgcttttctcaaatgtcaaccctacctacctctctctgaacgaacagcccacactttctacttcatcaagaaaattgctaccacagggatgatatcatagcccattactgtatgatgctatctataccttagcctgggcttccaccatttctttgtctcccaaggagaagggacgtgactgcaccggatcttagtgtcatcttttctgcctcccattggggactgtgaagttattccaaggacagttgttccccctaccatagctgctagctccttccctcgtgccaggagccacttagtcacagggtaactgaagagaaaaaagaacgagacctattgctgagcctagagcaagctcccccatacctgcaccccacatgtgtaccaaaagcttgctttctctcccattcccaggtctttgatggggacgaagctaagaccatgtatgccattggccccaggcaataagaggtgcattgtctgcaaaagtcttaaaacaatattaaaatcaactaaaaattggtctttttttttttttgagacaagagtctcactctattgcctaggctggagtgcaatggcacgatctcagctcacagcagcctgcacctcctgggttcgagtgattctcctgcctcagccttctgagtagctgggattacaggcacccaccaccacaccccactaatttttgtatttttactagagatagggtatcaccatgttggccaggctagtcttgtttttattatcaccatgttccagcaattctaaacgatatcagcgttggggaggaaaaacatctcttctttctacctgtcttaagttcattggctggggcccctataacaaaagacagagtaacaagagaaaagcacacacgtttgttgaatgccagttttatgtggcatgggaatcttcacagggaaatgactttgctgagaccagctcagtgggggagaccctaacccagcggtactagaggaattaaagatatacacacagaaatatagaggtgtgaagtgggaaatcaggggtctcacagccttcagagctgagagccccaaacagagatttacccatgtatttatttacagcaatccagtcattagcattatttctatagatgttaaattaactgaaagtatcccttaagggaaaggaagggatgggccaaattaattgcagcaggatcacgcccttaagacacagattgctcatgcttttgtttgtggcttgagaatgcctttaagcagttttcctccctgggcgggccaggtgttccttgccctcattcctgtaaacccacaaccttccagcttgggcgttatccttccagcttgggcgttatggtcattatggacatgttacattgctgcagagattttatttatggccagttttggggccagtttatggccagagtttgggggggcttgctcccaacagacttgaagaagcagttaaactgggagtttttatgctagcttgagtgaagagtggagagtcatggagaaatgtgttaggacagaaaaagtatgagccgaggatagtcaactgggagaaacaacaaggtctgtatgttcacattcctcttgacatccctgtgtctttggagagaaagatgttattttcctccaggcatagggagggtacctttcacatgatctgcctcagggaaggatcagacaatctttgctatacatgctgttttccaaattccttcaacctaaaatattcagtattccaagtcaccatattttggggtagtatgtcttgaaccttatcatcagtgatgtaatattcctccccagaaaatccttttgttggtaagttacaaacaattgctataacgattgttgacccactggcttcctacaggcaacccagctatactcagctgagtgtcaattcataagggttggaatcatttgagtttgctgcctgcacagtttgtgtctctaagccctgtgatactacctagtcctacgtttaaaaagtaggttcaaaataaacaatggtaatacaacaattctaagggtaaagtgacagagcttgccttattgcacttttgtgtgcagatctttctctaaccttgtagcatttattcctttggacgtgtttcttttatgctctccttctcccttaaaataaatacttaaatgtaattaaaaattattaatccattactttgtttccttttttgtactgtgatagttttctaactgacttgaatgtacatacaaaatttaataaaagactatgttttatgtttgccattattttttggcttttattactattattttaagaatattattgaaggcttggcgcagtggctcatgcctgtaatcccagcactttgagaggccgaggtgggcagaccacccgaggtcaggagttcaaggtcggcctggccaacctggcaaaaccccatctctactaaaaatacaaaacttagctgggcatggtggcgtctgtagtcccagctacttgggaggctgagacaagagaatcgcttgaacctgagaggtggagcttgcagtgagctgagatcatgccactgcactccagcctaggtgacagagcaagactccatctcaaaaaaaaaaaaaaaaaattattgaagacaattttgttgtgtagaggaggagggtcttaaatgatcctctctggctgtcagatatgctggggactccctgtgttcctgcacacctgcccaggctctctcctctccttcctccctcattcctgcacctagaatgttttcaaaagttattctaaaagcctaaaataacttccgtgaagacttgctgtgataattccagctctttctttcttctctgaattcttctaacacattgtagttttccatacaatgtagcaagtgatggtatgccagcttagactttttctaatactttttttcccaagatagaatgtaagctccctgaaagttggggttagccttatatttcttcttttgtgtctccccaaagacaacttttggaagtatcccattaaaatgtatactctgtagaaaccagctcaaatccttcaaaaacagctcttctactcctgcaaacttcattatcctctcataactttatgtgatcatttaaaatcaggtttttctaaaacttcggtctgagtgaccaaatgcaattgcttatcttcaaggaaatagtgcttgctttaggcattcactccagaggcacacaaggagagataggtgaaatcaacatgagcagttaatttctggtttcacccgtaaaatactgatttctgtggtttgaatgtgtccctcgaagttcatgtgttgaaaatgtaattccaatgcaatagcattgggaggtgggatcttcaaagagtaatttggtcaagagggctctgtcctcataaatggattaatgccattatcttgggagtgggttagttatcgagagagtgggttgctaatgaaaaggatgagtttgttccattttcctgttgctctcttgtggactgtcttattcttctgcctttcactgtgggataacacaacataaagaccctcaccagatgccagcccctcaaccttggacttcccagcctccagaactataagaaataaatctctgttcttaattatccagtctgtgttattctgttatagcaacacaaaacagactaagacagtgactctacaaccctaaagaggtagtcactgaagaactattaagcattctctcagttgtgtcagtgaaagccatctctatttgtgttccctatcttaagccaacagttctcaaaatatgatccagggactcccaggagtcctagagacctttccaggggttctgtaaggtcaaattatttttataacatgacccagacattatttgcctttttctctctcctaagtgtgtcaaggcattttccagatactatatgacatgtactatcattatagatttagcgtggaagcagatatgagaagccagctgtggtccattaagccagagggtaaagagatttgccaagaatgtaaaaagaatgtcttctcatggagttttttgtttgggaaaatagagtaataattcataaaaatttcctatttatgttaacatatgagtttattgctaattttaaatcaattcataaacacatattttttaatttttcagttttaattttgtatacagcaaataacactctatgtaacccacatatacaaaaggtccttgaggccctcaataagagtgtaaagaccaaaaagtttgagaacttctatcttaggccaaagcagagatttttagaaacatattcttttaattctttctttggttacttacctccaaatcaaagcaatgtgctgcaactgaatccagtggaaaaattaattagctctatgttaattctttggctttgctgtgaaaagcctgatctttgggccattgacatctgttagaaatttaaactcttgagccctgacccagacctactgaatcagattctgcattttagtaagatcactaggtaattttaacctacaggttgagagttatgagcactgctccactttgcctttgtgaatctggctgggatctttttccaactttattgaccatgttaattaactccctcttttttgattctctcctaataaggcttgcagctataactgcagtttatcctgataaaacttatttctgtagggggaaaaaaataatcttctccttcactcttcaagaatttttagctgggactccctgtaacaaaaggtagattaacaagggaaagcaaacaaaagcttaataacatgtatacttcctgtacacatgggagataatgcagaaaaatgagtaaacctctagagtagatctaaaaaagttgtcttagtcttcaggcttaaataccatcctttgctaagacaaaagaaagttatagggaaaggcctggttaagaagaggtggccaggaaaagcatcataaacaaaaccaaggtttgttatgcagatttaagtaatgccttctgcattgataagagtctctagtgatttagacattttcctcttcctggtgcagagagggagacattcctaccaatagggatgtcctgtatagatgtaaatttatgttacaaaagggtaacttttcagtgcttcttctgtatgtgcagtttctcaaaataaccagttcaaaataatcccatgccaaagaggcctatttggatgggcatattctggtttcctacaatcatatgttgggatgacatgtcctgaattccatcacttcctaatgaaatctgataaaggactgacttgtctgacatttattttcatcctacaatgtgaatgcaatgaaggatcaatttgcaattgtattttttatggccttttggatttatgcactagagaggtgctaaagctgatgtgttgattcaagtgaggagtaagaggggtgagaaactgtgagaaaaaaaagtactataaagacacatgcacacgtatgtttattgcggcattattcacaatagcaaagacttggaaccaacccaaatgtccaacaatgatagactggattaagaaaatgtggcacatatacaccatggaatactatacagccataaaaaaggatgagttcatgtcctttgtagggacatggatgaaattggaaaacatcattctcagtaagctgtcgcaagaacaaaaaaccaaacaccgcatattctcactcataggtgggaattgaacagtgagatcacatggacacaggaaggggaatatcacactccggggactgttgcggggtggggggaggggggagggatagcactgggagatatacctaatgctagatgatgagttagtgggtgcagtgcaccagcatgacacatgtatacatatgtaactaacctgcacaatgtgcacatgtaccctaaaacttaaactataataaaaaaaaaaagtaactgtgttttcttctgtttaatgattgttgcactctcctacaaattctctttaaggaaattttcctagaagccttcttccttgaatttgtaagaaagtggcttttcagtgggttgacctcttggcttttacatgtaaatacaccgaaaaaaaaaaaaaaccccaagggatgtaaaaacattgagaagtttctcaaaaaaagaaaaaagaagtccatttagtctggtataactatgaagtaaaataaatcatagtatctgagaaagaaggggaaaatattcaattgtcaaaattagcctgtctcatttatttggccttggagaataatagtcattgatatagaccagtgggtttcaatcttgaataaacagaggatcacctataaactcaagaaaaagcccatgtctgagagattgaattggaatttggtaggtacttatctttaaaattttgacaaggtgattatgaaacacaatgagaattaagaatgtatggtatggtcaaatacgtgagcagatggaacacaaagtccctagtctttaagtgtgtggattcaatcatttattcatttttctttatccagggttagatcctgtaggggcaaagataatttccccctccccctctgaaggttcaagtctgctgaaatgaactgatgagagagattaacagggcaaaggcatacaagtttattaatgtgcataagcatggaagccatacaaaaaaatgaggctcacagaaaggccagatagctgaagcttaaaaagcactctctttgtagaggagccagagatggtggatgcatgaaattgagggttagtagtaaatgctttttaagagagcttaatggacccaaagaggaaacaatagtttataaatgattctctttggaagttgaatttatgggacggtaaggggcagaactgcaaagcaaacgaaggttgtctttttatgcagataaagtttcttgggtaatttcctgaagcggtcctcagaagggtagatgaaaagtttgtctgggtatggtcagaattttgctttcttctcttctccagtggttaatctttcttgttaatttaatgaaattcctagggagggggtttaagactattacaattcttttagaaaaagttttcttaatcagatagggaaattccagagagaggtcctccctgcacttagaagcaaggaaaacagaaagttagcaagtccttggttcagaggcactttctgaggtattccaatttctttcaattcaaaagtggtcagcatgccaaagcactttactttggaatatcatttttctgagccacaacaggcctgtccagagatttgaattaagcaaattaacacaggaacagaacaacagatgccacatcttcttatgagtgagagctaaatgttgaaaatatgtggacataaagatgggaacaatcgacaccagggactactagaggggaggatggaaaggggagcaagtgttgaaaaactacccattgggtactatgctcactacctgggcaataggattgttcattcccccaaaccttagcttcacacaatatacccatgtaacagatctgcacatgaaccccttgaacctaaaataaaagttgaaaagaaaagaaaaatgaataaatcctgtttaacacaagaattttatggccttatacattttctaatgactattagccaagtgggaaacttgttgaaggtgtagagaactaagttcaattcctcatttattccctagatgagctatgccattggagtgaagactctgaactaaattaaaaagaatgtgttagactagtttttgtaccatagataagatggatgcacttgtgctttttaggtacaggaattcagacctgtggaagatccctggagggttaaggaatgcaaatctgcattatctgtaagccaaacatgtaatatgattcactcatgcgtatgcccgccattctttgtcaaatgtatgtgtgggctttattgacagaaaaggttttcaaaaaatcatttagaagcaccactgaacaatgattctttttatcagttagtttagaaattattaatgaccatcaactatgtatcaattacatgtaccctgggatacagtagtgaatctgacagccctaaatcagggagacatacagattaacagatgattaccatctagtgaatttagtgctgatcccattatatctatctgcagtataaatttaggtgtctgtaatcctagaaatactgctttaaagccagcatgtctgctcccatctccctgttagcctgtacaaatctgctcaagtgttaattagtaatcccaggagagaagtgctgtcattcacaattttctcaaaattacctctagaaatagtaaacagtggctcgtaactgatgaatgtgatggttttagccaaaacatattctcaatctatgtctactcaaagtagggcaatagtcatgatggggggaggggtgatagtaaaaatgcattaacatgaaaatgttgaaaacaatgatgcagtccaattatctctttatagaggaggactctataaaatgttaagagagatacaatgacatgttctagattcatggtctattaactcttgatcctaggtttctcaaagggctgaactgactcaaatatactggggactccctctgctcctcacacctgcccaggagggttacttctcaaggtcttgtgccagccattagtgttgtccactcaaactgctcaggaagcgtggtaagcacggtcagttgtgtcagcatttgcacaaagtcagtgacttacggtgcttccttgtggaggagttctctatccaatggtgccaggcttggccatgtgacttgctttggtcaataaaatgtgagcagatgtgatatgactatccacatccgtgcttaggctgtaagagccatcatgtgactcagccatgctcttctctctgccatgagaatggcatattaccataggaaatagtccttcagcctgtggagatagggcaaaacagagccacggcccacctgccactggcatgtaaggtgagtaggaaataaagctttctttgtagtgtacacccctgtgattggaaggttatttgttactgctgcataacttagtgaaagacaacttatatagtaggccagagacctgccaactttttcttaaagaccagatagtaaatattttaggcttgtgggccatttacagtctgtcatagctactcaattctatggcaaaagcagctattgacaatatataaacaaataggtatggctatgtgccaataaaactttatttacaaacacaggtctttggcttgtgggctgtagtttgcccacccctgccataggattttgcttcctcacctccttgaagttggatgtggccagtgaagttgggtgtggcacttgctttgcctagtggaatgcaagctatttaaagaagtggtgtaagtggtggctactctgtcagtctgagtcttgagagataccattagagagctgagcatcggccaacctatgctggacattcagcataactaagaaataaaccttattgtttaaaaccactaagatgtatggggtgtttgttactgcagcatatataactgcgcctatctgtactgatacaggtctatctggcattacgtttcggggcaccacctctgctcactgccatcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacattttcaaaggtatgaaatcacctgaaataattttttagttcattttttagtggctaaaatctgttaatagtttgattcacaagcctggcctttgaaaaagtaaaaattggataatgctgcacaagccatgttctccctggtgtgtaagggttaattattggactcttgcttgatgatgacagtgcaggttcattgaagtcatcactttatatcaccagcctgtctgcagcactgttggggccacgcctcttgtgcgatggttggctcagacctgtagcttcctttgccttatcccctttcacattgaagcctcatctgctgcttgacagtgcatgcctgagagttgcttttccacagtccctgttcttctcctaggtctggttaattgcttctctgttaaacagagaacatgttgaacagcagccttaaattattgtccaattttagcctactgggaacccctctgcagctactctgatcaccactgatatttctagaaagttcctattcacaggggactcttttctcccttctttatgctcaagggagaataaatcacagaagcagcaatccctccatgtgtcaaactatcaatcctacatggagctacaaaacaaaaggcagtatccctttgttgccagagaacatccagtccctgtacaagtctgtgcctcaggggctcaggctcattagcaccatagcagtggctcatgctttccatacacttttctctaccaacacctacagttagtctcagagttgttctttatcatgataggttacagagcagtgttttaaccatattaccttgactgaggtatggtgaggccagatgtggatcaagagaaagaaacagggatggattttatggttttgaggctcacagttccctggggagacacagcaggctgtgctgggccactcagcggaagcacagagtgaggcatgaggcagagggagatgggggatggtagggaagcagctttattgtcgtctccagggaaaggaaaaggaaaggcagggtatgcaggtttaggattggctaatttgaaaatgttcttggggctctggggcatagaggctgtccccggttgtctcatacctggccccagggtgatgaggtaggtccacggtggcctagggtgcaagagccacttaagggaagtggtgggagtttaaactacttggttgactcctcaagaaggggaactgactggcctctagctagggcctcaaaacagggtgaagacagtatagaataaaaaatatattacaactaggacagataccaacatactgggggtttgtacctaccacagttattccttacatttatgtttcattttgtctagtaatagtgaagtgaatggagttctagactgaagtctctgtttaggcagactctgaatttgttttctcattggttcccagagatggactgagatacctcagtcctgtggatacctcaggcaggcttaaaatgtggcacaaattctctttaactattcagttgatactttttcgtgagggcttcaaagaggctgattttctattgctaaaaattgcatacctctctatgttcaaagaaaataccatttactttatatatgaaagagcatttgcttatttggaaaacttttatttgcatttcacattttttatcacttcttactaaatagaagtttctcacattctctagggattgaactaagtgataacttagaaagaaagtattgttcaaatacccattttttggcttttatgttagtaaaatgtttcccctttttctagcttttctttgtgatttcagaaacgtgcaacttctttgaacgcatattaaatgtttttaaatttaaataatgaaccacttgcttttgttacagcccagtggttcttcttgcctgctgcacagacagagccaaggcactgagacagtagtgttgcagcgagaaagatttaattattgctaggcagtcaagtgacagaatgagaggcatttctcaaatccactgccccaagagctcagaggctagggtttttaaggataatatggcatgcagggggctagggaataggtgctgctgattggttaaagatgaaatcattgaggtcttcatgcactgagtcagtttctgggtaggagtcacaggaccagttgagtcagttccctggtgtgagtcatgggtccaggtagagtcagtcagtagccagaatgcaaaagtctgaaaaatatctcaaagaccaatcttaggttttacaatagtgatgttatctataggagcaatttgggggcattaccaatcatgtgacctctggctagatggctcctgagcagtaagaaattatagaaaagcaagctaggggacaatggttggttatcatttagttactcctacattttagcagaattcaggcccctcccataattctaaccttgtcgcttttcattagttttacaagggtggttttcagtccctaaacaaggagggggttagttttgggaaagggctattatcatccttgctttaaaattaaactgtaaactaaattcctcccatagttaggttggcctatatccagaagagttagcttgggaggttagaagcagaatggagtgagctattttgctgactagctttctgtcattgtcataatttttagaaaggtggtctcactcttagtaaacagtagtatgctatgctttactcagttgtataatttcatttgaattcaacaaataactacagacagctgtcaacttagtgatgttgagattggggctaggcctgcagtaatcctctgaaatatgtatgtgcaccccaaaaacatgtcattgagatgggtagacacctgcaagaggagtgcttttaaaacgtttttacatgaagatgctttctacttcagtgagacttttgccagtggtgttagaagttgctgtgaaaaccaagataaggagccactgtgtttttgatttgttctagggatttaatatccctcatagttaatcactcaggcaattactgggttaacaatatgtcctgaagaagagtagtttttgagccatgttctttgaatcactaagattcttcaaaactgctttagagtttcccatgaacatttggatcacattaaagcaggctcattatttccatcttcatgtccatgtaaatgaggttgagttcttcacttggttctcagctttagtgttgttagtatatagaaatgcacctgattttttatgttaattttgtatcctgaagcttcattgcagtcgtttatcaggtctaggagtcttttgcaggaatcttttgggtttctctaagtataagagcatgtcactggggaccccaaaagtgaggaaggtgggagagaagtgagggttaaaaaattctctattgggtacaatgttcactatttatgtgatgtgttcactagaagcccaaaccttaccattatgcaatatacccatgtaacaaacctgtacacatactttctgaatctaatataaaataacaaagaaaaaaataacaaaaagtaggctcgttagtaagacaatagctgaggagccctgaggattggtcaccttctagcagagagaggaagggccaagctgatttacaacagtcctgatcaaagaagggtgacctgtccagggcaagtccacaagcctccccctctgtgtcatgaggccacagagcactggagttccatgaagtcaatggaaaagaagagttctactgcttaaacaagtttaaaaaccactgctctagcattgtttataagaaaagaaactaagaataaaaacaatactgaattcaaacagctaattccttaagacctgggaacattgtgtgttcttatgcagttataatttaatccaaatacattggaaccacaccataattcaattctaggtcaagagcagagttttgtatacagcagattcattttggagcactctctggggatttggttacagaaaaatccagaggatttatctgggctgtcttactcataaaactgcacaatggcctagattttagagatgacattacagtgaggtctcctccaggacatgctatggtatacaccactatacaccacttaatctttagagggctcatttgaatcacattatttatgtagtgtgtccacatgttagatttggccagattctcaaactggggtgtcagttccacgtctagcccattaatttgttgccattgtgaagacagtagacttgaatgccttcagaaggagcatgctgtactgcacaagtgcgaggggcctcattcctaaagtgatcacactgtgttttagggaattgtgcccctttacaatgctgtgactttgggtgacactctctagcttctatagtacccaagtctgggttgcgtctgaatttgaaatctctactatgagactgtattgtttgtttttaaagtcgatggagcacttgacttggagccagaagagaaagcttgggtcttcacgcttcttgattaattatcaagccagttaattttctagagcctctgtttattcatttgtcaaatgggacaaataatgtctgtttcacagggcttgttgtgaagattatactctgttgtgttatagaggtttaaagtggacctgtgggtttgtatgaaatacagcaaggtaacataaattaaaagtagatgagggataaaagcggggaaagggtctaaaatggggttaacaagttgtaccttttgtgcagatctatatgcttgctaggaatgagccacaaatttgcttctgtgccctctagcagccaaggagaaaatggaaaccttattttctttaatcatggtgtctacgagattgggaacacagtagggagtcatgaaaaatattccttttcctagtaacttaacagagagagaccaccctcaggggtctgcaaaagaggacattgcatggtacagcctatagtgtctgctacacagagaggttgcaaactggcagtccaccagtgtcaccatttgttgggatttttgttttgttttgtttaggcttgatgtctaaaaagtttgatccaacatttaaaagaatcagattttgcaaaaataacatttttaagttttctttcaaaatcagatgatcagttaatattgtaactatatatcaaaattaattggcactgtgtagcagcttttttttaatgtagcaatgatttcaggtttgccacagtctccaccattccctactgccttacttactacattttatttcctacttggcatttaggcatctgatttagtgactcctattctacagcatccttgtagtaggctcagcagtacgcttcataaggctgagaatccctgagaggattgattgatatgggaaaatgctggtactctgtacaatattgttctacaataaaaatgtagaattagaatattgaagttactgttagaactttgaaatcatgactgagggtttaaaaatgcttaatgagggccgggcgcggtggctcacgcctgtaatcccagcactttgggaggctgaggcgggtggatcacgaggtcaggagatcgacaccatcctggctaacatggtgaaacctcgtctctactaaaaatacaaaaaaaaaattagccaggcgcggtggcaggcgcctgtagtcccagctactcaggaggctgaggccggagaatggcgtgaacccgggaggcggagcttgcagtgagccgagatcgcgccactgcactccagcctgggtgacagagtgagactccgtctcaaaaaaaaaaaaaaaaaaaaagcttaatgaacgagagtctcaaatagctaattaaaacaacctcaacttccaaactaatctcctagcaagtagtttacccagagtatccattccaattgctctttaatcaaataaaaatttcagaatattttatttaaatatttacatagctatatattttcatcagaaaagagtatcacaggaaagacatgttttaagtatgcttttaactgtataaagtttgattgttaggctctatgatctggtgacaatagtcgttactgttagaggtgaatccttgtaaagttgttatttttgtcaaggtccactttggcttctagacttgttgagtttggtaagatgttttgagcgctgagttgctaattttccagaaatgtaatttgcaatgaagatgttggatggggctttcccaattatcagaaggaattctccaaagttgaaaatgagtgataattatctaatattctaaaacatgctgctagacatggatatagagtgtttaataaaagatgtcaaagttgtgttgtggccaccagccaccatcacagctctagccaacattagagatgactggtgatctaggaggagattgtggagggttatctcagtgaagagcctcataaagagtattggggaattttccctcccattgccgtggagagaagagatgagtgctcttaccctttccccaagccaagagagaagagctctgatctagagataggggttatggcaaccatgggagattggcatctcacttcccacttggatgcctgcggagctctctccaggcccatcagaatggagcacagcgatgattttagggatctgtgagcatatatacagatgcttccaacatacagtatttgatagatgcaaagttgctagagcagcctgtgaaagtgaggcaaagaaaaagatgttcagtggttgacaagctcaacttccaccatttggcagagaaagatgtgtacattttcgtggggccaagcaacatcaggaaaggtagagagtttgagcaattgttgctggttccttgtccagaggtggccttttgggttgaggcaacccagactgtgagaaccctgacatgtatgttgaagtagaagatgtgtgttttgggggaggggctcacaaaaggctggtcaaatggttcttccaccatgctagggaacttggaatagagggtccatgtgggcctctgaagaacctacaaatgcaccctgtgaaggtcccaggatgtgactgcctgccttgcacagctgactttggtagccaagagaattgaaaacagcacgacctgatgtaagaagatgttccgtttcctcaccactgatgtcacttccctgtgttaacctgagaagagctacggcacagagtgatggaggagagaatgaaagcagaggaggagggtaaaaggaaaggctacagtcccttccccactacaggtcatacaaaaggaggagggaaaagctttgagttggatatgagattgaagttttgatacgaaattactatacttttagtaagtgagtgagtcttagtttccataaataaggctattataagtgaaagtgatggaaaaatgatggggtcttcctgagctgtccagctgcagggaatggagatccactggaacaagtcaaagataataataatgagaaaaaaaaagattcttaaatccccaccattcaatgaaccagttaccaaacccacacgatacagagacattgagattccaatatgaatctctccacagaaggaggcaccttctcttgccatcttctgtgtattataaccatttttgggggggtttggtgcttcttgttcaaaattgaagtcttgtagccaaaagtcaaaatcatattcttctaaaattcacttgaaaaatatttccttttacagttgaattaaagcaaattacttggttaattaatgtcaaaggtgactctgttctagagataatttctgagtcatgatacctaatatttaaaaattatgttttgatttttatctttagtcatggtgatttcaaatgaggttattaaatcactgtaattcatgatttatataaaatatgaagacattaacctacaacatcttggattgctttttttttttaattgcattagtcactagtaccttctaacagttccagtttttggaaggcagcctctagtttcctattcagcctcatcatagctgttccttttggagagcggtggagaatacaggattgaaggtgaccctcacagcatgacaaattgtcaatctggctccctcagaaaccttatagggagtgtattagtcagctttggctgtcgtaagcaagtaccacagactgggtggcttaaacagcagaagtttattttctcacagttctggaggctggaaagtccaagatcaaggtggaggcctctcttcctggtttgcagaatcccaccttctcactgtgtcctcacgtggcctcttttctgtgcacttaagggagggagagagacagctgtctggcgtctcttcctcttcttctaaagacaccaatgctacctattagggcccatctcttatgaccatagttaacttccctaaagggcctatctctacatatattcacattggggattaaggtttcaacatataaatttgggggcctggggagaacacagttcagtccataacagagaggaagaaagagattcttaaaaagtgttctcttctgcaagttgacatttctgaaaaatatgtttattctccaaatttaagagacttttagaaccaattacctgtgaaattttcttttccaaatgaccgaaactcaactcaaactagctgaagcaaaagtggatattttttggctcacatagcagatggccaagggtcagatatgtcagccacagctggatccagggtcgatgtcatcaggtctttgtcctccccttgagctctgtgtccccccatgttggcccctcctcaggagggtccttttcctgtggtggcattgattacctggggcagctccaggctgatctggcccttagaatttgcagctttaaatggagagaaactgtctcccaagagtcaactctgactgcccccgcctgggttagggatacatattagcagcctggacccagggcctatctgggtggttatgggctggcattcccaacagctgggagaggaccaaatgaaagattccaggcagatcaaactgtaaggcatgtccacagtcttccccttctaagtttctgagctaaaacaacttatttgtcctttgtgacttgtataattgtataattgatagtccagagaaggtccaaattagttcatctttatatgtgtaagagattctatctaaaggtcatcagaacctttttgaaagtcaactgatgtcatgttggcctttgctggtgtttctctgcagactctccggacgacccagccttgtcaccacctggagatttggctccagcctggctaaccacaggctgttgacatgatggctgtggtctctctgcactcctcctccaacctcccccttctctatcctcttatgcatacctattgttgtggtctaaatgtatgtgtcccccccaaattcatatgttaaagtcctagcccccaaagtactagtattagaaagtaggtcttttgggagctgattaggtcatggaggcagggccctcatgattgggattagtgcccttatcaaagaggcttgagagaggtctctcacccctttcaccatgtgaggacacagaagacaccatccatctgtgaaccaagaagtgagccctcaccagacaccaaatctgccagcatcttgatcttggacttcccagtctccagaactgtgagaaacgaatgtctgttgtttatcagccacccagttggtggtattttgttatagcagcccaaatggactaatacacctaatgtcacccatctcatgtgaatgtaggtgctcatctcttgcctgaaattcttggggtcaagtgtgttctggaactcagtttctaatttcagaaaggccatatcgtatacacactgtttactgacacccttagcagagtctgggacagcacccagaaatccatctcattaacatttctgcagagaaacacgtgaacattcatactacgtaggataaagaaaatcaatagtagccttatatcagttcaggtcaggttttgtcaccaaacacattacgagaaaggtttgttctcagggcttttcgtaatttcagaattgtaaacaagggatcccgaatttatattttcttgtatgcattaagtgctacctttgttggactctcagcagctaggactggtctccataaaatttaaaacttaagaaacattttaacttaaagcactttaagcagcactttccaaagtttaaagtatgtaagtaaatctgtgtgagtagataactataaagaacaaactttcagccaatatcttcactttgagtggttactggggggcaaagaattagaaagccactatgtataaaattaaacatttttatttgttcatttctttaaagtacaacttattttccgggagaggaaagtactctcaccaaagaagatttttacagagagaaatcaggtcaacttgaaacttgtttgcaactctctatttgtaacaacctttgtggggttttcataaaaggattttccaagtcttttgtcttcaagaacataaattagaggacactcttaccaggagtacatgcagtttaagtacccaaaaataagtttgtttaccacttagaatcatggagttcaagagaattttcaagtttgcaatcctgggtctctcccagggacattgagagggcagaatcgattctagttttgctaatgcgcctgccaactggtgtcaccatttcccatcacgatatctcagttatcccatctgtcagctctaagagtctttgatgtatttcaacataccatgctttcaggaacctctcggtaccacgttctggtgcttggcagctgtccaggatgaatttgatgtacctctccctgatgcctgccaggagggagttggaggaggggcttaaaggattttctggtaaatccaaatgatcacatatgagctgttatcaatgtgggagaatggaattaggggatagtcttctcattagaattgtgaaaattcaggatggtggaaatactcagtatgaagattttcaggttggctaagtgtatgtgaaatgtcctaatttgaaaaacactttggatttgattgaattagtggtgttaaattagtggggtgtggtgggcatggtgacacggtgctgggcatccttgcatacatgacggatcagaaaaccagcaatccaggcaactctgtggccaatgcggcattttgggtccaagccccttgaccctgtgtctctctccttgcttcatgggaaatcctgccacctggctcagacacaggcctgggggttaaatggagcatgtgctgccaggtactggtcagtgccctcaagggtggagaagacctcttgggaaccacagacaggctgtagggttgtcgtgtttgtctgtttttaagtgacaggctgcttgatctcatcccattagtagtgacgttgctagaggtagagcttgcaaccacccccttcccattaactctaccatcaccacctgccgctaactactgacggctacccaatggccacaaggcacataatattcacggagagccaaagtggcttgcctgtgtcattacagtagctctccttgttaagagtctcttaaccatttccctccttcccacaccccactcttcacacatacatgtacatccctacctgagctagagccctgcttccatccactttcctggccttccccaagctgcctgtgcaaagcctcccttttctgctccctcagcctccggtttcttcctttttctatacctttccccaacaatttcagcctttattaaccttttccttctctaactatcagtcctatcgcttttttgggggggggggcgggaggcaggtgggaggtgtacagctcctcatacttgctgttctgtttatgtatgctctatagcaaactatccccaaatctaacggcttaacacagtaaactgtttccctatcatcactcatgattttgtggatcgggaattccagccggactcagctgggaaattcttttgctcctcgctgtattgaagggggtcgctggatactttcactgggcagatgggtgaactggaggtgattaagatggcttcacatgcctggcgccttggtgggatggctggaaggcatgttcagctgggtgtgtccactggggcttccacacatggtggtctcaaagtagtcagacctctttcaggtagctggcttccacaagagtgagcatttctagagaaaggaagtgtaagtggccaagcctcctaagcctgggcccaggatcctctctgctgtattcggtggttgcacagttatgccgtcctcccagtttttacctagcccccacctctctgtgtgttacaacaaagtctgccaccactattaatcttccacacgtgcctcctccattctcgaatgttcttgaagattatattgctttctccaaacctaaactgtctcataagtttttggcgcttaagacaagtttcaagaaataagaattgaaaagtgttggaggaaagaaagtttccatctctaaccactttctcagaagggcatcagggtttttgcagcaatgtggggatacctcttctgatctcatagcttagggctctgaactaaactgatggccttttctagatttcttcctaggggtgtcaggttggaagtgctgagggactgctctttctccccagggctcagctgtgtcaaggctaagaccaggagtggttcccacagccaggctgggtgagggcaagtttatcctgcggtgcagcacctcagaccagggtctagccaatggtggcctgcaggctgaccccagtccaccacctgtgagcagccaccaccacctgtgtttatactacccatgagctaagcacgattgtcatattttgtttgtttgtttgtttgtttgtgaggcagagtcttgctctgttgcccaggctggaatgcagtggtgcaatctcagctcactgcaacctctgcctcactagttcaaatgatttctggctaatttttgtatttttagtagagatggggtttcaccatgttggccaggctggtctcaaactcctgacctcaagtgatccgcctgcctcagtctcccaaagtgctatgattataggcatgagccactgcacccagccaatttttatatgtttagatgattgggaaatagattttaaaaagaataatatttcatgatacataaaaattataatgacatgcaaatttcagtgtccataaataaagtttctttggaacacagtcatgctcattcgtgtacatggtagctgtggctgctttcacactgtgagagctgggttgagtagttgtgacagcaattattagatgacctgcaaaaccaaaaatacttgctatcttgctctttacagacaagtaacttttttgctgttcttgccaaagaccaaatgcatttttcaaagctggattccaggctcagagttacagcaaagagaacagaaagtatagctcatgattgggtgctgacaggacaagggagagagacgaaaaccattaggagcattagcaacaaatatattttttgccattccaactccatggagcaaatggcttcctaaaagccagcagagaaactaattacctgaactgggagaagaatgaaagactcattgttagaatattcctcagagctgaatcccttctttcagcctactgtattttagtgattcctaataaaagaaaaaaatgtatttttgtcctcacagccaattaatttctgctccaaagcatagaatatgattatttctgtcattattttagtttccagagtcattgatgagacagggaatgacacatacctattaacacactcgcacactcactcacacactcgtgtgggtacatgcatttccctagaagatgtactggaaggatctgactttactttcaggtgccttcatgtcctcgcaattattctacaaatggtttttaagatatttctattgtatttgttgaaattttcctgacattttgacttgtctagacgattattcttgcatccagcacattgtaggaaacactcatttgaaataccccactgtgcttccgggggagctcatctttctggagcatggcgggtccctcatgaggccctctttcgttaaccgaagaacaagctgcagtctgaatgtgagttgttaaaggtatggtattgggagttttctgttctcctgttttcccattctgtaatgttttctttctttctttccttcatttcatttcatttcatttcacttcatagcaacttttgaatgaaaacctccccacagggtttgacaggcaatgaaacttcctcccttgggaggtgtctcagcctgagggaaatggaacagcaccccacagaggattttcctcacttcctccctctctcctttacaaatcaatgttaaagagcctgcatggatgtggttagcaccatctctgccgcatgtgacttttcagtcattttcacccgaaataggatttcattcaccagttactataagctactcgtgccttctaatggactttgcagcagtgattcatccaccctgtgctgggagagagaaagagactttaggtgagaaagaatggttgggagaggggagacaggtaggcagaacagttgtggtaccatcccgccccataagacaataatgatattcagtgttaggcgctttataccaagaaatattccacctgacacattatcctggttgaatcttatgacacatctgcaaatagacattaccaaatacagagggggacttttaggttcagagaggttaagtgacttgcccagtaacacactgctggcaattcgacctgatctctctctttcttccgccttttccatttcagtcagtggcagtgccatctttccacctgcttctgtcaaatgtgttggtgtgatttgatttcttttctgtttctcttgtatcttttaatccagcaataaatccctgctggctctacttgtaagatatacccagaatctattacctccgcccccccaccacccaccttgctccaagcctccatcatctctctcctggagcactgtgatacccttcttcttggtcatcctgcccctgccctgacttccctaaagttgatgcccaacacacaggcagataaaccagatcagacttgtgactgttttcccattctttgggcaatcccattgcattccagataaaagcggaagtccttagagtactgcagtttgcctcctagcccacgttatctctggccttcctttctcactttctccctccattccagccacgttggcttcctgctgtctcttgaatagtcagggcctttgcccatgctactccctctgcttgaagcactcttatcccaggagactgcatgattgagacccttacctccttcatgtctttactgaaatgtttttacagtgaaacctatcttaaatttttttttttttttttttttttttttgagacagagtctctctctggagtgcagtggcacagtctcggctcactgcaacctctgcctcccgggctcaagggattctcctgcctcagcctcccaaatagctgggactacaggcacccaccaccatgcctgattaacttttgcatttttagtagagttggggtttcaccatgctagccaggctggtcttgaactcctgacctctagtgatctgcccaccttggccttcccaaagtgctgggattacaggtgtgagccactgcacccagcctttgtatagctttaatgcatcaaatatgggcttagttcctcatgtaaacaattctcccaggaaattagaggataaaaagttaaaaatagcatatatgtcctgccctcaggaagtttacgttttgaaggggggatacaacaaaaagctagaatttgtagcagcgtacaacacatgccaataaaacttgcaactcaagccctgtgcacagagaaccatttggcagaaattctagagaggcttcctggaggaggtgctagtagaggagaccttgacaaatggggatggatctagatcaaattcccctatgccacgtgctcctctttgcgttcagaatgctcttgtttgcaagatttcagccatgtacaactcttctggcactcagccatggactaaaacgaggttcatgcccacagtattggtctgcagaaaagcatgagactggatgacagtcagaacaaatggaatcctctagggtagggagaagagaaagaaagaggaaataaaacagcataatcccaggaactgccaataggaaaggatgggagaaaggacaactggcaaagactctgatgtggtgtccagcctttcagatgtcacctgaggacgttgctacaattaacatgcagccagacacacacagtgactacacattttggtgtggttggcggcattagttgagtcttaaacaaaagcaatttcagttgcaaatcttgtgccaggctttcagagaaagagaataaattatgctgctgtgacaagctgttccactgtggcaacaatagtttggacttccagtgctgcctgtcaaccaggactgaaaatacatcttcatttgttgctgggcagctgggaagatgagtcattaaagaattttataatacatcaaaggccatgattttctacctttcacgcagttacaccttttcccaagtcctcattctgccacaaaaaacttttgaatgcaccgaaagttaagtagaattccttttaaaatgttctgttctgtgcacatatctctaggggaagtgcagaagacatggggcattcccttttgtcatgcatttcagctccataaagatttattgaccacctactatatgccaagcattatgttagtcagtggggttaaaaagatgagcaaattgtggtcttgaaacccatgccttttgttcagattattacagtgcaagagaagcagcatcagccatgtgtctgagaggccagaggaaggagagagtgaggaaatattgtacctcattaatattgttcctctcgtttcaccactgtattaatctgttctcatgctgccaataaagacatacccaagactgggtaatttataaaggaaagaggtttaatggactctcagttccacatggctggggaggcctcacaatcatggcagaagttgagagaaaagcaaagggacgtcttacatggtggcaggcaagagagcttgtgcaggggaactcccatttataaaaccatcagctctcatgagacttattcgctaccatgagaacagtatggggaaaaccacccccatgattaacttacctcccactgagtccctccacgacacatgggaattatgggagctacaattcaagatgagatttgggtgggcacacagccaaaccatatcaaccactgtagacatgaccaagttcagacttggtcagtagtcaaatgagcctgtgagagaatggtgccacatctttcctgtaagagcacagcattttaacctgcgatggatttgtgagcagtcattccaactctgtattagttttctacagttgctgtaacaaattaccacaagcttaatggcttaaaaccatgtaaatatattatcccacagttctgaagtcagaaatctgaaatagataggctaaaagcaaggggtgacaggctgcattcctttctggaggctctaggggagaatctgtttccttgccttttccaacttctagaggccgctggcattccttggctctttgccccttcccttcttcaaagccagcagcagtagttgagtcctccttaacacagcatcactttttttttttttttttgccttcttcttccacttttaaggactctgtgatggcactggggccactgggataatcgaggataatcttcctattttaagaacagccaattgacaaccttaattctaagcaatcttaattcccttttgccatgtagctgaacatatccaagttctggggattaggatgtggatgtattggggtggggaaattattcttcctaccaccaaccctcatccatctctaaaggcactgatttttttgataaatcagataagtaccagagatgtgtactctgggctcaggagtgaagagggttagctggcctttgccaacagtgacttcatatcaccatactcaatgcaattgaggtgacttaatcaaggggaaaagatggacagcatgttttatggaaatagcacttgcctggtaatcaggagacttggattttagcttctctccttcaaacagactactgagtgtcagtaggcaagttgttgaactgctctgggcctctgtaaaaaatcaaggttgtggttagatgttctcaaatcctctttcatcctctagccttccatggctctcaatttctacagggaatgtactggaaatggagagaggctagcctgtggaaaatgcagtgccattatttcagcatcaaaatcctgaaataagatacagaatgttgtgtaatatacagctcggtgtctgtgcccttttatttctctcttgggcccagccccatcatcctgtccttgatcattgtaatgcagtgttcactaccagtcttttctccccctacattggaaattatgccaaaagagtaatgaatgaattaggtaaatgaattagatgaattagagataaaattatggctctacagttgaaatatcagctttaagagaatcgacttggagaccaggtgcaatggctcacgcctgtaatcccaacacttagggaggccaaggcgggtggatcacctgatgtcaggaatttgagaccagcctggccaacatggcaaaaccccatctctactaaaaatacaaaaaattagcagggcgtggtggcaggtgcctgtaatcccagctacttgggaagctgaggcgggagaatctcttgaacctgggaagctgaggttgcagtgagtggaggttgcagtgagctgaggccgtgccattgcactccagcctcggctacaagggcaaaactccatctcaaaaaaaaaaagaaagaaagaaaattgacttggagatgtacgggttcacatataattgaaagtgagcattccacagtgacttgagaaagttgattccggctttcaaagcttgcattatgggtaagaaacttgagcctaaaaagaacttatatgtatgtgggtcattagacaatctcctccctcaccacctttttttttctttaatcaaagaattatacatatgcaagtaactgaatcacctcttctttcatttttttccctctttaatcacagctgtgtggaaagtttccagctaggcattaaattgggtcaacagctaacacagcataagtgtggacagcaggggcaatcggtggtatatacataggaaataaacgacactgtgctgctggcattgataagctgttgaatagtgcaagggccctattaagatttaaagtaataaaagatgggaggaaatatggttaccagcagctgataaacattcttgccttatgaaggcattagtttcacttaatggcttctagtgcctggagtataagctcttgtaatttttctcccccagagcagactgaaagaatacctaggaattgtcatctttgtagttgctcaagaaagatctttgggtggctgtgagcagatctgaaaatagtaagtatggcaggtacatggagctgcatccgtttgcaaaagctatcaataaagaaaggtatagaaaggatgcccttgaccccggtatgtgcagatagaagtggaatttcctccggaatgtgcatgcaaatgtgcctagctgcaaaagaagaggcattccctgctcaggtgtgtagagtgatttagaaccatttgtttctgctcaatggttctcaaatgaacagtatttcctcactaggaaacagtgctaattccaggctaggacggtccacagagatggtggctgtgcccagatcattcttggaaatctgaggaagggagtcatttcttctcatgccacacccagtaaggggtacattagatactctatttcctccaggcagatctacagtgaccaggaccacgtactaggataggagaggttctggcactattcatcattggctccggaaatagctttcccctctgagctcaaaggtaggctcatcctctgctagagtctattaggtctggtgggattggaactcaggtgcatacccctgggctctccaaccactagtgctgcatccagggcttggggtcctgctttgtgccatcaggtcatcagtgacatgactagggcagctcaacccgcacctctggcatcactgccttcctcccatggccccctagcatgaacccaaagaccacagggccggttccctccttcaggcccaaggctgggcctccaaataatggcctcccaaagatgcccacattcacatgcccagaacctgtgcatatgttaccttatgtggcaaaagagactttgaaaatgtgagtgaattacaatatggagattggcctgggttatctgggtggactcaaagtaatcaataagagggtgacaggagggtcagagtcagagaagaagttgtaatgatagaggcagggagccatgaaccaaacagtgtagacagcctctagagactagaccaagcaaggaagtggattctctcccagggacttcagaaggacctcacccctgccaactcatccgaggacttctgacctccaaaagtataaaataatacatttgtgctgctttaagtcactgagtttgtgataatttgttataacagcagacagaaactaatacagtttatcttattcctttactcatgatcaactactttggggttaacgaacaacagtatatttacttccttcaatgaaacacttacctccacccaccagagtgaaagtttgtcaccctggttccaacaaatgccacaaaccactgtatgatcatctttgggtaggtcagcttgtctgctatggtatttttcttttatattgcagtttacaaagtgctcatttgtcttgtatgatagttatatatggaaggtagcattactatttcacttttctgattttctaaaaaatatctttaatgaacacatattaattttgtgattaaatgacacaataattagaaatgttaaaaggagatggcagttttagtcacttaataaccataatactaacaaattcaggccacatgctatctcagtggatagtccccagaaccaagttaggctagttcatgaggcatttcagatagctgaagggactaagtatacactggaagattgggtacgaagatcaaaagacagctctacaacaaagcttcatgggccattggtttcacagtagggggaactgaaatccaggctacagattcaaaagcttacaacctggcaatttatgtagcatagggaatcaatgtctatagtcttaattacatagaggctaaagcctcaattattctatttctgtaggcaggattcctacataatctatagcatctattggcataaaacattcttagtggccattctgggtacaagcatcccatttctctttctgtccttccacacactaccagtgtctctcgcttatttcctcccaactctaatgttcatatgtgggttatttgagcttctaagttaattccttgcctatatgtaaggaacatattggaaaattataaccaaagtgtagtatatattgcagagtctctacttcccatgagcagctttggagggtacctcacaggagagggttagctggcatctttccattaggaagccagcatcagcacaaggggaaaacttctctccaacgtctagacctctctatcccatgagactttggggactgggactgggtagcagggcagaattgggggaaggaggcacttaagagctttttaatttcaatattctaaccattagtgagggtgtgctgctgggtacatgtctgcccataaataaacatggactgttcattgaaacttgcatttttatgtagaaaagctcatgctaccttatcactttttgcacaaaagttgacacattatgaatgctttaaaaaaaaaattataccttactcccatacactgaacatatctttcctcatctaaaactatccaagcagccaactttttaaaattaatggaaggagagggtctacagcatgtattctcaatgggggcaatgtagccccctaagggagccaaaattggttctgggttgggagtggtgaaaaaagtctttaaaaaaataaattgcagaatatacatgcagcacatagattgatatatatatctgtgatattaaaatttcatatggaggtagttgggaaaaaatgtctaaaaaacctccttagggtgatatttgatatggttttgctgtgtccccacccaactctcatcttgaattgtagctcccataattcccatgtgtggtgggagggacctggtgggagataattgaatcatgggggtggtttcccccatactgttttcgtggtagtgaataagtctcatgagatctgatggttttataagggatttctgctttcacttctcattttccttcttgcctattgccatgtaagatattccttgctcttccaccatgattgtcaggcctccccagccctgtagaactgtgagtcaatcaaaactcttttttctttaataaattacccagtctcagatatgtctttattagcaacatgagaagagactaatacaatattgaaaaaaaaaaagttgagaaacactgatctatagtaaaatttaaatatccaacttctactatttttttggctgtccattcccagtagaatacaagttccatgaaggcagggatatttgtcttttttgtgcactgatttctcctaagtgcctagaatggtgcctgggatgtaggaggtattcaatccatacatattgaattgaatgcatgaatgaacaacttccctcagtgtcccagagtccactttctctcaacactgcaagtggtggcaagctggaaggtttgtgagcagtgctggagctgggctcttccaggtgcattcacaatagtttaaaatagcaggtgcatcagaggaggcctctttgttcctggtactatgctcattgatgtttactatgagccccttgcagactcaagcatccattgtttgccttttaaatatctctactagccgggtgcggtggctcacgcctgtaatcccagcactttgggaggccgaagcgggcggatcatgaggtcaggagatcgagaccatcctggccaacatggtgaaactccctgtctactaaaaatacaaaaaatgagctgggagtggtggcacgtgcctgtaatcccatctcctcaggaggctgaggcagaagaattgcttgaactagggcatcaaaagttgcagtgagccgagatagcaccattgcattccagcctggtgacagagagcgactccatctaaaaaataaaaaaaaaaaattttaaatttaaaaatctctactctccaggccaggtgcagtgagtggctcctgcctataatcctagcactttgggaggccgaggcagtcagattgcttgagttcaggtgtttgagaccagcctggtcgacatggtgaaaccccgtctctaccaaaaatacaaaaattagctagacttggtggtatgcacctgtagtcccagctatttgggaggctgaggcaggagaatctcttgaacccagaaagtggaagttgcagtgagcaaagatcatgccactgcactccagcctggacgacaacgagactatgtctcaaaataataaaataaaataaaataaaaatcctctactgtctacttcccccacccctaatatcctagctatgtggcccaagtacttatttagcccagtccatgaaagtaaaggacagtggacagtgtcctttgataggaggatggggcagaatgggaaaagaaaatggtagggtctggaggtacaagtgggggccagagagaggggctttacagattattcgggtgtttgaaagtcagttggtgttatctttaacatacaaacatgtattatgaatctctgagcatccttcaacgattcctgaattttcaaaacagttgtgtccaaatgacacaccttgtccagaaacaatttggttttgatagaaaaagaggcaaaataaaaacactgatttacaggctcatggtgaggggtttggggaggcagatgagaagagaacctagaaaggatgtcaagagcagacttagctgacctcactttgctttgggcttgctttcctacagacattgacagtgagagttgtttttgctcaccacactgggaatatgtattgcttaggagacacatggcagttaaggcaaacagcacatgccaacaatatgttgcatgatttgatgcctgttttcagggaacttcactaggaagtgtgtgtgtgggtttatatagccacgtacatacatatacatttatatatgttttatatacttagaaataaatacggaatttgttacaggaacgtggccttacacaatcatgggagctggtctgccatcttcattaagccattgtctggtacagatgctggagtttgaagtctgtaggataggaaatcagatgttgtctcagttggcacctgctgcataatacggtaccatagactaggtggcttaaacaacacacatttattctctcatacttccagaggctggaagtccaaaatcagtgtcttgcagggttcggtttctggtgattccccacttcctggctgtgggcagtgccctcttgttgtgtgctcacgtgacctcttctttgtgcacatgtggagagaacaggctctccagtgtcttcacttataaggacactcatcctatccgattgagaccctaccttatcatcgcttaaccttaattacttctgtaaagggcgctatctccaaggacagttatattgggattggggctttaacataagaattttgcagggacatgaattgcagtccatgacagatgtaaactttgagaaacaggaaaaagctggaacctacaagcagaagtgggaacctgtgaggttggactgaaactcagatcagttcttgctgcctctgaccttgatgtatgtatcctggaggagatgctggcatctctcatcatggagctaattgtaggacaggcccagaaatggaagaagctggaagagagtctagtggaaggtggggcagcgtgggcccagctgctgttgcctgccaaagaggtgagcagcagataagtgacgaggtatgtgagctcacacacccaatccactgtggcacttctgccttccagatcctccataagaaggtctctttggcctactctgctcagaaatatataaggcaggagattctgagaaatctagttgagtccagccacgttgacatgctacaaagccaccacagactctaaggagaaattatgtccagggttgggagaagagagccattagctgtacttggatgaacagttagtggcctagaaactgatctagaaagggatctctgttgatgaaaaaggacagtggtgtaaataaaggaagagtgatttggcgatggggtgttggttcagagttaaagacatgagaatgacaaagaaaggacaagggtggcaattgagatagatgcctttattaagtatagggtatagaagtgtagaatagagaagacaaagaaaagcaaaagaactgaatagctagaatgtattaatgcagggcatcaggcatgtggagccagctaaaaagtgagagatcaaacaagattcttagagcaagagaacatcagtaggaactagccacatttatttcacggactcaatgatactgagtttctactactacagggtactgtgtttgatgcacataaaaattattaacatgtattcctgcttatcattattggaggcaggggttgtgaagtcagcatggtccccaccgccacgcccccaccccaggccaaactctaaaggtatttacctgggttttctttcgaaaaaggaagaggtcttattttttttttttatgggagctgagggcagtggataaatttggaaccagacagttgaagtattaccataagcatcagaaaaagtgaataggtttttaaaataatagggaatagagatagaaagcaatcaacaaggcttgttttagaattaaaactctacaaagtaaaagatgtagcctgaatgacccttgaaatcacatgtataatttatagcacctgattccctccaagtcatggtacagaaaatgtatgtctcagctgtgccatgctggccaatctggtctagcctcaggcttgtcacatatgaagtggtgatgacatatttatatcacagaacaattgtgaaaaacaacggctaatgtagttactcaacaaatgtagtgtgcactaaccttatgctaggcactattcccggcactagggacacagaaatgaagagagaaacaatgtcctcattctcgtggaacttgcaaggtagtcagaagagacattttattatttaatctctcactgtctaatatcatagaaatcatacattcacattcatccagagagatagttattattacctttttcacatgctgaaacagaggttacttgtctgagacctcttgctatcaagtgttaaaggtgagactgagtccaggtcttatatgactccatatgcccagcactcttcaaacggccaaatgcctcgtcccacagaaaatagaagcccacagtcctcatatactataaaacttaaatagaatacattatctcatgtggacagatggttatgactttataaactaggaaatcctatgtaggcagatgtttagttgatgaaaagaagtgtaaacatgaccctaatgaatacatgttctgcaagttattggttgctattaatacagagatagttatgctgtattaacggacaaataaggcatatgtagcaagctaaaaagtgagaagtgaaacaagattctttttttttttttttttttttggagacatagtctcgctctgtcatccaggctggggtgcaatggtgcaatctcagctcactgtagcctccgcctcccaggttccagtgattctcctgcctcagcctcctgagtagctgggattacaggtacctgccaccatgcccagctaatttttgtatttttagtagagctggggtttctccatgttggccaggctggtcttgaactgctgacctcaggtgatccgcctacctcggcctcccaaagtgctgggattacaggaatgagccaccatgcctggcctgaaacaattttcttaaggcaagagaaaccactgggaactagccacatgtatttcatgacttcaaatgatactgagtttctactactagaggaatacatgcaatagaggaaataaaagggggtgatgggatcgagtgatggaggagaagatctctttagactggttggtgagggaaggcctctgtgaggagactattgagatatacctgaggaatgggaaggaggcagatctctgaaaatctggaggaagccctttctaggagaaggaacacacaagcaaaggccctaaggcaagaatgagcttggtgtccttggggaacaaaatgaagatcagagtggctggaggttgctgagcaaatgggacctggttaattcatgcatctggaaaggtagaaaggagctagatcctgcaagtccttgcaggccacagtaaggaatctgaattttgttaatatataagacacaaggtattggaagacacaaagtcatcggaagattttaagcgagagtgacaggccattggtattttttaaaaaatcactgtggctgctataaaactatcacttatggagcaactgtaggctttttgctctttttaaagattattgtgcattggatcattcatggatgccagacttgaaatgaacaagatggggaataatggggaacttctggaatatcagtaaaaataaagaagctgctaggatcctggctacagtgtgaacccttgagttgtggcagccgtgagagatggatgtgatggctgtttggtcctgcgagtcacttttctctatcaaatatacttgaccttcatgtgaccctttccatctctttgtgaccaagtaccaagtgataagcgttaattaatttttgggtcactgtgacagatcatcagtgtgctacacttttcaggtaacaggtttccgtgaaccatttgcaatgcccaaattataagaaatcccttaatatctgactctaacagagttgcagtttccaagtctatagcatcccactaacagaggggttggaagacaagatggagccacaaaggtagcagtggcaacccgtccacccctgcttaatgctactcctggtttaagacatgagcccaatttctctttagctggtaggatgacagaaaaagttttaacagcttttttgaggcataattgatattaaaaaggacacatatttcatgtgtacattttgatgagtttggacatatgcaattacctgtgaaactatcatcacaatccagggaataaacatgcctgtcacctccagaagtttccttgtgcccccttgttgtttttgtttgtttgtgtggtagaacacttaacatgatatccaccttcttaacaaattttttaagcgcacaatacagtattgttaattatagggactgtgttgtacaacagatctgtagaactcattcacctttcataactgaaaccttctacttgttcagtaataactccctatctctccctacccccagcccctggcaaccacgattctactctctgcttctatggttttgactattttacaatcctcatataagtgtgaccatgtagtatttgtccttctgtgactggcttatttcacttagcatagtgtcctccaagcttatctatattgtcacgtatttcagaatttccttttttaaggctgaataatattccactgtgtgtatagactatattttctttattctttcatccatcaatgagacacttaggttgtttctatatcttgactattgtgaagaatgctgcaatgaacttgggcgtgcaaatatctcttcaagatcctgatttcagttattttggctatatacccagaagtgggatcactggatcatatgatagtgctatttttaatgtttttaggaatctctgagatggtttggctgtgtccccacccaaacctcatcttgaattgtagctcccctaattcccacaagtagtgggagggacccagtgggagataattgattcatggggatggtttccccatactgttctcatggtagtgaataaatatcatgagatctgatagttttataagaggttttccctttcccttggctctcactctctcttgtctgccaccatgtaagacatgccttttgccttccaccatgattgtgaggcaccccacccccagccatgtggaactgtgtgtccattaaacttctttttctttataaattacccagtctcaggtgtgtctttatcagcagcatgagaatggactaatacagtaaattggcactgcgagggtagggagctattgtaaagatacctgaaaatgtaaaagcaactttgaaaccaagtaacagggagaggctggaagagtttggagggctcagaagaagacaggaaaatgtgggaaagtttggaacttcctagagacttgttgaatggctttgaccaaaatgctgatagtgatatgaaaaatgaagtccagattgaggtgttctcagatggagatgaggaacttgttaggaactggagtaaaagtgactcttgctatgttttagcaaagagactggtggcattttgtccttgccctagagatttgtggaactttgaacttgagggagatgatttagggtatctggcagaagaaattgctaagcagcaaaccattcaagatgtgagtttggtgctgttaaaagcattcagttttgaaagggaaacagagcataaaagttcagaaaatttgcagcctgatgacgcagtagaaaaacccattttctgaggagaaattcaagccggctgcagagatttgcaaaagtaacaaggaaccaaatgttaatcaccaaggcaatggggaaaatgtctccagggcatgtcagataactttgctcccattacaggcccagaggcctaggaggaaaaaatggcccccccacctgctatgtgcagcttagggacttggtgcccggcatcctagccattttagccatggctaaaaggggccaaggtatagctggggccatggcttcagaaggtgcaagccccaagacttggcagcttccacgtgggcacacagaagttaagaattgagttttgggaacttctgcctagatttcagaggatatatggaaactcctggatgtccaggcagaagctttctgtaggggtggggccctcatggagaaccctttgctagggcagtgcagaaggaaaatgtgggattgaagcccccacacagagtccccacaggggcactgcctagggaagttgtcagaagagggccaccatcttccagaccccagaatggtagatccactaacagcttgtatcgtatgcctggaaaagccacaaacactcaaagccagccctgaaagaagctgggaggtaggctgtaccctgcaaagccacaagggtggggctgcccataggaacccacctcttgcatcggcgtgacctgaatgtgagacacagagtcaaaggagatcattttcaagctttaagatttcactgccctgctggattttggacttggatgggacctttagccccctcattttggccaatttctcccatttgggatgggtatatctatccaacgcctgtacccccattgtatctaggaagtaactaacttgcttttgattttacaggctcataggcagaagggacttaccttgtctcagatgagactttggactgtggacttttgagttaatcctgaaatgagttaagactttgggggactatagtgagggcatggttggctttgaaatgtaaggacatgagatttgggaggggccgggggcagaatgatatggtttggctgtgtccccacccaaatctcatcttgaattgtagctcccgtagttcccacatgttgtgggaaggacctggtgggagataattgaatcatgggggcagttcctccatactgttctcatggtagtgaataagtctcatgggatctaatggttttatatgggttttctctttcacttggttctcattctctcgtctgccaccatgtaagatgtcctttttgccttccaccgtcatcatgtggaactgtgagtccattaaacctctttttccttataaattacccagtcttgtgtatgtctttatcagcagcatgaaaatggactaatccaatctccatactgctttccatagcagctacaacattttacattttacatttccactaacagtgtacaagggttccagtttctttacatccttgccagcacttgtctttttgataatagtcatcctaacaggtgtgaggtgatatctcattgtatttttgatgtgcatttctctcatgattggcaatgttgaccaacttttcatatacttgttggccatttttatgtcattttttgagaaatgcctgttcaagtcatttgcccatttttaaatttgtttattttcttgccattgagttgtagtaggagttccttatatctcttaggtattaaacccttgtcagatatgtggtttgtgaatattttatcccatttcataggctgccttttcactctgttgattgtttcctttgctgcacagagctttttaatttgatgtagtcccacttgcctatttttgcttttgttgcctatgtttttggtgtcacatccaagaaatcattgcagagaccaatatcataaagttttgccccatgttttattctaggaattttatagtttcaggtcttacatttaagtctttaacttactttgagttgatttttatatggtataaagtaagcattcaatttcattcttttgcatataagtattcattttttgcagcataatttatcaagggactaacctttctccattgtatattcttggcacgcttgttgaagatcagttgactgtatatgcatgaatttattgctccactgtctcttctgttccattgatctatatgtctgtctttacgccagtaacatactattttgattactctaggttcgttatatattttgaaatcaggaagtgtgatgcatccatttttgttcttctttctcaagattgctttggctttttggggtcttttgtggttccatgagaattttagtattttttttttctatttctgtaaaaaatgcccttgggattttgatggggaaagcatggagcctgtagatcactttgggtagtatagatattttagcaatattgtcttctagtccacaaacacagggtatctttccattttttatgttttctttaatttatttcattgatgttgcctcagtttcagtgaataatcttaaaccttcttggttaagtttatcctaggtattttattctttttgctgctattggaaataggacccctcccctcccctccccttccctcccttctttcactctgttgcccaggctggagtgcagtggcacaatctcggctcactgcaatctccacctctcaggttcaagcaattcttctgcctcagcctcccaagtagctgggattataggcatgtgccaccacacttgcctaatttttgtgtttttagtagagacggggtttcaccatgttggccaggctggtctcaaactcctgacctcaggtgatccacccaccttggcctcccaaagtgctggcctcccaggtgcaaactaccacacctgaccaggattgttttcttaatttccttttcagatagttcagtcttagtacagggaaatgcaactaatttttgtatgttgattttgtttcctgatatttcactgaatttatttattagttctaacagtttttgtgttgagtctttagggtttactgcatataatatcatgtcatctgcaaacagagatattcttacttctttctttcctgtttggatttctttttcttgcctaattgctcggattaggactttcagtagtatgttgaaagtaagtggtgacagtgggcatcattatcttattcttgatcttagaagaaaagcttttatttttcgttagtataatgttaactgcgggattgtcatatgtgaccttttttatttttatttatttttttgagacagagtctcactctgtcacccaggctggagtgcagtggcgtgatctagacttactgcagcctccgcctccccagttcaagtgattctcctgcctcagcctcccaagtagctgggactataggcatgtgccaccatgcctggctaattttttgtatttttagtagagacggagtttcaccatgttggccaggctggtctcaaactcccgacctcaggtgatctgcccgccttggcctcccaaagtgttgggattacaggcatgagccaccacgcccagccaacttttttatattgaggtaaattccttctatacctagtttgttgagagttttatcttggaaggtcagatgctttctctgcatctattgagatgattgtgtgatttttgtccttcattctgttaatgtatattatatcaattgatttgcatatgtcaaactatcatcagatcccagaaataaatcccacttggtcatggtgtatggtacttttaatgtgctatggaattctgttttctagataggtgagactttttacatctatgttcatcagggatattcgcctatagttttcttttcttgtagtgtctttgttttgactttggtgtcaaggtaatactggccttataaaatgagtttggaagtgctttctctccttcagttatttttttaagactttgggaaggattggtgttttaaaaaaatatttggtagaatttgccagtgaatccataatggaaatattgtatataggtaatttagtaagtcaagaattgtccctcaaaaggtactagaaaactcagttcttacttttaagactcttctaattatcctggtggaatggcttctggaatatcaccataatactgaaatttactccataatactactgaatggaagggatccagtgctggaaactttacatttgaccaggtgcagccctcaatactaggacagtttggctagggggctacccccacaggtagcagggaagaaggctgcattggtttgactgggatggaagaagaataagctaagtagtctgtcagagtttgccaggttaaagaggaaagatgatagcacaggctggagggaggtcaaagtcacattctggggaaactagatgtatgttgaccagtaggggcaagcctagtatggaatggtgggtgacagtgaacattgagggccaatgagatttagagaatgaattgaggagtgaggcttaggggaaagaaggccgggcacattagaaggctcagaggtctaagaagcatgaggaagattgtcctccagagagctgtccccttgaaggaggtgcgttggcatgatcttgtcatgaatttctcaccctgtcagaaacatcttatgtagattttttaaagggcaacagttttcctgctcactctgagtacctgaaccttgattctaagacttaggtaaggttcacttggcctggatgtttataaatgccagtaccaaggggagtccttgaaatggcatagaagatggcaaagggctctgcagagccacgaaacccaaatttagaaatgagaattactaacaatgcatatacaacatgtctacaataaactagaaaggatgatatagtttctgataacagtctttgaactttccctacctatgaaatggtattaacccttaatcagcagctcaggaaatagtccacggtagatcctcatctttgtatttcctttactgtctggttacttactgaaaagtggtagctgaggccgtatctcctaacctgcatgctctccctctctattttctttgtctcccatgttctccctacaaagttagcattcattcattcattcttattttctttctttctctctctctctctctctcactctctctccccctccccgttttcctgtggtattgaaagcttattgtcaggatgagccccttattgcttggaacccaatctgtgtccatgaattgcccatttcacagaatcacgaaagccacgctgcttcctgagcaacacagctaagtggcattccccacccctgctcttagcaaaagttcctcaggacattattgttgaattactcaatgcctattatcatagaacctcatgttcacgctgggaggtagttactactacctttttcaaatgctgaaacacaggttacctgcccgatacctctctgctatcaaatgtcaaaggtgaaattcagcccaggtcttctgactctacatccagcattctttatagagctaaatctctcttcccacagaagatagaagcccacagttctcacatacttacaaaacttaaatagagtacattatctcatgtggacaggtggttatgactttataaactaagaaaatctaggcagatgtttagtcaatgtcaagaagtgtaaacatgaccctaattaatggatttgctgaaagttattggtctctccttgtcagaactgttgttttccctgtcacttctcagattggattagaaaaaattaagcatgaagaaaattggcatttaaaatgtgtttattcttcactatcaagacagatagaactttccattcaaaagagaatgaaaagttcattttggcatggtgaatcataaataagaaaaacagaatagagaaatcctaggacgatcaatctctcataaaataaagaaatcgagattttatcgcaaagaattctgcagcacataaaggcccttaggactggactgatctccgagttcaagcgttacacccagtatgctgcataaaccctattcagtgtttgggctcattctcaagaggttgacatccttcccattttcatatcacctccctggtccacctttgctaggtcacaggtttttcaggcactttgcattctgccctccctcctctcaaaagacttcccggcatgttttcgatagcttcacacctagcagatggcagtttttcttctgaccttctgccagccctcttccttcctcagcttccttcctctccacagcttccatttaaggtattttggaagtccctcgaaatgggtccttggtgagtaaacccctttattgagtctcggactttaagaagttcttggcttcatgggacccccttcttctagttgacacttttggggattgatttcaagaatcatctgttgctgataagtcagtgtggcttctattgctgcagaagcaaggaagaaactaggcatatagtggaagaaaatgcgcttaattagaaactggtcctcattagggattcttaaaggaagtgctcaatttgcacctatgttagcagagcctcacacggattaattaaaagctgctactctcaccagcaacacccttcatggctgggttgaattgtttgtagctgtcaactctgtgccaagggcaacaaggtttgaatctgagttctttgaaatgcaggttctttcactcactatgcagaatctagggatccagactctcaagaggcaaagctctggaagaacaggtggagtgagtatccctctggcttctgctcccgccagatgatcaccatgcctctcaactctacactcttttccctgcctgtgctccagttcacactctccacatccctggggccaggctatacctagatccttctgcttgatctctcaggctccgatgtttcaactcgtcattccctaggctattaacttcaagcccttagatggcattcaagctccttggtgacctctctgcgtccgtctccatccccatctgcttccgtgagcttcataggcaagccactctccatagttatatgtccctcaaatacccagcatccccatgccatcatttcaaccagactgtcctttttcttttcccacctaaggaaattctattagttcttcatggctgggttcaaatccacctccttcactctccaggaagactacattattcttttcctaacactcctgaagtgcttgtcctctacagcattgctgcacatattttgttctgttctttattacactagtccatatggctttactccctgctgaatttaaactcttcaagggcttgatctctgtcttattcatctctgtaacctcacagtacctaatcaagttctttgaacaaagccagtgttgaaaagtgtttgttgaattgagaacagcaagccagactttctgatgggctagaaagatatacctagaaagatagagcagagtagcatttctaaagatggaaaggacaagcctggctaaaatcatgctcaaagaaaggttttcttttagggtcctcatcacatcacaatagcaaatttttaaaaaaagaaagggccgagcacgtcagtatagttaccgagcgtacttgtgtactgggcaaagtactgagcgcaatagaaagttactaaaagaaagaacagatgctttttctcctttagagctggtcccttttcaaaataaggcctcaaagtgcatcccattattaaccctgaaatagtgggacacaaacgtccagatagatatgtgcatgccaatacgtgtttaaaaatctggcgtcacacagcacactccagaggaagccaagcctaagagacatgaacacagtaacacggtagggagccgtgtgatccagactgtcctaagcagaagaggccccgggtggagaattctcacactgacagccgcagagcctgccttccccagtgtactggttttcccagggcatcaaacattttatttaataagctacatgtttgagtcacaagcgtagacttgacacccctgtatggtcaactccagctgtcgtttgttctcctcccctctcttctggcacagtggctggaacctgtatctggtgtatcacaacgctccatttcgctgatcacacacagccagaagtgacagtcgcttctctcactgccaaggacagaggagactctggctggacaggagaaattcaggtcgaaccaaggcaagtgaacgatggaattaaaaacggctgagaaatcccatagacttagaattactcatatctgcagactagagggaaatgagttggtcctgatgacaaaacaaccctttcttttctctagtctgttaaacttctattttcccgtcagactgttttaacaatgccctctactgggtattttcaaaactgcagggttctgcaggcctgacctgctcttgttctccttgagtaattctttctgcaagatgaactgaacccaaagttttcttcacataagcaagatgttactgatgtatagtttcttaagagcataaaaagtggaccagtgcatcccctggaaggagggcctcttgccctcttgagagatttctttgtaaaggtgcatgaggaattgaaatctcaccacctcctgaactggcccagagctgtcctggcatggatgacacagggaccttgacatgggctgatggattaagaacaatgttacattttctgaacgcatcacttttccaacagctcttgatctcacatgtgaggctctttctcatccctgaaggctactgacttttccctggatatatttgtattgtgattattctgcatatctaagaatttcatccctttctaaccgctcctctgccaaaacagaaaccaaaaaaagccaaaacatcactctgtgctagttagtttctttgacccctcttaaagaaactctaaacaaaaaatctgcgtccagttatatccaagggggtgttcttactgggtattcccgtcagaacctcccatctgtctattttggttcattctttgccattatcatgtaacaagttcaagataattgtgtttcatctccagttattattcatagtccctctgcatgttgaagattgctgagacagcacagaaaaatagtaaagcaacagatgaggtctgtttgcaaaaaatgtagaacaattcgaggtgcaggatgttcttcaaattgtgatggggtgaggttttgaaaagttcttcggatgggctagtgtttgttttctctctccctctccctctcttcccccctcccctttccgctttcccacttcctctctcctccttccttcctccccatccatttctcttaaatagaaacaaaattccatatattcttagaatccataggatccatatattcttagaatccataggatccagcattgcattttatttaaaagcaaatgccgaccaagtagtcagtagcaccctttcagctccaatagttggtgctatattctgtactcagcagtagactcatttcattattttggagtatggacctgaagaaaatgaatatcagacatgggctaagccaaggccagttaataaatattttaggctttgcaaaccgtatagtctctgtagcaactattcaactctgctcttatagcaccaaagtagccacaaataatagtaaacaaatgggcatggctctgttctagtaaacttacttgtggaaacgggacaggctgaatttggcccacagaccctcgtttgccaatccctgggctaagctattgcaggggtactgctgatggatatgcgggctgtgtcctgtgtgacagtgcctagccaagggggcaagtgggacctgaaatacaacccatgctctgcttctccacgccttccaccacaagaggtcctttttgtaattcagacagaggtaccatttgttcacaggctgtctccaaccagaataagcacatttcctaatggattagggtacttaacatggtttgcataagtgggaggaagagggacctgattttcctgtattaggataagggttacctttgatcccaatggctgttattgaaatgactaaagccacatggttcaaacatggctgccttagcccacatctacagactgggagtaggtggtgggagcaattccaacagagatgtagactgggaaagtgccccaggtaagaggaaccccaaagaaggtgagtttattggttagggggcttgttggatattattaccaaagccatagtccctttatgaagtttgttctgtccaaaaatgtgatttaggccactgtatgagtccattctcacattgctgtaaagaaatacctaatgctgggtaatttataaagaaacgaggtttaattgggctcatgttgctggaggctgtgcaggaagcatggtggcatctgcttggcttctggggaggccttgggaaaacttagaatggtggctgaaggtgaaaggaggagcagcacttcacatggccagggcaggagggagggagagaggggagctatcacacactgttaaagaaccagatctcgtgagaactctatcatgagaacagcaccaaaggggtggtgctaaaccgttcacgaaggatccaccactatgatccaatcacctcttaccaggccctatctccaacatgggggattacaactaaaatgagatttgggtggggacacatatccaaaccatagcagccaccactctccatcttagaatggtagaataataaaattaggaggaaacttggtatgcttttgcatgcattttaacatcagaaccctttgttcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaccctttgttcaaataaaatcttatctagaactccagtatacgcaactgtgaaaaagggagagtgctctggtgcagctggagaggaaagacaaggagtgccctcagtaaccccctccccagatccggctggcccagagagagctgctgagactcccccaggacccagtttggagccactgatctcatcactgcataggagggagagagagaggggagatatgaaacaacggaggcaaaatgaaataaaataatcttaggtgacaacattttttaccaggttttgttggtataaaacaccctttccttttcagttcccctacctgaaagtctttggttgcttatatatatttaggatgtttttatatagggtaatatagaattgtaaggcttaatataatattaatatttgacattctattggatttaagcagccagtgggaagagagtaaataaaaataactacacaaaggaaactgctattagcgtttgttaccatgtgaatgaaatagcacatcagctgtgcatttaaagatctggatagaagtttgtttcagttatttgtttgttttgaggtacatttacatacagtgaaatacatagcttttaagtacacagtttgatctgtgttgactatacttacgtaacccacagctctaccaaaatcaacaacatttccatcatgcgggaaagttctcttattccccttcccaataaatctttcccacccagaagcaatcacagatgtgatgtctatcaccacacttggttctattctaggactttgtataaatggaatcataccatatgtactcttttgtgtctactttgtttcacttagcataatatttttgagatttatccatgttgcagcatatggccatacctttttcctttttatgcctgagtagtgttccattgtgtgaatgaatatgccagtttatccattctcctgtttatggacacttggaatgtctaaaagctgccatgaaaagccttgttcaaggctttttgtggacatatattctcatttctctaggataaatgcctaggagtagaattgctgagtgataagagtgatgcatatcttttaagaaaaaaactatcagagttttcacaattatccattttacacatccatgcaatatatgagcattctgattgttccacatccttgccaacacttaatattatcagcctttaaaatttcagctattctatttggtgtgtttctcatgtagttttaatttgcatttctctgtaataatgttgattgccttttctaagtgcttattggctattcacctatcttttgtcaaatgtctattcagatgtttgccctttaaaaaattgtgttgtctttttattgttaaattgtaggagttctttgtaagatacaggtctgggaaatattttctcccaatctgtagtttgcttattttattgagattgtcttttgataatgagttttaaattttgcagttaaatttatggatatttttctcttatggttattgcgttctgtgtttgaaggaatcttgccttcctcaaagtcacaaagatttatcttatattttcttctagaatatttatacttttaagttatacatttatgtctatgattcatcttgagttaatttttatatacaatatgtggtaagattcaaagttcttttctttttccacatggctatctagtcattccagctcaatttcttgaaaagatgtttctttttcaattgaattgctttgatatctttgttgaaattgatttggccatatatatgtagggctacttttgggctttcagttttatttcattgttctgtttctattttatttcactaaaaccacactcttgatttgtatgtttatagttaatcatgaaattagatagagtaagtccttcaactttgttcttctatttcaagaatgtttgggctattctaggtcctttgcatttctgtataaattttagaatcagcttatcgatttctacaaaacgtcttcagaaattttaattgagatctattaagtcattagataaacttgaaaagaaccaacatcttaagaatattgagttttctaatccttaaacatggtatatattattattattattattttttttttatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtggtattccccttcatgtgtccaggtgatctcattgttcaattcccacctatgagtgagaatatacggtgtttggttttttgttcttgcgatagtttactgagaatgatgatttccagggacatggatgaaattggaaatcatcattctcggtatatattatttatttagatcttctttaatttctctcaacagtattttgaggttttcagtatatatctcacatacctttcattaaaattattcctaagtactttctgttttgggaagctattttaaatagtattttaacatgttacattgatgaattctttatgtagaaggtttttttttgaagattatagaattttatgtatctaccaggtttgctaatttgttttagtttatttatatctttgattaattatagccttgtaaaatattacttaatattacatactggtcatttcctgttctgtcttgcagatgattttatagctgacatcggtcaagaactacattatggtgggataaaattttaatttactagagtattatagtgagggaagttttttctttcttatggagagtttttattatgaatgctttttaaaatgctttttctgcatctatttagatggccatttggtttttctccttttaatctattaatatgttgaattatattgactaattttaggatgttaaacagcctttcattccagggttaaacttcacttggccgtgatatattattattattatgtatgtgtggatacatttgagtttttaatgttttgctaatgatttttgtgtttgtgttaatgagagatattgtcattaatgttcttttttttttttttttttttttttccccccctctgagacagagtctcgctctgtcgcccaggctggagtgcaatggtgccatctcagctcactgcaagctccgcctcccgggttcaccccattctcctgcctcagcctcccgagtagctgggactacaggcacccaccatgacatccggctaatttttttgtatttttagtagagacggggtttcaccgtgttagccaggatggtctccatctcctgacctcgtggtccacccgcctcggcctcccagagtgctgggattacaggcgtgagccactgtgcctggccctaatgtttttataacttgcttgtttcagtgtctgggcaacactggccttttaaataattggaaatgttctctcctctgtttctcagagaatttgtggaggattttactattttctttctcaaacatttagtagaatttgccagggaacctctccaggttgggagagttctttgtgggaagtttgtatttatgagtgaaatttctttaattgacacagggctattcaatttttctatttcttcttgggtaattttgttcttttcagtctttgaaggaatttgttcatttcctgtaagttgttaaatttattggcataaatttgttcatacaatttccatattaccttttattgtgtctttgtaggtttttatggtagcatctttatagagatataactcacatataacacagtttaccatttgatgtatacaatccagtgtttttaaagagatttagctatacagctaattttagaacatttttatcaccctaacaagaaatcgtggtgccataccagtccttcccaccctatttacccagccttaggctaccactcctctcttttcagtctttgtagatttgcctattccagactttttatataaatgagataatataataagtggtcttttgagactggcttctgtcacttagaataatgtttttaaggtttactatgctgctgttaacattcatgtacaaatgtttgtgtgaacacacatttttatttctcttgggaatatacctaggggaagaatttctggatcataacgtaactctatatttaagcttctgaggaactgatggactgttttccaaaataactgcaccattttagactttcaccagcagtgcaggaggatttcaatttctctgcatccttgctaacacttggtgtcatctatcttttttattacagccatcctagtgggtgtgaagtagaaactcattttgctttggatttgcatttccctgatggctaatgatgttgagcatcttcccatgtgcttgatggccatgtgtatgtatctttcttggggaaatatccattcagccttgttatcctttaatgactgtagaatctatagcaatatcccttctcactttcctgatatcagtaatcttcatttctctcgtttttttcttaatgagtctaaataggagtttataaattttattagctctttaaagtgccgacttttggttttatcatttttctcttttgtttgttaattttatatttcatttctcctttttactacttcattcttttacttaccctgagtttaatttgctcctcagattatttagatcaaggatctaaatttctaccttaagaaactagctttttctagcatatgatctatcctagtcaacataccatgtgaacttgaaaagatcgatgtattgatagtagcttttactttttctctatcttttttttttctgatactattgattgcttagaagaactgctttaacatagatttccaaactctatacccataaaactggaataggttacactatacccaatttatagataaaaaaatgaaacttgaggctcagaaaggtgaaatagattgctggtctgaaacttacctagagatgaaagttaggtagactccactgcttaggttggaagaatatgcagacaggaaaccagtgggaaggggacagtacaatgtacctgcagacctgattattccagtatagcaaaagcattctgtctcagcctgtcacactttgataagatatatttgggggaatatcatgagtttttggcttatttgttaaacacctggatttttatggtctaactttagttgttgactaagcaaagtatttgttgactaatgtgactgagttgtgaaacgtctcgaaatggcatttcaattgtcagtgaagggggtggcatagacatatgattccttcatatccactcaactgagtctggcgtctccttgaatgcaggcatgcggaatgtccatgtgcctggcatcttggcggtggtcagtaaatgtttgtcaaaaggagctgaagtgtataccgtttctttgacttcttctgtgagtcaagcaccaggttcatctgagtgaaaaaatgcaatgtggatgagactgtgatgtgtcctgtacactgaaagagatcttgatcgttactaaatgggtattaaatgaggcagtgtggccatgacagaaatatgcaagaataaaagaagtgttgtagttcgcagaactttagagggggaaaatatgatttatttattacttgtggaatctcttgatttgatacactggtggaacatagcattatagtcaaagcagcagtgatagcttggcttgtgtgaaaacaaggtaggatttgtaataccatctgatattcttctccgagtttcagattcagaaagaacagtatcaacatgtaccgagcaggggaaacaatataggaaagatataaaagaaaatatgcaatccttgaccaatgtaaataaatgggaacttttgatttatttgtcatgtactcagattgatgggtttcgtagtgaagtaaatgtgtgtgcatccctggttcaggagagagtgttttgtgtatcattctagactactccagactgacatttcaaagcaacgtatcatcagtgaagtatgtatttatcgttagctcttgaaggatttttttttttagttgatagagtcatgtcttagtttctcaatgtggagaagctaaaactgtgatcctgtttctcattttctctctcaccacataggaaactatcctggtcagaagctaccccttggttgtatcagtttgctagggctgtcacaacgaagtaccacaaactgagtcacctaaacagaaatttgcaatctcagttctggaggccaaaagttcaagactgggatattggcagtgttggctcctaccaagagctgccaagaagaatctgtgccacacctcttccttagcatatgttgttggctgacaagctttggcattccttggcttgtagaagcatctctcccacctctgccctcatcttcacgtggtgttctacctgttgtatgtctccaagtccactcacactggattagggacccacactactccaggacaaccttaattaattacatttgcagaagccctacttcaaataaggtcacattttgaagcactgggggtggggacttcaatatatgaattttgggggacatgataacatgctgcttataggtggaaaataatttctacatatttattaataaggaacctctaagatgaacagatttggaaatctagtttatcttcagtttgttctaagcatctgtgtgacctggaataaattacttcattatcccaacctcagcttcttcatctgcaaggtggaagaggtgatacttgctctcctatgttatagagtcgtagtcaattataacaatagctgctgccatttattgagtggtaataagagccggcactatcacaagagtggacaccttttacaggctaggaaacagtggcacaaagaagtaaagtaatttgcccatagccaattaagtggcggagccaagattcgaacccaagaagaatggctacagtgccaactctttcaaccagggaaccaggagagcatcactatataaattctgtgtaaagtgcaagacacaatgcaaaagttcgttgtcactaaaaggagaactcagggcaaagtcttgtccttcccacttctaattctttttttcctactccagtgtttatcaaacttttcccccttttagaatacttattggaaacccatacaaaactcatatctcctctgatgtttttgaaatttcagaacctgcatcattattgaagtaaatccaagcaatcagaatttgaaaatctagctttccaaacggcctcagaggcccccaacacacacatacacatacacacacacacacacacacacacggacacataacacacagtgtgttaactcagtccttcctgccttcagtttctgtggtacagccatgatatggcttggctgtccccagccagatctcatcttgaattgtagctcccataattcccacatgtggtgggagggacccagtgggaggtaattgaatcatgggggtggatttttcccatgctgttctcgtgatagtgaataagtctcacaagatccgatggttttagaaagggctgttcccctgtacgtgctctcttccctgccgccatgtaagacatgcctttgctcctcctttgccttctgccatgattgtgagggctccccagctatgtggaacagtgagtccattaaacctctttttatgtctttattagcagcatgagaacagactaatacaagccataaaaggccaagatcatcattcctttacctacattctttttttgttatttgcccttgcttttcatcatgcaccacatcatttatgtaactaaaaataccaacttccaggccaggtgtggtggctcacgcttgtaatcccagcactttgggaggcggatgcgggtgggtcacctgaggtcaggagttcaagaccagcctggccaacatggtgaaaccccatctctactaaaaatacagaaattagccaggagtgatggcatgtgcctataatcccagctactcaggaggctgaggcaggagaattgcttgaacccaggaggtggaggttgcagtgagctgagattgtgccattgcactccagcctgggcaagagtgagactctgtctcaaagcaaaacaaaaacaaacaaacaaatgaaaaaccagcttcccttagattcccccatgagtttctgactccactacctaattcaataaaggcatttttaagaaatataaatcatatttattcatggttatatgtacatgatacaaaacatttcacagcagaaatggactcttttttaccccatcctcaatcaactaatttccttccctataaaaatctattatttgttttgtgttgtgtgtttcagccagagatactctatgcatgatgcaaacatattagcatccatatgctactttcatctaaaaagtagcatactctccacagtattctaaacctcttctttcacctattaagatatcatttctctattgtaagacttaaaatttaatgtagtgcctttgagcccaaaagtcttgagtttccctacttctaccagatattccccccaaccttcccaaagagaaaggctccctacttaaatggttcctctatcatctgggcctgctgggccgtacccattcctcaacctaacaggtttcacctcccggccagcccatgacattagtcacatcctcctgtaggaacctgaggacacctctcccccttgttactacatagccggcctcccacagcccttgtggtttgctctgctgtggactgtagcccctgtatggtgaacagtgtcctcctcccccaggctgcaagtgtatgtgactagtaaaccacgatctgtctcttttaagtggtgtggggtgttgtttgtctgaccttctcatattatttagggcagaggatccacctttaccaactgggtgaataggaggtgattagaactagtccatattaccacatagagcaatcctttgcttttcctaataagtgcacagaactctatagtatgaataggaaccaatttacttatcttgttccctgttggtagacactgggtttttactctttggttccacagcaatgctctagtgaattttctattccacattttgcatctgaagtcatcttgcatctgaaggagtaaattattacaagtaaagtatgggtcaaatgctatgcacattaaattttaataaacattggccaggcgcagtggctcacacctgtaattccagcactttgggaggccaaggcgggagtggatcacctgaggtcaggagttcgagaccagcctgaccaatatggtaaaaccccatctctattaaaaatacaaaaattagctgggcgtggtggcatgtgtctgtggtcccaggctactcgggaggttgagacaggagaactgcttgaacccaggaggtagaggttgccatgagttgagatcgtgaaactgcactccaggctgggcacagagcgagattctgtctcaaaaaaataaaataaaaaaattaataaacattgccaattgcttttcatagaatgtgtaccaatttagacccccacaggcagctggacagtctatttccccacatcctcatcaacccaggacattaccaaactttctgatcttggccaaggggagaggtgaaaaatgtcaagtccttgtggttttagtttacagttttacaagaagtgagggcaagtgtcttttcatatgcttacaagtcatttgtatttctggcctttctcttattgactcgaggaagcttttcctttattgaataaattaccactttttctatgatatgaagttgaaatatcacttatcatttgtctttgtttatagtaggttttgctgcctagatttgtattttatgttatcacatttaccttcttttgtggattctagtgttggggttacatatagatgcatcttctccagtctgtgtaggagaatctcattttattgtgcgttctttgttgtgattcacagatatcacatttttttacaaattgaaggtttatggcaactctccattgagcaagtctatcagtgccattttcccaaaagcatgtgtttactccatatctgtgtgtcatattttggtaattctcaaaatatttcaaactttgtcattatcattttttcttttatggtgatctgtgatcagtgttgtttatgttgctattataattgctttggggcaccatgaaccacacctgtataagatggagaacttaataaatgttgtatgtgtactgactgttccaccaactggccattgcacatctctctccctctcttcaggcttctttattccctgagacacagcaatattgaaattagaccaattcataaccctacaatggcttctaagtgttcaagtgaaaggaagagtcatacatctctcactttaagttaaaagctagaaatgactaagcttggtgaggaaagcatgtcaaaagctgagacaggccaaaagctagacctcttgggcaaaataattagccaagttgtgaatgcaaaggaaaagttattgaagaaaattgaaagtgctactccagtgaaaacaggaatgataagaaagcaaaacagccttatcgctgatatggagaaaattttaaaaggtcaatgcctggcttcaaaagacaggctgactctcttgttaggggatagtgcagctggtgaagccaatgctcatttaccattccaaaaatcatacagcctctaagaatgacgctaaatctactctgcctgtgccctaaaaatggaacaacgaagcccagatctgtttacagaaggatttattgaatattttaagaccactgttgagacctactgctcaaaaacaaagattcctctcaaaatattgatgctcactgacaatgcacctcatcacacaagagccttatgaagatgtacaagaatgtgtaatacaaggcatgttgttttcatgcctgctaacacaatatccattctatagccctggagcaaagagtaattttgatttccaagtcttattatttaagaaatatactttgtgaggctatagctcccatagataaggattcctcttggatctgagcaaagtaaattgaaacactcctggaaaggattaacagttccagatgccattaagaacagttttgatttctgggaggaggccaaaatttcaacattaactgtagtttagaagcaattgattccaaccttcatggatgactttggaggggttcaagacttcagtggaggaagtcactgcaaatgaggtggaaatagcaaaagaactagaattagaagcagagcctgaagatgtgactgaactgctgtgatctcatgataaaatttaaacaaatgaaaagttgttccttatggatgagtaaagaaagtggtttcttgagatggaatatgctcctggtgaaaatgctatgaacattgttgaaatgacaacaaagtatttagaatattacataaagttagttgataaggcagcagcagggtttgagagattgattccaattttgaaagaatttttgtgtgcatgtggaggtaaaatgctaccaaacagcattgcatgctacagagacttatttcatgaaaggaagaatcagttaatgtagcaaacatcattgtggtcttattttaagaaattgtcacagccaccccaaccttcagcaaccattatcctcatcagtcagcagccatcaacatcaaggcaaaacctcccaccagcaaaaagattacaacttgctgaaggctcagatgatccttagcatttttagccataaagtattttaaaataaggtatatacattgttttttagacataatgctattgcacactcaatcaactacagtataaacataattttatatgtgctgggaaaccaaaaaattcatgtgacttgctttattttgatatttgctttattgtggtggtctgaaactgaatgcacagtatttctgaggtatgcctatagttgcattaaaaaaaattctcctgatgttattgtcaagattttaatggcttcacttttacatttaaatatttgattcatctggaatctatgctgatataaggtatgagataaagatctataatttgtttttacagttgattatttgacaataattcttttttccattaacatacaatgtcatatttatcaaatactgagagactgtttctgatctgtgttctgttccatggatctgtctcttcatgcacaaaaatgagaatgttttaattattatatatttaaaatgttttaatattgattattatgtatatttgtcttttccttattcttgtttattttgttttccaaatgaactttaaaatcatcttgcctatgactccatgaaaaaattatattgctgtttttggattcttgaaaattcatatactaaagtaagaagaattgaatctttaaaatgacaaattttccaatcaaagactgtgacatgcatgttatttctttaaaggtcttcatgccctgatagtgttttagagtttagtttatatagctcttccacatgtctcattacatttattcctaggtatttaaatagtagtctttccttcctttgagactttctgactagtggtaatttacaaatattaaggctgctgatttctagatatgagcttcccccagccatctaattaaatgttttattattctaattttccaggtgtacagtgatatcatctttaaatatgatgattttacttcccttgcttcaatttttgtagtccttacgtctttctcttgtttattttgggttggccttcagaacgatgctgagtaaaggataaaggatgtcttcatcttattcttgattttaacaaaaatgcttctgtagttcccctaccgcaaatattgagtatccatgatgttctaggcaccaggatgtagcaaatacaactgtccttcaggactcaactcaaatccaccttcttccaaagccccctgtgatcatctcaaacagaaattgtctttgcctcctccaaacttcatattttccttccctttactgtcctactttttatcttgctttagaattatcagtatacttgtcttaaatagtccactaaaaatcggtatgctcagagaaggcaggatctttgacaaatcatctagtcatcctcagaactctgccttgcccacagcaaatgctcaacacagtcctgcttaattaattataaattagttagtatgaaaatttgttcaaatatatttgagcaaatactaagtaagcatctgctcagataaaaatgcaggattctcatacagagcacttggccatgagtaataaatgtaagtccggctctcaaaatatacatgtattcctatttggcactagccaaaagggggtgcaatatttacctttaaattattatagagagaatgagctagaaaggaaaaagccagttggagccagaaagcttggagtctttgaacctccctcagttctctaaatctagatgaaatgatatgaatcatcaagtcatttcatgccttttacacttcactttaggatctttttctctaaaaagcctctctcaacagggataatagggtgagtggccttagtatcagtgtttggtttctttgcgatgtgtaattggttttagctagtgtggaatgtcctcttgattttaaattcctatttttagctcctctgtatattgtgttatgtgttcactgttgctccccacacccctccttgcaagtctatacagaagcatttcatgtggaaccggagctgttctagggaagcctgtcatcaaggctgccctttgctctgcacctccccagcaccctcagaggtcagagcgaggctggtgtacagggcagtggatgtgagagcttgaatttcttgccaccttgttacaagccaaagtaggaagaaagtgtatccagaccaggaaacatgatttgtaatcgtggttgcaaatctagcaccctaaacctagcacaccatttggcacatactcggctcttaaatgtccatttaatgcatgaatgactaagcagataagtgagtgagtggatacatatgtgtcttattgggagacggctcatgaactgacattcaccatgggcttttctaagtttttcagtgggatcaatgttggtagtttgtatatttgcacttggtttagaaaactttcctttacctaatcctcaggcgatactgtgaactttgggttgcttacttgataaatatagttttattattaattcatgcatttgaaataacacatgcattgaaagcagcagcaaatccttttaagctctgtgctcttttaaataggttctttctctcatgctcaggaaaaaattcagtggagatgatggcaacagactggtccctcaaatctctggccatagcccaaggaggagagaacccacaattgcaggccatatgtattgccctgtatgatcagtattaaactcaaagtatgtctttgtaactagagacatattctgggtagtgtggctgttagtttgtcccaatctttattttaaggcactatccacatctctttctcttttcctttgcccctaacattgatatcaactgagttttcagggtgccagctgcccatgtcagctctttgagagagcagcctctctcctccttctgcctctcaatcctttcctctccgccagctcttctcggcatgttggtcattcattattgatgaccctccagcaccttctccaccccggtgttcccatagccctgtgcactgctgagcagagccaggtgcaggatctagtcggggtccaggactgctgctccaaggccgccaagactctttcccttcctggctgtcagagaggatgcctggcactagagatacagcagcagcggcgtcagccgctggtcttgaggagggtttgtttctctcctctgtcttctaggaagcaaaaggttaaactgttcattttaagagcctccctgggtataaaatactgagctttgtctttctggagtgagccgattcctaggccccttgacctttgctccaacatgtctgctgcccatcccttagagtgtttttctttgctttctatttagtcagaaggaatgaggctagtgtctgccgttagcttaattattggggaaaagcgttggaagaaaagaaactgattctctccatttttctaattgttacttaaccaagtcttgacaagatacaatttggtggctaatatgcatggagtgccctttctgaaagcagaggctctgcttgtggattctgcagtgaaggctggagtcacaccttggaaatgactgtccaccttcacatttgcacacatcacttacacacatggagctccttccaccaccagcctcccctgagccttcataagacacaggctgctgctttaaggaacattaacaatccagacccttccagggacccatgtgactccagcttctcccacaatagtcagaaatcgtaattgagagttcagaattcataggtaccaggataatattgcagaaagataatcaggcacctacttcccagttccctgaaattaaaacaggtattcatcttgtcagaataagaaaacagggtcctgctgtgttccagccacctggcaaccttgttcttagaatacagaaagggagggaagcaatgtgtgcgatcactctagccgaagaatgtagagagaagcgaagaccatttttttagtcctaatttcctacaagggacaatgcacctaaagtttttcaagccttgctcagaatcatctcacaaaaggaaaggccctttgcttcacaaaatattttaatgaaagcaaaacagtgactaagagcctcatgtactgctggttctgcctgtttcaaatcttgaaaggcctttaataacctccattatgtgactatgtgatttttatcacacaatctcagattcttacattttttaaataactcaccagcaagaaccaatgtcagaactaaatgctaataagatttggcctgggagagtaacatagtaagattgttaatgtttaatgcactctcatcaaagtgggataatcctacggctgaaggttaagtgagccttttgtaaaaaaaaaaaataatagggaagaaaacattattgtagcttttccattttactcagtcaaatgaattcaacataaacttgttatagccaagcccaggctagacatttcctggtgatctggtaatttcccttgtattgttcatgtggtttgtctctttcctcttcctctttgtttctaatgatgatgatgaacagcatctctgcaataggccacattctcaaagtgctccattcattgtcacttgaaaagaccactgttgggttttattgccatcattgatatacaaggataatttacatacaaaattgtggtttggttttagagccatggcaaccagagtatcacttctgatgggaaaaggaagaatggccttcagtgatggagtaggcaattgcaaagagttctgctcccagttctcttgctaaatcaaaagattgcaagggtcaagatcgatttcttcattttctttaggcagcaatctgaagaggccccagcagaaaactccagccttaggatttctggtaatcagaaaaagaagcaactgttcttgggtaacatgtggtgcccataaaagggcatcagctcttgggggcagcctgaggttaccaggttcacctttgctcattctgcgcaaggatcgctcccctcagagtttctgcaggggaatgtgtactctggtgttcggtattaaagcttctacatgaatttatagagttgcttacattggctgagaaattgttttttttttttttttttggtactcagccctaattttccctggcaaatattgctctgtaactttgagatgaatgtacccatcaaaaactccagaagaaattctcatgcagttctattattgctcatcattttgccaaggaacgttagtaaagagagctatgaagtggctaaagaagttgtgttttttgtttgtgtgtttgtttttccttttcatcgttttatgtcttagtaggagaagaatccaagatgaaaaggacaggctctggttttagctttgccactaatttcgtgtgtttccttatgcaagtgtccagatcttcttgggaattaatttctttatttgtcaaagggagctaataatacctgccctggccaacctgtaacatagttatgcgtaggagtaaaatcacagatgtgaaagtttgcaaaattctaagatccttaggtagctcatgcgtcgacaggagtaatgaattatacacctaccgcaaaaggtgattgtggggatccagtgtcaaagggcttagaagagagtgtgacacataagtagcatttggggatggtagctggaagaccaagcagcaagggtgttaccatcaaatcccttccataacccctctcccatacaaagcaaaggggtctaaatagccccagtgctcacttcaatgctactcatattctttggctttggagactttgcttttttggagcccctcattcctactttccagacatttgcagaattcagctgtgctttctaagagattctctggcattaacacagaatgaccttgcagtgggaatgaccttggagctgcagcgacttgagtttaaattctagctctgccccttactagctgggtgggattgattccaggtaactgtcagtaccttgtgtctcaacatcttcagttggggatagcgtcctaccatctccctcatagaggagttaacgagttgaaatgacacagatgctacagtcaggagatgctacgtaattttctgggcccagtgcaaaatgaaaattcagggccccttgttcaagcatattaagcacttcaagatggcaacagcagagcatgaaaccaaggtctaggtcttctgagctcagggtcttgtgcaactgcataggtcacatgcccttgaagcccaccctggccactgatcccatagtggcagcttgccacttagtgggcactcagtagagaccgcttgcttttctttcttcctctttctctcttcttctcttgatagccttaaatccctgggagggggggcttgcatttactcttacacttcctgccacagtttctccccttatgatcgttccttctgctggttaaattgccgcttctcttttgcccctgaaatcagggagccaagtgattaagagaagctagcttatctacacgagcctcccatctctatgtctgtatttcccaagttctttcaaagataacccaataaaataaagaactaacagcatcatgatacatacaaaggggctatggtgtatgtgtggcaggctggggagtaaggatggagaaggtattttgaggcaaagaagaaagaacaaaggaaaatgaaggtattagaagataaaagcttgcacttcacagaagatattattttgctgccatgtatctaagcacaattgaggcagattagttgtaaaatcacctcatttacttttcccagcttttttcagccactttcactaaatcaaccaaccaaaccttttctgtgcccttatgtcccttgtctctgaacttcatcaactaaatatttgttatgcattattttattcagcattcacagtatctgtgggtttgggtatgctacttctttcttcattttatagagaaggagatgatagagtaaccgtccatagttactgtgttcattggaaatgttttgtctccaagtagcagaaagcccaacttacagtgtctgtgttcggggttggaagttggggagaggttcctcctaatgagatgcttggaggcagaccaccgcctcaggggttagacagctcactgacatcctggctcctgtctgctgctctcttggcttttccctcataatcacaagatggctgctgtgggtccaggcatcacaacatggtcaggagaagaagaaatgagggaagaaacagtatccagcctattgttgtcttttcttgggaaagttacactttctcaggcatccactggcttacagacttctacttatgtctcattggccagaactgtgggagtttctagctatagaaatggcggagaaggtgagtgtttagcttttcccgcctttttcctggttgggggagacagctctagagtgaagcacacaacagtatatactttatagtgacaaagatagcaaggggcaaagacagaacctgaacccaggtcctctaatcttgagtttagagattttgccattctgccacattgctcttcttttaaaaatactttcagcaacatccagcttgtccacttcctgctgagacaagccaacaggtataactccaagttatggaaatttaaaacaggaaatatgtttatactatgccttcccttaaggttcctgagagagaactttctacaagttatgtaaaacagagataatgtggcttatagaaaatttattcctcacatgataaattctgtgcatgtgaagtttcgtagaactcactgtagcgcatttagaaacacacgaccagaaattgtgtgaaacattgctttgggatggatggtgcccgtctgaccttaagctatccttcccccactctgctgctcttcaaaccacagccagtttattttttggtagaaactatttacgtatgaagatcgtatttggatgcctttagtaatttattaaactcactttcctaaagcaagatcagagtttaaaacatatgtaaatatcagctgagagattagaaacaaaagccaagaaggaatttctccactgcaattaccacatgcagttaccatggcagggaagctgtgcgggataattcagtccaaggtagagaaataacagagtctggaaatgtaaatatgtttctgttagagatacttgaaataacgtttacactggcttcttcctttttagctatgggatattgtgcaaaacttttttgttgtgttttctttaaatgctccgggcagtaaattggaagtatatagcacctgctacatgtttagtcagtagtcgaaacattgaataaatcatgaaatctgtaggtgaactgaataatagctgccctggagagaactgtaattcactgttgacaaaataaatccccctgcatttttctggggaatcttttatttttagcaagagtgtttgatactcctaagttaattagtagttttaacagagtggaatgttattgaacctaccagtgttgtttaagagctaatgtttatgtgccaggcgccagattaggtaattttataagcatagatcattacattctcgcccagccctgtagggttcctagctctgcttttccagatgaagagccaagacccttagaggttgtaactagtccagagccacatgggctaggaagaaaggaagacctttcaccacttatttacacaagtaagttcttcccaggcagtgtggcagactcagcagattggcccacttaactcttgttccacccccactctatcttgtctacttctaccacagaggccagaaaccacaaatccccagcctcctgtggcttggcttggggtagcccaaatacacagttctgtccaaccatgcataggcagaattccctggggaacatttctctctccccaagtaggtaaagcttctttgccctttaccgtttgttgttccttttcttccttcatggaaagaagagtcactttcaagacatgcagcaaccaccctctaacaatcagaaggaaatacatggttaagattgttgaaacaagaagtaaaagaagtcaagttgcttgacgatattctcttttgtctttttattttttttattttttaaattatactttaagttctagggtacatgtgcacaatgtgcaggtttgttacatatgtatacatgtgccatgttggtttgctgcacccattaattcatcatttacattaggtatttctcctaatgctatccctcccccatgcacccaccccacaacaggccccagtgtgtgatgttccccaccctgtgtccaagtgttctcatcattcgtgtcccacctatgagtgagaacatgcggtgtttggttttctgtccttgtgatagtttgctgagaatgatggtttccagcttcatccatgtccctacaaacggcatgaactcatccttttttatggctgcatagtattccatggtgtatatgtgccacattttcttaatccagtctatcattgatggacatttgggttggttccatgagcttgatgatattctcaaatagattccctagccctaggctgcctgccattgcattccttattacacaagaataatcatctcttattgtattccaatcattgattggcattattttttttctgcatagcaaaatacatggccaaatcagtaaacctgaacttctcaaagtggccatctggtagctactagcttataaactgttccctaggtatagagaattgaaagcaggtgaagtgtgtgtgtgtgtgtgtgtgtgtgtgtgtgtgtgtgtgtatttcacatatcactcaggtcaatgttcctttgaaaatggagaatgcaactctattaagataatagtgtaaatttggtaactgatcacttacagcaattacaacaaaagatgcaaaagtcaggcagaactgggttctaatgctggctgtagcactggttggttatgtgaccttgagctcattagttagccttgcacacatttcctcatatatgattgaggataagagtagttttatctcatagagatttgaggggcatttggcacaggatcaggcacaaagtaagcactcagtggtattgctgccaataataataacaataataataataatagaattatttaagacttgcagattgagggaatttgatgaaatatataacaactgaggttaaagtgttctaattttctgtctagattcatcttttatggtccctttttaatctcacaccagtgtccttccagaattaaaaggtcaatgattttacttcctagagaagcttccttaggggcttatgaatggtgaaaatgtgcacgtttgcctcgactctctatttccattgtcgaaggccttcgcaaatttacctagtgattctagccaagtgcttcctgacattcttaggggctcgaaggtcaatacttgatttggattttttgttgttgtttctttttccctccagcctcctgtgttgtgttgatttgtaaaatggccattgtaaatgttaaaatggaaagaaaaccgagtctgttataagctttgatgtagtaaaaacagcatggagcatcttaaattttaagatgtcatcagaaaagaagctcttcccagtttcctcttgaaaatcattgtattagtcagggttctctagagggacagaactaataggacagatatatatagaaaggggaggttattaagtagtattaacttacacgattacaaggtcccacaataggctgtctgcaagctgaggggcaaggaagccagtccaagtcccaaacgattttatttgacaaaagacaaaaacagaagttatttacaatagtttttgctcaaataattcagtgggggcaactgtacttttcctccaggtttatcttataaccaaacccaagcagaggctgccccaccccaacaccccattttacacagctgggaatgccaaccagaattcagcagcgtggctccctcacccctcaccaccctctattgctcagtgtacagtggggagggaaagatcccacctcagcccaagaacttggagctgaagaacttggaatctgatattcaagggcaggaagcatccagcacagtagaaagatgtaaggtgggaggctcagccagtctagccttttcacatttttctccctggtttacatgctggccatgctggcagctgatttgatggtgcccacccagattaaggatgggtctgcctttcccagctcactgacttgaacgttaatctcctttggccacaccctcacagacacacccaagatcaataatttgcaccctccaatccaatcaagttgacactcagtattagccctcacaatcataaaacagaaaaatgagtgaaaagcataaattttgctttcaaaaagctgggagattctatatccatgaaccacaatatatgacgtaaggctggccaaatgcagtggaacgaaagctcaggaagggctaagagacaatcactatgatcaggttatagattttgacaaagcaagcaaaaaacacgtctccaaaactggtacttcagagcaggcataccctaaaggatgacgccaataagcctttgtttggaaaatggcaagggtattgcaagactggaagtagaaaacctccctggaccctacctgctaccatgtagtagcaaatgaaactgaaagggaaatgcacagtcatcctgtgtgtataggaagcagtccattgttgtggcactacggcagcctgttggccgagaagaagcagtggctaaaataactcatcagcacacaaccctttgtaataagacttaacagtaaatcaggtaaatttttaccaactcacaacatcctgactcctatcccacaaaactgtcctctaaatatctgaatcaagaagtttccacattcagaggaaagtaacaataaaaaggaaccagcacaggatattgtaatatgccatacatgacactacaaagatattataatataaaaggagaaaaaactggaaaatagatggtaaatgcagaacactcactataggtgattccaacagacaaatcaaaagataacattaccatgatcttgacgacttaaagaaaccaccaaagagctcaaaacagaaataaagaggtcaggggtaatatggtgacgtgagaagagaagaaacatacactgatgtagctctccagagaactgaagggggaaatttttttttttttttttgagacggagtctcgccctgttgcccaggctggagtgcagtgacgtgatctcggctcactgcaacctccacctcccgggttcacgccattctcctgcctcagcctcccaagtagctgggactacaggggcacccaccaccatgcccggctaatttttttgtattttttagtagagatggggttttactatggtctcgatctcctgacctcatgatctgcctgcctcagcctcccaaagttctgggattacaggcgtgagccaccgcacccggcctgaagggggaaaatcatcacagatatgaagatgattttgaagcagccaaagtaaaatagacactagacactgccgaacatagaatagaggatatgatgggcaggattatcaaagcaaacaaaacggaaacaacagcttaaaagtattagaaagaaaatagtatatttgggtgacgaggaagatcccagagatacatcacaatatatccctgaagaagagaattaaacaaatgaaacataaacaaagatataattctacgtaactttcaataaataaaagatttgaatttatagattgaaggagtctactatgttacagaaaatttgctaaagaacaatcaatactactctgtattatagatgtattgatagatcttggagataagaatgatttggtcacaccagcaggaatatcaagtaacctatacaagaccacagtttaaaaaaaacctcaggctaacctaagccttccttacagcaacattccaagattgcagagagtaatgcccatgaagccctcagtgaaaaagtatgtggccttagagttttatgcacagccaaactgtcattcaaatgtaaaaacaataaataaaacgtgtccaacatttaagaacccagagaagatgattcccatgagttattctttaaaaaactattggctgggcgtggtggctaacacctgtaatcccaacactttgggagactgaggcaggtggatcacgaggtcgggagatcgagaccatcctggctaacatggtgaaaccacatctctaccaaaaaaattaaaaattagctgggcgtggtggcgggcacctgtagtcccagctacttgggaggctgaggcaggagaatggcgtgaacccgagaggcagagcttgcagtgagcagagatcacaccactacactccagcctgggcaatagagcaagactctgtctcaaaaaaataaataaaattaaaaaataaaaaataaaaaactattaaagactttatctaagagatgaatgaagaaaccatggcaaaaggattttcagtgaacactgagtctgttttgcttttagactgggtctaaataagtgcagaaacttttgttatagaaaaaaaaaactaagctctgaatgttcataaatattttaactaatataaggataaggtggaaggtggtatgtagattcattcatcatctcatttaaacatgataaatcaagtatatttaaatatacttagcatacttactaaagtatattagtaaattaatatatttactgaagtatattagtaaattaatatatttactaaatatactaagtatatttaaatatacaaaaataagtgtaggaatgaacatatatgttagtttgaaatatatatgtaatatataaggtacatgtttaatatgtaaacatataatatatattaaaccaatgtttagtgcctattaaccaaattcaagtgatagaaggaagagaaaataaagaacaatttgtattgcttttagtggaaagtaaaatgtcagtgtttcaagaaacagagaagttaaatagctaaataagggttagttacaaaggtgatcactggaaaaattaaccataatacaaacctgcccaaatagcacaaggaatactcacaaaaagaaaatatagaccaaagagtagaagatttttttaaaaaagcaatagaaacagaaatcaaaatactataaagtaagaccaaacctgtttctcatatcaacaaataaaagtgggctaaactcccatattaaaaaaaaagattctgaaatcgagtaataaagtaaaacttaaccatatgctataccccatatatacctaaagcaaagtgtctcgcaaacttgaaaatagaaggatgagcaaaggaatattatcaaatgccaacaaaaaggaaagtagaggccaataatcttagaataaaacaaggttgaatttagaacaaaaagcattaaacaagaaacataaagacaattgtgtgataagatgtatcattcacaaggaagatctaatagtcattaagtgtttctgtatcaacgtagcctgaaaagttaagcaaaaactaccaaaaagataaggaaaaatagaaagactttaattataggaggcttaacagacaaaatagacccaaaagatgacatagatggcctaaataacataagtaagtagtaaagttacatatatcaatctatccctgaaaactaaaaatatgtcatcctttcagatgtccataaaacgtttcccagaactgactatactttagaccacacagaaaacctaaataaactccccaaatcagaaatcacactgatattgtcctctaatcactatgagtcaaaaaggaatccatgtgaatgtatagaatatttaaaattaatgataatgattataaccacattacatatcctatgggctcaactaaagcatttgctcaaaagaaaatttgtatacgtaagtacttaaattaatgaacaaaaaataaaggaaatcagtgcatatgtcttctactcacgaaattaaatataagaaaaataaagttaacctcaggaaaatataaggtagctatgataataaaagcagaaaataggaaaaaagaataaatctttaagttagctctttatgaaaaatcaataaatcattagtaaacaaaccaaaatggttgccaataagttattttctaggaaaatataaaattaccaggcatgaccccagatggagagaaaacaacaatctaaggaaatgaattagtatagaagaaatacagaatgtggagaaaaagcaaacctcttgaaagaaaacaccagtcctggaatatttcacagattacttctaccaaacctataaggaaaaaataggtccaatattatttaaaccaagtgaaagcatccaggttatttttctgaagctagcatgcatcatgcatattctgataaatagagcacacaaaaaagcaaactaaggaccaatattgcttatgaatatcagtgtaaataatcctaattaaaatattagaaaacaaatctaagagctcacaaagacaagaatttgctatgttcaaatgggatttagtcttaaaaaagtaagactatttcaaaattcacaactgtattaatttaattcataaaatattgtcaaaattaagaatcactttatcatctccataaatacttgaacaggtgtttgataaaattctctaatcttgatgaaaaactcataataaaatgctattttattatacagacagagacatacacacatacatataccaatacatacttagtaacatggtcccaaagctactgatacaactgctgaagaaagtgtcattaatgtcggctacaaggaaagataccttaatcaatagcattaattaacattattgctccagagagcctagctagcctaagtaaacaaaagaaaaaaataagcagagtaattttaaccaggagttaaaattatcatatatgcagatgatatgattatgtactgtaaaacacaaagaatcacatggaaaaaatagtataaacaataaggaaatacacttaggtgattgagtacaaaaatactactcatgttaatctttccacaaacagaaactggttagaaaatataactgaagagatcccatttacaataagaataaatttaacaagaaatgtgcccaaattacacaaataaaatttttaaatgctactgagaaacatgaaaaatgacttaaacaaatggaaaggcatactctgtttaacataaagatgtcttatctaaattaagttatacaggtaatgcaatgcaataaaaaaaaaaacaatagaatctacaggggtagattctaaagttcaagaacaaataaggaagcccaacccaaaagtttctgacaaaggaaaattaagaaagggggattagccctatcaaatattaaaatgtattgtagtccgggtacctgaggtcaggagttcgtgacctgcctggccaatatggtaaaaccctgtctctactaaatatacaaatattagctgggtgtggtagtgggcacctgtaatcccagctacttgggaggcttaggcaggagaattgcttgaacctgggaggcggaggttgcagtgagcccagcggcgccactgcactccagcctgggtgacagagtgagactccatctcaaaaaaaaaaaaaaaaaaaaaaaaaaaaaaaaaaaaaaaaactattgtaaaactacagaagttaaaatatatatgtctccatatctttttttatttttaatttttatggccacatagtaggtgtatatatttatggggtacttgagatattttgatacagacatacaatatgtaatcatcacattagggtaaatagagtatccatcacttcaagcactcattacctctttgtgttacaaacattccaactgtactctctcgttattctaaaatgtattacaaattgtcactgactgcagtcaccctgttgtgctatcaaatactagatattattcatttatatctctatatcctaacaaccaggaagctctatgtaagtgtctagaaatagaccaaactacatatgacaaattttttatttacatatcaataaaaaaatcagtctattcaaaaatgttattgaaacaactgaatacctctttagaaaaaaattaacaagcacaaacaccataaacaaaatcagaaaatgatatactgagaaaaatcatttacaaaggactattcttttttttttaatttaagttctagggtacatgtgcacaacgtgcatgtttgttacatatgtatacatgtgccatgttggtgtgctgcacacattaactcgccatttacattaggtatatctcctaatgctatccctcccccatccccctaccccacaacaggcccagtgtgtgatgttccccaccctgtgtccaagtgtactcattgttcaattcccacctatgagtgagaacatgcggtgtttggttttctgtccttgcgatagtttgctgagaatgatggtttccagcttcatccatgtccctacaaaggacatgaactcatccttttttatggctgcatagtattccatggtgtatatgtgccacattttcttaatccagtctatcatggatggacatttgggttggttccaagtctttgctattgtgaatagtgccgcaataaacatacgtgtgcatgtgtctttatagcagcatgatttataatcctttgggtatatatccagtaatgggatggctgggtcaaatggtatttctagttctagatccttgaggaattaccacactgtcttccacaatggctgaactagtttacagccccacaaacagtgtaaaagtgttcctatttctccacatgctctccagcacctgttgttccctgactttttaatggtcgccattttaactggtgtgagatggtatctcattgtggttttgatttgcatttctctgatggccagtgatgatgagcattttttcatgtgtgttggctgcataaatgtcttctttcgagaagtatctgttcatatccttcacccactttttgatgggttgtttgattttttcttgtaaatttgtttaagttctttgtagattctggatattagccctttgtcagatgggtacattgcaaacgttttctcccattctgtatgttgcctgttcactctgatggtagtttcttttactgtgcagaagctctttagtttaattagatcccatttctcaattttggcttttgttgccgttgcttttggtgttttagtcatgaagtccttgcccatgcctatgtcctgaatggtattgcctaggttttcttctagggtttttttggttttaggtcttacatttaagtctttaatccgtcttgaattaatttttgtataaggtgtgaggaagggatccagtttcagctttctacatatggctagccagttttcccagcaccatctattaaatagagaatcctttccccatttcttatttttgtcagttttgacaaaggactattcttcttaacatgttaaaaatctcttgaataaaattaaaaaacaacccagtggaaatagatagggcaaataatataaataggtacttcccaaaaagaaagaaacatgatgtaaaccattgaaaaaatgcacagtctcactcacaataaatgtatattaagactactgagagatgctgatttaaaaaaaaaagcctgccagatttcacattgacaaggatcaaaaagtttaatcacacattgttggcaacactgtagggaaataaggtaccctcatacatctttggtggacccatgaattggtacaatgttgattaggagcaaattgccagtatttatcatgcaacttgcatgtatctcctgactcagaaatttcacttctaggaattcctcctacattacacttgtgcaattgtgtgtacttgcacttgtgtgaatgatgtatgtacatgaatatgctttgtcatattgtttgtgagaaccaaagattacaaaccaccaaatgctggccaatatacattcattaccacaaaggtctggtcaatttagagaaagaaatcctatgtccacgaaggatataatctctaagaaaacaaagtgctgacagcatcatagagtatgttaccattattgtaaaatggcaatagtaataattattatataaatatatgcttgtgtatgaataaaatgccctgaaagtatactgatagagtttggatatttgtccctgcgcaaatcacatgatgaaatgtaattcccagtgttggaggtgtttgggtcatgggggcagaccccttatgtcttggtgctgtccttgcaatagtgagtgagtgctcacaagatctggttgtttaagtgtgtggtaccacacactcctccttgcttctgctcctaccacatgaaatacctgctacccgtttgccttctgcggtgactgtaagcttcctgaggcctccccagaagcagatgccagcactgtgcttcctgtacagcctgaagaaccatgaaccagttaaacctcttttcttataaatcacccagtctcaggtatttttttctttcttttgagatggagtctcgctctgtcccccagactggagtgcagtgacgtgatcttggttcggctcactgcaagctccacctcccgggctcacgccattgtcctgcctcagcctgccgagtcgctgggactacaggcgcccgccaccatgcccggctaattttttgtatttttaatagagatggggtttcactgtgttagccaggatggtctcaatctcctgacctcgtgatctgcccacctcggcctcccaaagtgctgggattacaggtgtgagccgttgcgcccggccaggtatttctttatagcaatgaaagagtggcctaacacgtatacattagaacctgattacagtagatgcctcttgggaggggacttaaatggccagggttggtgataaaaagtattttttaatgtatccccttttttatctgttaatttttttatgtgtatatgtattacctattcaaaaagttaatcaattttaaattaacttagatcccaattcaaactccacatctgctacctccagctttgtgacctagagcaaactgcaggccagctgccttctctgtggagcagggactgtcagaactcccccatcccagggtgtgatcagagctacatgagataatcatgggaaagtacctggaaattacatgtaattgcttagtaaatgccctccgcttctttccccccagaattaaagtaagctgcatctaactattacaacttaataaggtgcattattgtgctttgctgtgtttttaattttcttgtcatacctgaatggtttaaacatctggcttccttaaggcataattaagtaaaagagagagcagcgtacatcaccagtcaggtgtacttctttccctgttgtaaaagtgatgctttttattcagagccaagtctagatattcaccagtccttggcacgactagaaaaagatttgaaggactaaagctgctagagcataattatgtattggctgtggacttgagatgcctgggttctgtccctcctgactgtgacttagcagccgtttgtcactggagatgttttatgacttctgcaggcttccacagtatcacttgtgaaatgggaataactatttaatagctcacagaggtgctgtattaggttctccagagaaacagaataggatttacgttatatataacaataggatatagcctagatatatagatatatatatataaggatttattgtgggaatttgttcacgtgtttgtagaggctgagaagtgccacatatgccatctccaagctagagaagcaggaaagccagtggtaaaattcagcatgagtccacaggcccaagaaccagcagctctgatgtcccagggcaggagaaaagctggatgtcccaggtcaagggaaggagggaatttacccctcctccttctttttgttctatctgaaccctcaatggattggaagatgcttgcccacaccagtgagggtaatctttactcaatctactgattcaaatgctgttctctttcagaaacacactcacagtcatacccagaaataatgttttaccagctatctgggcaccccataacccagtcaagttgacacataaaattaaccatcacagacactgactagaatgcataaagtccatctagaaaagcacccagtacataataagcactcaacaaatatttttggaaaagtatcaaacactctgtgcaaggagcaagaaatggttcctactttcacggtctacacaaattaatagggagatgaaacaatggcccaaatcactagatcaccaagccatttaggagaagaaactgaagtgaagggggtaggcatgactcataaagagtaatttcctttccctctctaaggccccaccagtgaactggtggccacgttgactaactggagacaggataccaaggaggacagacatcattgtgaggtcccattctacgtaccccaaaccaacagagtcctctggaaggcctgagagctgttaggaacaagacgaaatgggtgtgagattgaagaagtcacaaaatgcagacattttaagctattctcccaaaatacattaaaaatcttactgagaaaaatgtgaaatatatacaatactcacttgcatatactatttcttattttattttatttatttattttttgagacagagtttcactgttgttgcccaggctagagtgcaatggcacgatcttggctcactgcaacctctgccaccctagttcaagcgattctcctgcttcatcctcccaaattgctgggattacaggtgcccaccaccacacctggctaattttttatattttttagtagagatggcgtttcaccatgttggtcaggctggtctcaaactcttgacctcaggtgatccacccacctcagcctcccaaagtgctgggattacaggcgtgagccactgtgcccaaccaacactatttgttattttagatgttgggaagttttcatgaaaattctcttgtccattctcatttacatgcacacacatacatatgcacatgcatgaacacatgcttcacggcgcttcttattaatccttattgggtaaaatcttattgagggacaataaaccagataaaatctccaaccactccctggtgccaagtctcttgggcccctcacactccaggtgggcaaggcagcatgccagtggacacagcatcacctgctcagagggagtggttgtggaaagcacagaggcaggcggcctggtggccaaggtccacaccacatcctcccaggtgggcactgtcctgagtaggcttaaactggcattgtctgtccagtaagtccttttctaaggaaagcaggtatcaactaattagcaacatgcaagtgttttcattttaggaaaagagaagaactctggaattatggggcctggtaaaggttcatttaagcgtcaagatcaagttggctaaacccatagtgtggaagcactctttgcgtagggtgagccaggtggagcagctgtgtgacagatcttggaggcagtctaagggcaatgagcacctggagaacaaagagggaggggctgcccacctgaggaggaagggacatgtgcaactgtctcctagatggggccctgagaactgccgggagacatcacagggcagcccctctccccacctctggctacacagtctcctgcccttctctactcagtgaattctgaggtcaaaggctactgtgccaaactttcaagtagagtgaagcctcctccgtggtgaactataaacttggatggcatcatgtccatttttgtgttcttcacagcacccaacagcaggttcacagtcaacgttagtgagggaccgagattgtagaagcaaatatttctccagcatcaggggtgttgcctcactaggatctaccattgggatcccaacccaggatgatggtttgaaaccttccggtccagttctcccccatttgtcagtctttgtccttgacaattaatgctgtaaatgcatgtactaaatgcccactgagtgtgtgtaacacacaagccggtgatatcagagtggcaccggacagggagcaacacttctgcaaaggagcaggtattccaagtccttctcatctttcctgagcatctgtcatttgggtggacctcactgcacccttcagctattagcagtgactgtaaatggagaagaagttctcgagaaccagcagcaccctgaacactcattaactgagaaaaattggagactcaaggaggcccaataccctcttactgaatacccaccttccttgtgccagggaggtcatagggaggttgaaaaatcaagggttttgccatgtgtctgagtttgattcctccaaaagggcattaacttttcatattacctctgcagagtgggatttaaaatctgtgttagtgacacgatatttcatttcagatccacagggcccacatttaaaattaatattgcatgcttgtcagaatgaattccaaaccctctcacagcaggccccttgtgggacctagagaaggagtggccaattcattatcgtaacactgggatgagggttccatcccagcttttgactgacacctgcagagattttttttttctgagacattttaagtttttggtgtgccccatcttcccagacaagctgcacgtttctgtcactctgtgctgtttccaaagcccagtggtctgcagggtacctttgaggggcctcctctgatccagttaatcagttcctcattgacaacatagacagagcatctggcccaggccagagagggctttcggccgagtccctctggaggatcagtctgtagagggatgtgactaaggcagcagattccgccaggattctgttagacacagaggacacaaggtcacctggccaaaagtggaggtcaggaagactcaagatctgggtccacctgtttcattttctcttagcatctgccctggcctgctgtcgtaaatcatcatcaccgagcttaaaaccaccctgtcgttcaaaaaaaaaaaaaaaaaatgagctatttggtttttgaacactttccttacagtgcgtagcagtttgttagagaggtgggcaggcattaggattttgtttataaccttggaataaactaagccaacagactgtattcttgcagggttaatgtcccctgctttacagtatgggaatgcccaacgaagtttttattatagagggtggaatatggtgcagtattcagtggagacaattgccccgggagtgcagcgcagaaagccacagctgcatctccacttggtgtcggccgggagctgcctcacctggggctccagggtccctttgagaccgcagttccatagcccgtgggtactgtccttgtgtcatcatcctctctctctctctctccattccagtcattcactctctccccctctttttctctgactgcctccaggcactttctttagcacagagctctggtgatacctcccactggccttgggcacccttcttcaaggccactcaccctgcatggaggagaggaagggaaggagtggccaattcattttcgtaacaaacacccaattttgtttttctccgtggactatccagatgcatgcttcttttacagttcatgtctgcgatactttgtcccttagagaaaaaagctgtatacaaatgtgaaattattccaattatctaatctctgttgcattcctcagccctgcaaagagttaaatgatgtgtaaaatcacctgttagcccgcattagacagggctgtatttacacacccagaggtggcctgtgaattatttaaccgaagggactcttggctcagcatctggctagacactgttgagcccaagttccttaggaggtgcagcctgtggccccagagcttcctcttggctggggaaaccgtctgacagacacggtgggctgctgccagaaccaggtctccttgagaacaacttgaactaagctcctcccagctccagatggttcacaaactagagaggagttttgcagagtcctgaacgctttgccaaaaaagagcgttggccatcttccaggccaggcggtaggtttgcctgcatgctgtgaatgccaggattattgttggggttttagagagtccatttcataacacccccagttcccatctgaatttggaaccaatgagagaaaaagggaaagcagtgagatggatggagatcaaaacatcacttttgtcaccaactgacctctcagagaacagggggagagtgacactggatgtcccaactaggaaccccagagtagagacacacttccatgaccagtgctggaaacccatctgcctcatgccaggaggcaggatcttgggtccctgtaccctggtgcagggaacggaaaggagccataccttctgcaagcacccagctcctcacaggaagccagggccaattcttccacctctccttgtctcatctcacttttcaggtgagcttcctttctctcctaccaaggagagggtgggggctgtggcaagagatggaggcatctggggaaaagccttcctcggggaaaacagcattccatatatctcccagggagatgggacctgcatatatttggaggaagaagtcatagagattgcaagagctggagaggattttagaagccactggaatcctctcattttactgaaggaaacagaggcacacgggtgcagcgaaaccctcatggttatatagctagtcaggggcagggctgaatttgtgtggcagtctgcagtttaaagccggtccctcatggtatggagaacacagcagtgggcatttcacacgcataatctcaccacagggggccaggctgcctcttggtctatgggactccaccccactgtgggtttcagggcaggttcccactcctacctcatctatcccttcttgggaatgggagatgcttggaggatgcacagtaattgaaatgctattcctggcaaatgatcatttccgggggaaaatgtgaatatcatgatatcaagtcaaataaagctgttaggttgaggctttgtccttgagctttttagactctgaacaggcagttgggaaggcagtcagctcctgcctgagtcactgggcaggacagccagcccagggaaagatgagggaagtgggggacctgcgttggtatctcactgggaggatgctgtggcctccccattcgatggagatccttgtcaggcctgcttttgcaaatgctcagaactccaggcagctctctggccctcttctttctgtcctctccatgcagctcccactgctgtatttactcggttggcactttccgctgtcagaatcacatttctcccagccactcactgtgttgcagaatctgtgtattgtcttttcttcagctggtgttttgggcttaagccctgaaatgctttgttctgggccccactacagcacccatactgtgtgctagagaaaacaggaaagggccctcaccatcacacccatgaccttggggaggccagcacctttgttgtcatacttcccaaaaccctccatcccctccctgccagaggagctagcacaatctagatgcccactggctgaggtttatttccagcactgcaaggtaacaggtacacacatacgcacaccagatttccattcccattaaatctctgcatccccaaatgagctacctgttggcaaaagctttttatctgtcagaagttctcaagtggaagttgtctctctctctttgctgcacgtgtgttaccacaaatgcggattgtgccggcctttctccatctcacccacaacctccccttaaacctccatctccaacacccccgagtcttcaatgcctcaggagaattctgaagccagcatataattgctgtccagaaagaggccccgtgggaacggaaaggattttgtgtgtgctcacccctacatttaatggggccatccttccccataaggctcagtgctgcaaagccaggagcccacccccaaggctcatgccaaaccccaattatctggagggcaactggccctgggagctgggccaagcacagcccctcctagctgcggaaagagccttcctatatgtctcgtttgacgcctacaaaaacctggggaagctggcagggcagggggtggggaggttaagcccatagggtggacaagccacagggctctgctccctcccttccccctcatttcttcacccctcccccatgaaaccatcaatcaccttgatggcaggagggaggggtgcttggctgaattgacttgaaaacactcagaaacccaaattgcacccacagaggcactcagaattcagggagatgagggatgtccgcctgaaacacttttttgcagtaatgtgttccgtgatggaagtcatctaattcattcatgaggggactgagacctcagaggaaagtggtgtccctgaaactagcaagggtcagaactacttgcagagaagccactaggaaggctttccagatgagactctccccctactcccactaatattagagggactcccctccctccagcatctccccacagggtctggctgcctcaggcttcccttggctctcagagatgcccttccactcaactgctacccacatgcttctacctgctgcacacaccctttctgtctgcagcctctgatatggtttggctgtgtccacacccaaatctcatcttgaattgtacctcctataattcccttgtgtcgtgaaagggacccagtgggaggtaattgaatcatgggggggcaggtctttcctgtactgttctcatgatagtgaataagtcttaggaggtcttctgcacaagctctctcttgcctgccaccatgtgactttgctcctcgttcgccttcctccatgattgtgaggcttccccagccatatggaactgtgagtcaattaaacctctttcttttgtaaattatccagtctcaggtaggtctttcttagcagcgtgagaacagactaatacagcccctcccctaggctttccctccttagagttcatgttgcagaccacttttccttccttctccgctactgactgcccccatccctgtttgtccagggttctcctgttttctgggttccctgatgagagttagttccttttagggactaattcgtcctagggaggactagattaatagactaccaagtcccctttccaaactgacttgcattttaagatggaaaagtgactcccagggacagggcattggctcaacaggtgcttctacagcttggccgtgacagcctgtctctacatagaaagggccaggggctgcagtctttgcttggagctgtgtttgtagaacaagcacactgtttttaacgtggtttatggttttgtttaaatcaggagtgtcgaatcttttgtattccctgggccacaatggaagaagaagaattgtcttgggccacacataaaatatactaacactaatgacagctgatgagcttaatgttttaagaatgtttacaaacttgtattgggccacatgtggcctgtgggccactggctggacaagctcggtttaaattgataagatattcgggaagaagatctaatcactctcctgccagcctctaccctgctgctaaaatgctttcacaggatctaggtcactggctttgataatcaccacagcttgtggatgtcctcctaagtctagtgccggaagggaactcggtattcctcagtgtgaactggaagcagatgaaggaactccacctctcactcaggtcatcatgtttctgttaatgcatcctgagatcaaattcacctttttcttttgctgccatattatattacaatttttcagttgacttaattgcaaagtatcttctatttgggctactgagtcacttatctctcaaattgtgtgttgttctaactatatatctatgccataagtataagggtttacatttattccttactttatgtcatcttaaaacaaatgaaagactactctaatcatgccacttctcactcctgattctagaaaacagtgtctttcttgaccctcctagttttaaatctggactatgaatctggcattcattcttatcccctaacattagacagagtattggctttcagaaagctaagctttgaagtactatatgttgtgtggcttactggagatcagacaatatgcaagaagtcaaattagttagtttggctcatggaaagctgtctaatttggaaataattaggtgtcatctcctgagagagagagagagagagagagcgcgcatagggagaggcagtggggaagaggaagagagagaggacagaaagggaagatgagagaaaatagttttcattacatgttaagcagaaagagttggaaaaaaataatttctatgatctgcaaagtcatttcaggagtacattagcttgctagggctgccatagttaagtatcacaaagtgggtgggctaagtaacagacaattattaactacagttctggagaccagaagtctacgatcaagacagggttggttccttctcggggctgccaggaaaggatctgttcccagcctctctctctggcctgtagatgactttgccccctgtgtttcttcacagtatcttccctctgtgtgtgcctgtctgtgtctaaatttcccctttttataaggacatcagtcattttggattaagatccacactaacaacctcattttaactcgattacctctgtaaaggccctatttccaaatgagatcacattctgaggtactgaaagttaggacttcaatgtctcgatttggagtggggcacaattcagtccataacaaggggattcccaaagagttgtcataggaatatcacccatcaggcaaagctcctggaagcagatggagccaccattaggaaagtttcccatgagactgtggtgcttctgatgtggctcagctctggaactgactcccacccccatcacccatttcaacctctaacccccaccacctaaccaacaccccctcccctgtaaaagcctttcttcttaagtcaggggtaaactttccacattattatggtccgtgtttccaatgcagtggtttctcagatctgcatcgctcctctctacctcctggttccctgcaactccttaacccacaagcagaggaaggagaagagaaggaccctattgtttagagcagaggtgctgggttctccctctacttacaaccttgccctctctcatttctcctgatgaccaggtagggtagacagcaacatccccatccaaacatgagcagtgaggtgacctggccggttcgatgagtggtaggcagcacagccacaggccatctccctcctaaatggggctgggcccaggggttttcctaggccctgcctgactatgctgcaggctctgccttacacttgctcatcctcctgttgcagaagagctacagggagacaagctacaaaaaccttttaatctgtatgattaacagaagcaattggcaaatgaccctgctgctctcccaaggggaataaggggtttattttcagatgctggtatttatcccactgaatttcattgtgcagcctacagtccatcaaatgcttcccagagtcacccagggtttcttcttagattaaaatcagaattaaatcagatagatacatgctttatcaaatctcattttcttggggatgaaaaataagtttctctttcagtctgtgatttcaggaacaggaagcaaagaatttggaagtttaaaaacacctttgcctgagcctgcatagcttattttttctccaggcagatatgggcctccccttgacaaggtgctacctgtaggcaggaaagtcctgctgcttgtcctgccatgtaatggaacttgggccataaggtggataaagataaggctgctctgagaagctgtattagttttcacaatgctgataaagacatacccaagactgggtaatttataaagaaaaagaggtttaacagactcacggttccacgtggttggggaggcctcacaatcatggcagaaggcgaaaggcacatcttacatggtggcaggcaagagaaaatgagagccaagagagtgagagccaagcaaaagaggaaacccctttaaaataatcagatctcaggagacttattcactaccatgagaacagtaggggggaaacccatgattcaattatctctccactaggtcctcccgtaacatgtgggaattaagggagatacacttcaagataagatttgggtggggacacagccaaaccatatcagaagcacagaattagtgcagagttggttaatgaaataatcattttctacataggtaggggagttaaatgatcatattttgccttttaagagtatcatataggaactcttacaaacctatacaaactggggcttgttatgtgagaagtgacgttggtgatacctgcttggaaagcataggtctccaatcccagctgctgtcctctgggagctgcacaaaagaaggtctatcacatgcttctgaagggagctgtagaagcttctgtggttattcatttgctacagatagaagaagaaattaaaaccaattgtgaaggaaagggaaatgaacattattgaggagtgagtaactgtgtggcaggcactgccctgagagattttgcctgcatgctcacctaaattttagaaataggactagctttaaaaaaataaaaaataaatttgagaaataaactattatcctttagaattgataaaaagtagttcatggatattagagatattttggtaaatatcactgtaaagcataaagaaaagaataaaaagtacccatttgctatgatcagaatgttgtgtcccaccaaaattcatatgttgaaacccagcccccaatgtgatactgttaaggggtggggcccttggaggtgattaggtcattagtgttctacctccatgaatgagattagatttgaggaagcctgtttggctctgctggcttatcaggacacatggaaagtgccgtttaagaaagcagaacaagccctcaccagacaccaaatctgtcagtgacttgatcttgaacttaccagcctcctgaactgtgagtaataaatttctattgtttataagttaccccggcaaagatattttgctgatagtagtccaaaagaactaaagaactaaaatgccattgtaccttagcccattctgttgaatcctttggtggctggattgaagagctgggcagtggagagaccagccaatttagaaagactagggggtgcctggtcatgctgccttctatgtaaagagtgggaagtggggcaatgcagaggacattttttggtgcaggaacaccatgaggggaaggactccaagtcttcagatgagatgatggtctctgggcagtcagttacagagcaggaacagcactctgatgtcacttggaaaggcactcatgaaagcagcagagcctgagctggtgtgttcggaggcagcattaaaaatcagcaggaaaggcatgagacatgaaaccaaaaaagggatctttgctgctgggtctcaggcaacacaaggaagaggtttgtcctgggaccccctgtgaggttctaggacctcaggtgctgttgggatcaggcaggaatttcctgaagtcagccttgtggttgcacctccttctttgcggccctcctggggactgttcttcttttttagactcatttaaaatcctcaaggggcccctctgctataagaaagcaccaagggaagggccctgcctttccagtttcccagcacctagcatgcagtgagtgctcaaatataatttatatttggaatgagtgatgattctctctgcttcccctttgggactgaccttgatgctcatttctacctgattttgcttataaattgtgaggagagttctctacactacaatttatctcagtatccctccccagctggtggctctcatgtgctcactggagcagtctgggacatcaaacatgaacaatgacatagtgaaagaagaaaatgcctggggaagataatggcactatctggagcagggagcctgccatctaaggaaatggtaaaaagaaggaggctccttagggcaggtttcaaggggccagaggaagccccaaatgcgtagaatcacagccaggtgctcaggaggggcagcagaagcagccctcaggacgaagggtagtggtcatcgtgcaaggcagacaagggccctagggtgcaggcaggctgggaagatctccagagaatgaggtgggccatctgggggcatcactttgacctgtagacaaagtgaagggagaggggagggtctggtgatgacagcctcagatgcagactctttaagccttctcaaggctttccagtttttgcagctgctgaggaaacttcattctcacccttcttgttccatctgaaaatgcacttctctccagagctctgggagactgtgaaaggctctctcattgccctgaaatatttttttaaggaatgagtatgatcttttctattctctacttctgtcccatgcagagcagatgtagaggaccaggagtgattcagagatgagaactgaatcttccctccagaaagttatgttccagagggaaagaagcggaacttcagtaacagagaatatgaaattggtcctaagtagaggtatgtggctctcgtgactggagcagagggagaaagacttgattcaggttcttgcctcgcagccttggaatgggaaaaaggaataaaaaatatagaacatgggtattagttcattctcacactactataaagacatagctgggaatgtgttatttataaagaaaagaggtttaattgacttgcagttccacaggccgtacaggaagcatggctggggaggcctcaggaaacttacagtcatagtggaaggcaaagaggacgaagtcatgtcttacatatctgcagaaggaggaaaagagcacaaagatggaagtgctacacacttttaaacaaccagatttcatgaaaactgactcactttcatgagaacagcaaaggggaggtctgccttcatgattcactcacctcccacgaggcctctgctctaacactggggattacaattcaacatgagatttgggtggggacacagggccaaaccatagtaacatgtataatacatatgtatgcaagtactggaatatcaagtttcctggaggaagtagcttttgagcagggcctagaagcatgccaaggatttggatgtgtttgttgtgggtggatgaagtccatgaccagcaagcagactcaggagagttttgcagataagtgtgtccagaagcaaaacaggctgggaggagtggtggtgctggaaaggtggcagatgccgaatgatggaggaccttgaattccatagtagggaatttggcatttattttgtagctgtgggaagccatagcagtttttcaccaaagagataatttacatcaattattccaagccctcagattcactccagttgctagttcagttgtttggttcaaggaagcgtcagaaaggaaatgaaccagaaaggatgagtgatcctagagtccagggtgtccttggggtcagagggaggacaaggccttatgttccctgccttttccaggaggaagaaattgtagtaatattccaggacactggatggacttgtttttctttggaaacaaggttattgacctctctgccgcagtaagagaaaaatgatatatatgttagaacttgaatatttttgtagaaacttaatattaaaggccttatgttcaaatatgcagcatttcacagtgctggttgaattatttgggctaggttgccacatggtgttccatgtacaattctccttggtaggctgggttaaaaaatgtggctaggtaaaatgtgagatgagaaataaaaaaggatctttgttttttcatgcttgtgatacttaaataggctactgtgacccaattaagaagctcccagaggccaggtgtggtagcttatgcctgtaatcccagcactttgggaggccaaggcaggcagatcacttgagttcaggagtttgagaccagcctggccatcatggcgaaactccatatctcccaaaaatacaaaacttagtcgggcatggtggcacacacatgtaatcccagctacttggaaagctgaggcaggagaactgcttgaacccaggaggttgcagtgagccaagatcaggccactgtactctagcctgggtgacaaagtgagactgagactctgtcttaaaaaaaaaaaaaaactatccaggcgtggtggtggatgcctgtaatcccagctacttgggatgctgaggtgggagaattgcttgtacatgggaggtgaaagttgcagtgagccgaggtcaggccactgcactctagcctgtgcaacagaggctttgtctcaaaaaaaaaaaaaaaaaaaaaaaaagttcccagaaataacctctaagccacccatctaattggtcccagagagatcaaaaaaaatgcagcattgaaaatggcgtggaggcaatgacttagggtttatagacaggcatcttccctgtcgtcatccctgacatcttccccaagtgggctaccacaggtcctaggtgatgactggttaggccatgaagctgttcagagggacagagagctgcagagtttggggaaatccaccccctgcttccccagaaggagaagatgcatactaatctgttttggagacaatgcagaatactgattagccaaatatttgctggtgatggggatcactgtgtgtattcgttttctattgctgctataacaaattaccatacacttaatggtttagaacaacataaatccattcattatcttatagttctgaaggtcaggaatctgaaaagatctcactgggctaaaatcaagttgctagcaggactgtgtttctttctggaggctctaagggataatcttttttcttgccttttccagcttccaggagctgcctgcattccttggcttgtggccccttcctctattttcaaaatcagtaaagtcccatctatctgaccccttttccatcatcacatctgtctctaaccaactatagctgggaaaggtcttctgctttcaaggacccatgtgattcactgagcatacctggataaccagggtcatctcccatcttaagatccttagccttaatcacatctacaaagtcccttttgccatgtgaagtcacatattcacagattccagggattaggacatggatctcttttgggggaacatttttctgccttctatagtgtgtattaaactttgatgcttatggcatggccccgttttcgtatcttcttccactcagctaaagccttaggtgagcccgggccaccctggcagctgccctggccagctgatgtggtgatccatggagccagctctggttcatgccaataatctcatttatccagcagtctcacttggccttgaacaatttaccgttcccaaatatcagcatgtttttctgtaaaggagtgatggttcccaacaagaagaggttgacacactcaaattcaggtaatttgaggagattagaataaaaggattttaggtcttctgcggttgctagaatatttcattggccagtatctattgtcctcatccgcactgttgctggccatctgcggtcagagattcctcagtccagggcctgaccaaaaggacttgctccacttacattgcaaagcaaacaacagattcttaaacaagaaagatgatgccttctaaagcttggctattccagccaagctcaggggaaagacattttccctaaagtatcaacaagccatttgatctcagacttagaaggtcattcttgtctgcttttttctcccattagatgaaagaaaatgaaatgttttccgtaaaagtaatttatgaagcactccatatggcaatattaaaactgtaaaagtaagcctccaggggacaaaacaaataatgctgtgtcatccgtctgccctggtactgtccctgggtaatgtcaggcacagaacgttggggaactggctccccactcaactggtacttggatgcctttggagcttttccttgaacattgttgctaaggttcatgaaatcttcagatttttgttatggaatccattcgcaaagcaaaatgatcttaagtgtaaatactaaatttactgtaaattgcagacatcactacctccaagacccttttaatatattgagtcccactgaatgctggaatccaagataaagttctttaagaatatagcactcatgtcattcatgtattcattcgttcattgatgcagtcattcaagaaatatttactgagtacctattaggattcagtggtgagcaaaccactctaatgggtgatacaaatgcaaattagagcgatcgttgatatggagaaaagatagagggtttaataagagcttataacaggataagcactgggacaccatggacagattttaggtaggggagttaaatggtcatattttcccttttaagagtatcatataggctgcagtgtgggaaacagatcagagaggcttcagggcctgcccaaccatcctttacgagtgttgtttaacgcaaggtctcgtggtagacagtgttacatggttaaccccatttccattctcctcttgccctgcttccatgtggtatagaggctggaaaagttaaacaccttcttccccacctcctgtgcagctcagtgtagtcatgtgaccctgctctggcctgagacttgagcagtgatctgttgaggtcttctgggaaggaatatgcttttcctgataaaaggaatgagtgcagctgttccccctccccctccttcccacctttcacagagaagggatgactagagctgggcagccatcaggcaaccacaagggaaagaccaagatgttggtgttcatagaatagagcctctgcagcaatgtcagcaccacacacatatggactgcttgttatgtggaaaatatcagcccccatctttggagattggatttttttgttgtggttactttccatgaaaagcattctaaacagatacagtgattcaaacataggcttagccgaaaacaaattaataggcattttgatcattgtcatagttagcgggtggaatccccaaattccacttgtgccattgaaattgcagcctttgaatgggatgataaaagagggttggaaagaagaagggagccgtgatggttttcttccacaggcctgtggtggcattcctcagtgtttcacttccaacctccttggaacccatgcttatcttagcttcagcctccaacacagccttaactgtaagcctagttccctgagtcactctgaaatgtattagtccatgaggaaggagaacagattctgtcttctacctgttttcataactgtagaaatgaacacagtgcatggcacttggtaggtgctcagtgaatgtccactaagccagtacgtacacacaaatacatgcaaaagttgaaaatcgcaatgcattgtgtctttaaaaataaaaaagagaaatagcctgatcttttggaacacatatggggcagagcctgctcaatgaagcatgcacattttggattaagaaatatgattatcatttgtcagctctgatttctgcctctgggctgataagatggtgtccgaggagtcattttcactcctttgcagacaccaaaacagaaggggtctttgctgaaaggtagactctgacgtgacagtcattagtagctagaaacaggcaactgattgcaaagtcaagatgaagtgcttcagtaaaaagaaccttcatgcttgaggcatactctttgcttctttgttgaagttgtggtagatttttttaaaaaacaatcacaatatagtttgctatactttaagtttttaacatctccactggggaaaaattgaaggagctaagtaaattagctcattggatcatgaatttatagaaaaaaaattaatattgccctttgtcgtttctgttaggagtgtcacgggtcaaagcagagacaagaggcatggagaaggagcagtgtgagggcctctccgggtcatttctctgtctggcttctgatgctatctgcccaacacagtttctgaaaacatcagaaactccccagttttgcccaacatgcttcccctaccttgcacctcttagtgcagagacatgttctgtgagaatccacctggtaagacagacaacatggagaggaagatctcagagacctggcttcctttcctgcccttcccttgcagacagagttttactttgtgaagtctccagtttcagaatgagaaacctctgttaagcaaccaggcctatcactgtagggatgagaaaagtgaagtccagataggtgaagcaacttgtcccaggtcaacacagcatgtcagagaagctgaggccagccagtctcctgggttctcccccatgttcttcctactgcccctctgcggcttccatttgtaaagagaggattgcttctcctcactcctctcgcacactcttgaggctatttcagtgaattgtgtctatctttttatatttcccatttaaaagaaaacccactctatggcataatggtttccagtgtcctgctgtttggaagaatgttttacctgcctgtcagtgctgagctttgagctccttgaagaaggacattctcgtggctgtggcccatccaggcagaaccagcctagctggccaagtggtttctctgcatcgtttggctgtcagataagggccacctgcttattgattggcacagtgacgcttaagtccaaacatcctccctaatgacacagaacttcatattaaaggatgtcagggaattgattttgctcttctttaggaacaaaagatgtcagaagttagaaggaactgaacagtcaggaaaacgtaagtctctataccttcccatcaccccatccctgacccacaagccatgatcggccagtggaagataaatctaaccaatcccatgggacaaagggagagagccctgcacagcaagacagcagcagtcattgggcagaaataaatcatgagatggttgagaatctgattctctgggtcaatttctctgcatcctcctctgcccttttaggcctgtgctaaactttccctttgatgcaaatggtattaagtgccttgtgtctgaaaaggttgttggcaggctttggttgagaacataaagatgaatctttgttctcttgtctataaaatggggatataataatctacctcctgtgagaattcaataattttataagataaagctcttagagcagtgcctggcccagagtggatactcaactaatgttaactaagaaaatgaaaatgaaaatccaggaatagtctctgcctgcaaaatgttttgaatgtaaggagggagatgagacgctgtgtatatatgcctctgttctgtatttttaatcaactactaaggccatagagaacaaagagttacccctttttaaggtaaaataaattatactcattgtccagcaaggaagaaatgaattgaaaatcctagaggcagaaaagtgcagagtttggagactaccaggtggcactgagactaaaagctttatttgccatgttcagctcaagatttaatgggttgtatagtgtaaggggctaactccaggatctgctggaactcactctgggatccacagcaaacaaagcactaaccttggcatatggcgctgcgagaagtttcctaggatcagccaggctctgggccactcactgggttcatgcctctgaacattaccttccaggagctgcccccattactgaacctaatacgctactcagaagttttgtaaccaaggttttctaaaagtctgagaaatagaagatgaactttagatttgataaacagggctgtacactggagtcaggtagaggtgagtaggaatcctggccttgccacttactagctgtttgaccttggataaattgcttaacctttctaagcctcaatttcaatgtctttattaaataacttttatgaccgggaaatcaattaaataatttatttaaaatacttagggcagtattgatcatgaaatagatgttctgaaaatacttataatgattttgatcagttcctgagagcccacttgtaattttcattgggtctgtactcttgggacttctccagaaaccatgacaaggaattttagagagtattacccgatattgtagtggactgtgctcaagaatcaaatacaacaatgtcaaaaatttgtctgacacaacaaagaaatggactacctgaaatagtatatatagtccctaagagttttaaaatagatggtggatggtaataaattgaatttctgcgttcttagaaagggtgattcagagataccccaattctaagagtcactgacactgaatgtcaagtattttttgtggcttcagaaatttctgataaatgcattttttcagagtgttgttgtatcataactttgctgtagagcaaaccacttcaaacttagtgatctataaaaataaacatttatggccgggcgtggtggctcacgcctgtaatcccagcactttgggaggccaaggtgggcagatcacaaggtcaggagatcgagaccatcctggctaacatggtgaaaccctgtctctactaaaaatacaaaaaattagccaggcgtggtggcaggcgcctgtagtccccagctactcaggaagctgaggcaggagagtggcatgaacctgggaggtagagcttgcagtgagcctagatcacgccactgcactccagcctgggtgaagagtgagactccgtctcaaaaaatatatataaaataaaaaataaataaacttttattgcttgctcatgagtctataggccagcttaggtttggctgatctagcaatgggttcagtaccatttgctccagatgtctctcatcttccttgaaataacaactattctgaggcgtgttcttctcatggtaagagggcaagagaagggagtaactacagccatgcaggtacatagcaagtccctgttcatatcacattcaataacaccccagtagccaggcaaatcatatggccaaacccgaaagggaaaaggtagacactgctcactatgaggccaaggcaagtattcaggtgtatattaataccatgggggagtcaggaactggggggcaataattccttcttccacacctgtgatgttgcagactgttgctggagtgtagtcttctttctgttagttgaggggattgtttttttgatctagctgtaacccctgatgagtgatgtacctcttagtaaattgtgggcaaacataaggaaaaaggacctctttagtaaatgagccttctaagattcagtcgtgtggtgaaataactaaactgagtggaggacaaagaagtcacagaaccaatccttcaaatccagcccgcagcagcagaggtgtaaacagttactatctaatgtccactccggggtctacctgaattgaattgttggtttccttccaattctcaatgattttctggccattttcatagaaaccatcaatgtaactgatacttctggtttcaaataatatgctagatcaaaagcataaattaccttgaaaatgtgaccatttttctagctctccttggctatcaataaataatactcaaattgctctaaattgttggattgagtttaggagacaaaggccagcagtaactgagatgattaacatgaattgggataaaactccctcttcagttttcatctaacagaatgcaggtcttcagagaatgattgtcttttctagcataatactcatctacctcctgaagggctgggagcttagaattctttctcactctcagtacttcttagagaaacccagaagagtccagtgagaatggtttccctgtttggctgattttctgggaggcagaatggctcaggggttagatgccattctgggatctatggctggattcaaacttggctgcacacctgggtagctgtgtgaccctgcgaaagttgcaaaggttggttaacctctgcagttgtccctgatgttgatcacagatcttcagttcccctttcctcctgtcacccagaggactgagtccctggctcctttgtggttgggtggtgctatgtgaccagttctggccaaggattgtgagcaaacatgctctatgtaacttctggattacactatttaatacccagtgagaaactctccagaattctctcttgtccccctggcacattgaccagcaacatgcaaggtgatgtaactccaatgagtagggttcccttgttgacctacactagacatgtagcatgacagagaaataacctttgtgctaagccactgacatttggggggttatttgctgccataacttaatccaccctaccctgattgatgcacctcactatatctttgtttctttatgtgaaaaaatggagataatagtagaatctatttcatcaagtaattatgaggactaaacaggataatgtgtgtataatacttagaatagtacctagcacataataaatttttaatatattttagctatttatgatgatgatgatgatgttatgccgtgctctaactttgcctctaacaagttatctatttctatcaaacaagttattagtcatgtgtcttcaagaaaatcacttatcatcaagttgcaatcatagtatgttagaataagtgagctgtaagactaatttctagccttatgatgtgagcctctattaagaactcactcagagactccatcctggtgtttcaaagatatttctattggttaggaaaataaaacgtgataatactaaacattattttctccccttcagttgctctcccttccccaaacaaaaagatgtatccttattacagaattctttctgtatcctgttctgaagatttctgctcaggaaattactctggctcgtaaattattaactacaaattggttttccggtttaggcacctacaccctcatcagtccatccccattctctgttctgttttcaccagtaggatgtcaacagtccactatgatcttttttcctgatagcatggtcttaccaaaaggagaagttcctgtccttgaccaccttagtccaggctaaaatagctatccacataccaccactcatgaccactgagacctgttttccaacttcttcagatcagagctttccatatctggtttttctctcatgttactctagatgtatccttctctagtcccaaaggtagccctgtctgcaattcccaatagcagcatgttaatctatgttaacatattatattgaaccataagaaattgcctttgtggaaggggtgggggttgaatatagaaatttcatatggttcaacctatatgtaaacccaatttggaaaagaaggagactgtgatcacatacctattaaattacatgttggatcccatcaagaatcctaatgtatttcttcctccataccttgttgaactgggatcttgttccaggacatgacttatgctctgtatataaccttcagacctccctatacccagcacttggtagatagcagatactgatgctgtatttattgaccaactagatgggagctttttgtgatatctattgttgacatccatgtttatacatttgggctgtttaaaaaggtaccatttataattacattatgggagaaaataacacttcttttctttaacctctttcagattgaagacatcattacaaagatgcaagatgacaagacagggggtgtgcccatcagaacagtcaagagctttctctccaaaatccccagtgtcgtcacaggtaacaccctccttgcaaggtgttggtaacagtcagaactaccaaagagttataagtctagattgcggcctgaggggtgtctgaagatctgtgaatagtaaaaatgaaacattcagtgtgtttcttgactcaggtcccatcctagtcttagtttccaggaagaagctacttgttgcccatcattaagaatgaccttaccatgaccagcccttcaagtgcatgtagattgaggctgctgggaataaataaacccattaataaagtggcgcatcagcaactttgcctgtgggatacacacaagcacagaaatattaaagaaattaaacaggtttttaagaaagtgttatattcaaattctacaaaatgcttttattttcagttttttaactcagtgtacttgacctcctgaaagagaggttttaaactatttttcttcattccttatattgtgctttgtgtgctcatctttcttttaaaatattttattgtgaaatatattaaaacacatgggtagttcaaaaataataaaacacagtacatgtacctaccatcctgccttataaagaacattattatcaatatcttagagcccccttgggtacctactgtattgcatccacttccctaaacactatctgcttgtatactaatcaattcattgtttttcttcatagttttactacctaggtatgtatcttttgctatccaaacaagtaaccaaataaattaagataaaattttagatgattctcttaatctgcctatatgcttttcaaaattcgggaaccaaaggacttagttttcactatataccttttagaatggctaaaaataaaaatattgacagtaccaagtggtggtgagcatgtgaagcaactggaactctcacatattggtgatacgaatggaaaattgtgcagctactttgggaactagtttggcagtttcttacacagttaagcaatgcttaccatatgaaccagcaatcccactcctgggtattcacccaagagcaatgaaaacttgtgtttatacaaaaacttgtatgtaagggtttatagcaacttttattgaagtatactgaagaatatagcaactttattcatcatctccaaagactggaaacaacccaaatgtccttcagtgaacgggtaaatggataaacaaactgtagtctctccacaatcagcaacaaaaaccagggaactattgatactggtagcaacttggattaatctctaggtcatttttctgagtgaaagaagcagtctcaaaggttacatgctatgtgatttcaggtatacagcattgtatacatcacaaaaccgtagtgataaagattagatcagtggtttccagcaactggcatttgcagggcgagtgtgactgcaaaagacaacaggagggagttttatgagatgatgatgatgaacagatgaacagttctgtatactgattatggtgatggtaacatgactctatacataggccaaaattcatggaacaggccaggcatgatggctcatgcctgtaatcccagcactttaggaggctgaggtagggggatcacctgaggtcagggggttgagaccaccttggccaacatggcaaaaccccatctttactaaaaaatacaaaaattagccgggcgtagtggtgcgtgcctgtagtcccagctacttgggagactgaggcaggagaatcacttgaacctgggaggtagaggttgcagtgagctgagatcgtgccactgcactccagcctgggtaacagagcgagactctgtctcagcaacaacaacaacaacaacagaattcatggaacagcacacacacacacgcacacacagggtcaatattactgtatattaacctaaaaaataagtagacccagttgaagtaagtatcccagctcattattgagactgtcactctttgaactcaggtactgtcttactcagctcaggctgctagaacaaagcaccctacactgggtggcttataaagaacagaaattcatgtctcacagttctggaggctggaagtctgagatcaggtaccatcataggttctggtaagagcccattccaggttgtagactgctgacttcttcttgtatccttgtttggtggaaagaaagctagatagggggccgggtgccgtgactcatgcctataatcccagcactttgggaggctgaggtgggtggatcacctgaggtcaggagtttgagagcagcctggccaacatggcaaaaccctgtctctactaaaaatacaaaaaaaaaaaaaaaatagctgggtgtggtggcacgtgcttgtagtcccagctacttgggaggctgaggcaggaaaatcacttgaactgtggaggttgcagtgagcagaggtcacgccactgcactccagcatgggcaacagagtgagactccatctcaaaaaaaaaagtaagctaaatagctctctggcctctctgtaaagggtaataattccatttgtgaggggccctccttcataaactcccccaaaggactcctaatgccatcatgttggggattagatttcaatatatgaatttggaggagacacgttcagtccaaaatagagcccagatagatttgggtaatgaaggatacttgtattgttagtgttctctaattttaaaatttatgtaaatgaaattttactatatatattattcatgtataatatacagtataatatagactatgtatgtaattttactatattatttttcacattcctggattttgttcaataatgtttaagatgtttgtatctatttcacaggccacactgatctgttgtttttcttaccattgttgctggtttgggtatcaaatttatgctagcctcataaatgagccatgaagtatctctcttttcttgatatcctgcttttctttgaaaaataattgtccctttaatccaggttttaagtatgtaatttcaattattttttatttttaaaatttcctctggttctttttttttttttagacagagtcttgctcttgtcacccaggctggagtgcagtggcatgatctcagctcactgaaacccccacctcctgggttcaagcgattctcctgtctcagcctcctgagtagctgggattacaggcatccgccaccacacctggctaattttttgtatttttagtagagacagggtttcaccatgttgcccaggctggtctcgaactcttgaccttaggtgatccgcccaccttggcctcccaaagtactctggttctttttacaatatacttggtcattcatttttttaaatttattcatttagatatttattgagtgttcactattttctaagcattgttaaggacttgagattcagaagtaaatgaaacagataaaaagttctaccctcatggaatttatattctagtagaggaggaaataagtaaggaaaacttgcagaattttagattgtgataaaggccaaggagaaaaataaaatacacaaaaggatgggaagtgttggagtgttgcagctttggaataggtgctcaagaaagagctcctcgagaagatgacatttgagtaaagacggaaaggagatgagggattgaatcatatggatattgagggagagagcatgccagacagccagagctcagtgcccaaggcaagagagttcctggaacattgaggatctgtgaggaggagccagggcagctataatagagtcaagaaaataaggagagtggggatgaagccacgtgagaatggtgagcttgatcacttagcctcttatcactgcaggattttgcacatggcctgacatgctctgacttacctttcaatgagatcactctattatattcagaattccctgggggattgaggggttaggtgccagataggaggctattattaaaatggtgcctcagactaggtgatatggtttcactctgtgtccctacccaaatcgcatctcaaattataatccccacatggcaagggagggacctggtggtaggtgattagctcatggggaaggttctcccgtgctgttctcataatagcgagtgagttctcacaagatctgatggtttaaaagtgtggcacttccccctgctctctctctctcctgccgctatgtaagacatgccttttttcccctttaccttctgccaggattgtaagtttcctgaggcctccgcagccatgtaattaactgtgagtcaattaagcttctttcctttataaattacccagtctcagatcattctttataacagtgtgaaaatggactaatacactaagctatcagcactggagatgtgtgaagtagtcagattcggattcaagtctgaaggtagatgatatggtttggccaagtccccacccaaatctcatcttgaattgtataatagttcccataattcccacatatcatggaagggacctggtgggaggtaattgaatcatgggggcagttacctctatgctgttctcatgatggtgagtgagttctaatgagatctgatgatttcataaggggcttttccctgtctttgctctgcacttctccttgctgcttccatgtgaagacaatgtatttgcttcactttctgccatgattgtaagtttcctcagccgtgctgaactgtgagtcaattaaacatatgtcctttataaattacccaatcttgggtatgtctttattagcagcatgagaatggactaataccgtaaattgttactaggtagtggggcactgctgtaaagatacttgaaaatgtggaagcagccaggcgcggtggctcatgcctgtaatcccagcactttgggaggccatggcaggtggatcatttgaggtcgggagttcaagaccagcctggccaacatggtgaagccctgtctctactaaaagtacaaaaattagctcagtggtagtggcacgcacctgtaatcccagctacttgggaggctgaggcaggagaatcacttgagcccaggcagcagaggttgtggtgagctgagatcacaccactgcattccagtctgtgagaccctgtctcagaaaaaaaaaaaaaatagaaaatatggaagtgactttggaacatgggtgacaggcagaggaaggaacagtttgaagggctcagaagaagacaagaatatgggggaaagtttggaacttcctagagacttggagggcttagaagacaggaagatgtgggaaagtttagaacttcctagagacctgttgaatgactttgaccaaaatactgatagtgatatggacaataaagtccaggctgaggtagtctcagatggagatgagaaacttgttaggaactggagcaaagataaccctcgttatgctgtagcaaagtcaggtggcattttggccctgccctagagatttgtgaaactttgaacttgagagagatgatttaggatatctggcagaaaaacatttctaagtgcagagtgttcaagaggtgacatttgacatctctggacacaagagagcataaaagtttggaaaatttgcagcctgacgaaccagtagaaaagaaaaacacattttctggggagaaattcaagctggctgcagaaatttgcataagtaaggaggaaccaaatgttaattgccaagacagtggggaaaatgtctccagggcatgtcacagaccttcaaggcagcacctcccaccacaggcccagagacctaagaggaaaaaatgtttatttttcctcttaggtccagggccccactgctgtgtgcagcctagggacttaatgccctgtgtcccagctgctccagctatagttaaaaggggtcaaggtacagctcgggccatggcttcagagggtgcaagcctccagccttggcagcttccacatggtgtttgtcttctgggtgtgcagaagacaagaactgaggtttgggaacctccatcttgatttcaaaggatatatagaaacacctggatgtccaggcagaggtgtgctgcaggggcagagccctcatggagagcctctgctagaacagtgcagaagggaaatgtggggttggagtccccacacagagtccccactggggcactgcctagaggagctgtaagaagagggccactgtcctccagactccagaatggtaggtccacccccagcttgcactgtgcaactggaaaagctgcagacactaaacaccagctgtgcaagcagccaggaaggaggctgtaccctgcaaagctaccgggtcagagctgcccaagatagtgggagcccacctcttgcatcagcataacatgggtgtgagacatgaagtaaaaggagattatttcataactttaagatttaattagttacctattggatttcagacttgcatggggcctgtagcccctttgttttggtgaatttctcccatttagaacaggtatatttacccagtgcctgtacccacattgcatttaggaagtaactagcttgcttttgattttacaggctcataggtggaagggacttgcttagtctcagatgagattttggacttggacttttgggttaatgctggaatgaattaagattttgggggactgttgggaaggcatcattgtgttttgaaatgtgaggatatgagatttgggaggggctggggtagaatgatatggtttggacatgtccccacccaaatctcatcttgatttgtaattcccatagtccccatgagtcttgggaaggatgcagtgggaggtaattgaatcatgggttggttacctccatgctttcctcatgatagtgagtgagttctcatgagatctgatagttttataacgggcttttcctctacctcactcttcacatctccttgctgctgccatgtgaagaaggatgtgtttgctttcctttctgccatgattgtaagtttactgaggcctttccagccatgctgtactgtctgtcaattaaacctcttttctttatttcccagtttcatgtatgtctttattagcagcatgagaaccgactaatagagtagaacagatattattagcggatagatcagatatggaatgtgagaggaaaaaaaggaattagccatgatccacactttttggcttcagcaactggaaaaatggagttgctattaatttcaatgaggaatactataataggggtgccaggggttggggtggggggcagttgttagctgaagggtaagaaatcaaaacacaaattttaggtcaagttttagcgacctattagacattcagttggagatgacaagtaagtattccagtatgtggatttggattttaagggagtgtctgtgctgggttcataagccatcagcatgtagacagtatttagagccataggaataatgaggtcaccaagggagtgagtgtagatagaacacacagtccaattcctaaaacacagggtactccaatctatagatgtgagggagagaataagaaaacagcaaaagaaatagaacaagtggctggagacaaggaggaaaaatcaagaggatataatttcttggacaccaatttttctagaaagtgttttaaggaagagtagagtgacctactatagctatgctgagaagctaagggctgagaattgatcattgcctttagcaatgctgaattcattgctgaccttggtaagtgcacattctgtgaaacattgggagcaaaaatccttattgggtgtgtccaacctgagatgaggagagtgattcgaggtgctaagacagttaatcttggaaggagtttcccttgtaaaatgaagaaatgcagtcatatctagaggggtacgttaggtcagaacaggtagatttttaatttaataaaaagataatatgtttgtattatagaaatgactcagtgggggtgggggagatgatgtaggagaatgggaaaacttcaaggagttatatcaaagaataggtaagagaggattgaatttaacatgcatattggtgagtagtttcagctagaaacacatacaatttattcatagaaagaagaaaggaggcagccgggcacagtggctcaggcctctaatcccagcactttgggaggctgaggtaggcagatcacaaggtcaggaaatcaagaccatcctggctaacacggtgaaaccccgtctctactaaaaatacaaaaaaattagctgggtgtggtggcgggcacctgtagtcccagctactcgggaggctgaggcaggagaatggcatgaacccaggaggcagagcttgcagtgagccaagatcacgccactgcactccagcctgggtgacagagtgagactctgtctcaaacaaacaaacaaaacaaaacaaaaaaggaagaaaggaggcataatagatgcacagaggtacaaataagtgggcagatgtgatgggaggtggtggaagcttatagatcttctcattgtctctatgttcctagtaatctggaaaccaaaaatggtagagattttgcaagttcaaggagagatcataagttataaattagtcaactaggaaagtagagattgactggactagggaaatagaactttgattgtgactgatatggtttggctctgtgtccccactctgatttcatctcaaattgtaatccccataatccgcacatgtcgagggagatacctggtaagaggtgattggatcgtgggggtggtttcctccatgctattctcatgatagtgagcaagctctcacgaggtctgatggtttttataagtgtttgacagtttcttcttcacagactctcttgcctgctgccatttaagacatgcgtgcttcccttttcgccatgattgtaagtttcctgaggtctccctagccatacggaactgtgattcaatcaaacctctttttttttttttttttttcataaattacccagtcttgggtatatccttatagcagtgtgagaatgtactaatacagtgaccttcttaggatgattaatatttttgaatttaaagacaggtaatttttttccccatccacatttagctctgtggatttgggcatgcctcaggtagaaagtggacttaattgatgttatagcaagtttgaggttataatagatcaagacagaggcacagtaactaaaatgattgcccattacatttaattgagtaaggatgaaaacaagaacatgagatggatgaggaaccatgaagagtagtaattaccacaaattgtaagtcaagtggcaaagaaattttggagttttcagaggcaagagtaagagagctgaaaatatagtagatggtgattagatggtggcatgtttgaaattgagattctggaaagattgtgattattggcagggacaataatataagatataaccataggaacaaggcattgaaatgggataaagtgtaagatttttggaggagaggaggttaaggaactgagaggccatgatactggaagactgagctgtgtgaatattgaaatcactactgggggagtgttagagaaggtggttgtgagttaaaatctttatggaatgagaagcaaaggaccagggatcagcagatgactttcacaataagaggtacaggtggtttaatcagatggtatgggagtcaaagctgagtgtgttttagagaagagggaggggatgaaggtgatctgaaagcagcagttagtagcaggacagtcacttatctacctgtaaaccccatggtatataaagtgtgggagggaaaatagccaccacgtaagagggctgcagggaagcaggaccactggggaagaatgagaagatgaaaggaatattaactgattttatttatgattcatcatgagtccaagagggcaagtggaagggtttcaggaggagatggtgagtttatgacttgagtaataaatgcctgctgttgctatgtgccaggctctagagtagtcacagacgatataaagatgaacaaagacttgacccctgctcttaaaaagctattaatctagtgagagaaacagacacaggtagatcaatgatttatatgagctatgtgccataatagaagaatggacaaaatgctgtttgagtccaggagagagaatcatgaatttttattgggtatgtctagaatatttctctgagaaggtatatcagttatctatttctgtataacaaacccacaaactataattgcttacaactacagtgatttattgtttcttatgattatgattccatgaaccggcaatctgggcagttctgctggtctcagccatgaggccatagtcatctgatggctcaactgaggctggagggtctacagtggcctcactcatttgtttggccttggtgcttactcttaaactcttaactggggtctcagttcttctccatgtcaccttgtatctgccaataggttagattgggcttcttcacagcctcttggtcttagggttccaagcaggacaggataaaaactgcaagacctcttagggcctaggctccagaactcatacaatgtcaagtgtgccacgtcacgttcttcaaggcaaattacaaggcaaagtctggattgaagaggatggagaaaccaactccacctcctggtgtaggagtggcaacatcatgttgacattgggagacacgattcattggagggcattaccataacaatctaccacagacaataattgagaaccggaccttaaacataagtggaaacccaggaaaagtcattccacgtagagaaaatagaattttcatagcctcaaatacatgacaaacatgccaggtttcagtaagtataagcttgtttgtgtggttggagtttaaaacacatttatgtgtgtatgtatttgagaagaggagcatattggcagaacagccacaggaatgaaaaggatacaagaattacacctaataatatattataaaggaaagctgacttgtagactttgttccaaaggtggggctgcttttatctcaaaggtaacccatctaccctgctcagatggactgccgtcagaggttttaaatatgagggaattcacatccatgaagtggatggaagtttaagcaggaagaaatgaggagtgtggagactagttatggagtctagatgagggaatgtatgtgagaaataaggccatattaacgacaaccacagcatcaactgaaaccatggctgtacagccacgcatcattaaatacttataaaaaccccatgagatagaaaccgttattatctctaccaagtaatggaggaaactgctaattcaagagtaacttttccaaggtcacaccactagtaaatagcaggatctgttcctctgggccacccgtgtaaggatggtagcagtagggttcaaaagatcagaggaaacagtagaaggtatgattgacacaacctgctgacttgaaatagagcagagggtaactcatccaaaatggatacaccttaatatcatggattgaatacattcatttaactttttctcttctgaaaccccacaaaaattatagtaaaagatttttattttaaaagcatgatctaaaagttggaggcctctattacagtgatctaccatgggaaataaacatccttaaaaatcttgaaaagatagtccagtacaaagggcagtcagtgcctcactctcaagatgtgcagatgtgtgaaagactcatggagaatagtcttccaacacaggagacaatagccacaaaactcaagaatctgaaaaacaaatggatgagtggtaactgacaatagccctgaaacaatctaaccatcacttgtcagtggacaaggctaaaaaaaaaaaaaaaaaaaaaaaaaaactctatatttatatgatggagttctcaatgggctcagaaactggtaacatcagcagacttttctatctagttagaatacattttgccaacactctcacctacttaactactgcacagaccaatcactagctagtgtctattgtttagcaatatcagatcctgcacttggccagcacagctcaggctggtgttgaggtggttcctaagaccagtcaagccccaggacagaagacaaatctcatgcttacctctagttgctggcactagagtagagaattacatagagaaaaaacccaggtcactgagacccatgggtaccaaacttaaagttgaaacgcattaatacatggccaccctgttactgtggcaagagaagctgtatctacatgggacagtaatcagcccacacttcagcctttccaccagctcagcagcctccatcagactttctagccatttgagaaatagccagtttcccatcacaaaccagcagataccagcagatactccaacattggagcttccatttcaacagcaacagctgggggaataactttttctcttctctattgggaccccagttctttaataaaaattgaaagtaaagatgaaagaataatggacattataaggctggttaatcagcagtgtctttatttcttgcactgctacataacgtactgtccatacctacatgtgactttgctaaataaacagcaagtgatttcaatggaagaaggcaagaagatggagaccaatggcacgatgatgacagtctgctggtgaaagcttctttccaaagatgatattgatgaggaatgcatgagcatgtcccagtgcatccaagactctgtcactctcagaagctctgggaagctgcttgtcaccactttctcagcaacacagtgaaagtcagagaataatgttgataaaaagtagtatcttgctgcaaggcccgtctctacactgtcaagttaccacattgagttgaaaattttgccaacatatccagatcatcccaaaggcgaaaagagaagcaactgttaatgacctacaccaaataaatcaacaaacacatagcaatatgcggatgtgtacctttgtagtggatcaaatgagcctggacaagaaactctaaatggaaagttttagagcataaagagaacattctagaaaaagaatgtacttgccaaaaaagtcaaaactgagataaaggaaaaattgtagacctggggaatgtgaatttggaaaaataatttatgggtactgaggatagagataacaggggaggtatagctataagcagagcagaaaattgatatccagttttccagaattcacaggtgacatagaagggaaccattgtaccaagtgatacacaaagatcagagttgaagagatgtgatttcgtccacgagtccctttaaagctggctttgtggtgtgtttgtttacaaccttcctaaggtgtcgatgtctaccagttggaacagtgacacaagagatggtaggcatttcttgactttccatctcacaaattaaatttgtttggtgaattcctgaaggatccatacagagcctggactgaaagcacctgtttcgatcttatgtgctgaaagcaaaaccttttctcatcaaatgtttctcttctttgtctttctggctttcatatgtgtgatctaacttcattggttacatctttattaataataaatatctaataaaaatgttaataaatttaaataaatacattgaataaaaataacctatattcatctaacctgttttgggtaaaggaggttcctatacccaagataaggacttgaggaagttatgggtttgggagagaagacacaagatcagtcttgattatgctaagcttgaggttttgaagggttatttgggtagcactgtttaggagaaacttggaagtgaggagccaaagtcctggagaacattttatgtaagagatatgtatggatttgggagtcatcagagtctgagtgacccgggactccagggtcatgactgggaactataattttcacatcttcttctataagccatgtattagtctatctgctacccagccttgagataacatgctcacccaccccacatcttctatgattttgagtttgaaattttcccaccaatatgtaagggaaattatcttccctgctcagatcaggacaaactcataggtgaattcacaggtattgctgggatgaagagggagaaggaatgcctgttggttcacctgtgggttcgaaatgttgggattgggaaggttggcccagggagtaaatgcactgagttaggggatagatatgtttgggagaaggccaaacacaagagataaccattagaatataatctctgtcttagaaagtgaaaaattaagagctgtaaggggtgaggtttagcaaataaatatttctgagcaaaaatagagaattggagagagaaggaaatacggaagaaagaagaacccaacatcagatcaaagtccaaggctcattggctttttgcaggggaagtcacatacaaaccatctcatcttccagaagcttaagatttctgagcaaggtgcccacagaaagggtacttcagagccaccctaccaatcccttttcaggactacagaccaacctcctcagaccctctttgaatagtaagtaggtaacaaagatgatcactggagccaagatggtgagtcttcggagtttccaacctcagcgtgccagctctatccacgccccacctgccctgcaggtgatagacatatcctgggcagaatgcctgccagccccaggaaagcagccagattgtgcagctttgcccagctgtcatagacagtcattccaggataattctccatcacctgaatgtcatgaagaattttccagggactttggagatttatttcttccagaccaccctcagaaacacaaattcctagcatgtaagagccataagatgcatctagtctcacttattcttgcagtcaggaagattgagtaccagagacatgatgtaatgtcctcaaaaatcacagttaaggacagaaccaagactggaatctggattcctcactaccattgcaaactgttcccatgatctcatgcacaaaattatagactcttggattgcagcagtttcttaaaggtgtttgatgcgttctccctgaacatgagaatcacttgtgtaacttgttaaaaatagatttccaggacatccccatgggtctggactcgggatcctctattttcagcagcttctcatatttatctcctacagcctgtatgaatttgggaatgtgtaagacccctacagagtgctctctagcctctgttttaacaatctgcaatgatggatgtcatctctccttccatctttggacaactttgaccttgagaaacttttttttttgtaataaacctaccagcctcctcttgcttcactgcattagtcccaattctacctctgtatcacaaagaatagaggaatggatttgattaaaattatgcccacctagctcttccttatgaaattttcttgcacaaataattttcagaaaatatccaaggtatatacatgcatttttattttacttaacacatttttttatgaatacatttctgtcttttcattatccacaaatttatttttaatagctttatgtttacctaaacatttaaaagtattattcttacagtttcttggcaatacagtttggagtctaggctccaaacagcctatgtgacctgggttggtcactgtgtgaccttgagctagtcaccaacctctttgggcctcagttttctcacctgttaattgataggtttggattaaatgatatttgtagtccattctgactctgatcttctgagattcttcacaggatatgtataaaggcctgtctgaagttaattcttttcactttttctcacgatgttctaactgaatctacctctgagttaatttaggccaccagttttgtcttaagatgtgtgtctcagtctgtcttctgctgttgtaacagaatgccacagactgggcaaagaagagagaaatgtatttctcacagttttagggtctgggaagtccaaaagcatggtgccagcatctaatgagggatatcccatggcagtaggcagaaaatggaaggtgcatgtgtgtgaactggggatggggggtgcaaactcagcctttttattgggaacccactccttggatagctaacccactcctaggataactgcattaattcattctgtagttaatgcttctcactttttctcaagatgttctaactgaatctacctcatggaaccctcatgatctagtcattcattaatgatcccatctcttaatattgttactgtggtaattaaatttcaagatgagttttggaggggacatccaaaccattgcactgtggtacttccagattagaaaaccaaagaacaagaaacagcctctgttttaataacgtgcgatgatggatggcatcatcactcattccatctttggacaactttgacctttagaaactttttttataatgaacttccctgcctccctcttgcttcaattcattcatcccaattctatctctttctcacaaatagagaaatagatttcccaaattagtaattccctgagaattgcccaaagttaatcagtattcttagtctttgttactcttcttctgcttctgtatcactggaaggaagaactttaaaaatgcctcaaaatagagataatttgttggatgcatgtagagggctgaataatggccccccaaaatatcagcttctagttctttacatctgtaaacatttgttgataaagggtctttgaaggtatggttacattaagtatcttcatatgggtaggttattctagatcagggtgtctaatcttttgacttccctgggccacactggaagaagaattctcttgggccacacataaaatgcactaacactaacgatagctgatgaactagaaaaaaaaatcacacacacacacaaaaatctcataatgttttaagaaaattgactaatttgtgttaggctacattcaaagccatcctgagccacatgtggcccatgggccatgggttggacaagcttgtcctagattatctgggtgtgccctaaatacaatgacatgtatccttacaaatgagagtctgaggaaaatttagtatagaaagaagaggagaaggccatatggcctcagaggcagagattagaatgatgtggccagaagccaaggatgccagcagccaccagaagattccttagcacctccagagcaagtatggccctgccatcaccttgattgtggcctggtgaaaccaactgtggacttctggcctccagaactgtgagataataaatttctcttgttttaagccacaaagtttgtggtgatttgttgcagcagccatagaaaactaatacagtgccaaaattacactaagcacattatagtttaaagtagatgacacaatgattttttttagaaaaattgtgattcattaactgaaaaaagaaacaagcaaaaatttagttttcttccaaagttttatttgaaaaaatatagattataatattaattttgaaagcaaattatactaacatgaacttatgtagtagaattatttaataagcattcagcttaaattgcttaataaagttataaattgtatttgtccaggtctaatgtagtttaaaatatcttttggatatcataactaatcatattatttccacgttcgtgatggaattaaatcaattagttataaaataaaatttattcttaattagtatgccaaaatttatacatacataaaataatctcttaaaatattcacttcgaaaagtggtatatttatttcagtaatgcttccattgctttgattttttcagatttttttctccagtaagagcttttagaacttgtttaaatatcctcaacagaagcaaagccatgaattcataaccatatatacatttatataatcaaaattgatttggagattctgctttggagaatggtagactagcctactcagaccaactgtctgaatgagaacaattacaaaatctggtaaaaaaaaaaaaaattcacttgatgtcactggagagttaacaagagaataaagagttactgggccaagattcatgctaacataaacatccatagatatgatggtggccttgggtgctgtttttgccctggggacatttggtaatccaagagagcacctgtcagacgatgcctttattaaggcccatggacattatctcctatgccataggggttgtggatttgctagtttaaagaaaacacatgcaaagatgagagcttatttacctgactctggtattgactattaggttttaccatggtcagcagctgtgggctgtgtcaggtttgggtcagggagatgaggaacaaggaggctacatcttaaccgcacggggaggggacgttttaacaaggccaaaggtgatgaggtacatcagggtaaacatgtgttaggcctaaaaatggatgtcaaggcagcaactatattaaacaaatttatgatgggcagtgattactgtttacctctaaggggcagggagtatattgtgattgggacagtacctgcaagagactaccagagtgttgaaaaaaaaattttttaacatcaatcatggtaacatgattaaaataatgtaaactgttcccacagtatttcttcttagcacttttctgtttgtataatatttcacaataaaaatagctttccttttcctttttccttttgttttacaaaaagtaatttgaagtcagttcggtgaataaagtctgtaattaaagagggaaatgccaattgtggtttaaataaggtgtgactctgggtaaatgaagtcagttttcttgttgtccttaaaagctgtttcataagtttatttccaaagagcatttccaaaaacatttgtagcacagccaatactgatggaaggaagggtgtggcttttttagggccaactctgaaaatgacagtgcttaattaaatattgattatgctgtggttgccttaacaaatgtaacttcactgtaacatgttttatttaaatgtatgaatttttcttcttatgggattcactttagtaacaacctcttaaaatcctgtcaacttataactgtgaaagcaaaggcatatctctgatgctcctggcctttgtgtcattaaaatcttactctaaatgtcgcattaattcatcttttcaacatttttccttgtttgatttttttctcctggaagaaaaaatgctaagtggaatgaaggaaggaaaagacaggcagtttattaaaagtcaaaatataccatacaaacccctaattgtactctaaaatttctttttaaacgtttctattaaaaaattctgggccgggcatggtggctcatgcctataatcgcagcacttttggaggccaaggcgggcggatcacctgaggttgggagttcgagaccagcctgactaacatggagaaaccccgtctctactaaagatacaaaattagccagtcatggtggcgcatgcctgtaatcctagctgctcaggaggctgaagcaggagaattgcttgaacctgggaggcagaggttgcagtgagccgagatcgcaccattgcactccagcctgggcaacaagagtgaaactccatctcaaaagaaattaattaaataaaacattctgtttccaataagataaaatttgagaagagaatgaaatccagatttagtgtagctgacccgggatcactgactcttttttagagaaggaactgggaaactgcagtggacatcatgctctggagcaacagtgactatggatttcactgtatcatcggtcgcagcatggaattctatacactaaaatcgctggatgagatgctggtgggaagaccctaacaaaatcgtgtttctgacagaaagtgtatacacattatgagcaaggagaacattagttttcagcttagctccttgtgcagttgaatttgttactctgttctgaagacattggtgccagataaaagctttaaacacaaaacgttgttactgacatgttaatataattatgccacgtattatatatacaaaactttaaaagctaaatttagaagttattgctgtatcatttatataggctttgttctccttaaacacgttgactttaataaggcatgttttgtacaaataaagtctaattctaccatcagttgcagccacaggaaatttgaagtcatttttatataaaatttaaattccaacacttaattcaggttctatgacaccattttctagatccaagaaggaaatcattggctcaggattttctacagcgatctatcctgtatgttcctcagataatatgcccctagaatattattttttataagaattaatggcagaaacatttgagcttatcactgatggcatttgttgactatcaaaattgtctaaaacctcccacatttatccaggtataaaagtaaacttctaggttgggtgtagggtaggttgggagtcaaaagaggacactctatagagtcacagttcataggttttcctaaagaacactttctaaatctaaatttttcctcccactaagccaaatgaggagggctccagggaaatcactggtgatgattaggggtcctacaagaagcagggtgttaaccttctcactgattggattcttgctgagctgttgaacccatagctcatccttgcttctgctgccagagaggaaaatatggaaaagttcatgggccatttgccagagtttgtggatgtatatgaactgagactcttgaggctaagaggctgcatggggcagcccacaccaaaaggcaaatagggcccatattgtagtgtgatgcttaaggagaaatatatggaacactgacctccccacccccaggatccctgtgactcttggagggtcaagggagcatcatcatggagacagaagacagagaaagagaggaaaagaggaagccgagcccacccttttcctgtctaggtcctctagacaaagctgtgaagggaaaaaaaatagaagataaaatgggatttaaattttaaactggactaaattgcaagtgaccagaaagctaaagggtctgctcaagatgtcataagggaaaagtaaaattatttcccattggtacctcatcgagttcatattgttcaagaaactggatataatacctagtgacaaagagactaggacttctgttttgttcttgtcatacagccaaatattgttctggtcacacagccataacaatacccattggggcagaacactgaactggtaagaaagtaagggaaatttttagaggccttaaaatagaaagtgagaattcaggaaagtagactcgttttagattagtcttttctcagaggacatctgtccatcctgggtagtctagggcatgaattttaaaagcctatatgagtatcaagtaaaaaaattgagtagggtggcagtcagttcagagactcctgaagagcaatacgattattagatgagtagggggagaaggctttagagaaggagatgatggaaataatcgttttgtctttggctattaataggtgaaagacaggagaaaaagtctccctagaaaattcctaattccaaattctaagtctattcttgttggcgtgtctcactaaaccccatgtggcccaaaaattcaagcaaaaatttaaattgtctttttttttcccccactcagtaaagatttaatgatgaaaaaatgcaagttttataatacaaatatataaaattatgaaaacaatttttataacaatcatttgatagtctttttttaaaagactacagaaagtttaaaatataattttgtaattatagatataaacaatgaagttttataaaattaatcatttgatatttttaaaaaggctatccaaaggaatttaaaatcagaatgttgttgaaactgaacaccaactgtatctacatttatttctttttttaaaatactttaagttctagggtacatgtgcacaacatgcaggtttgttacatatgtatacatgtgccatgttggtgtgctgcacccattaactcgtcatttatattaggtatttctcctaatgctatccctcccccctccccccaccccacgacaggccgtggtgtgggatgttccccttcctgtgtccatgtgttctcattgttcaattcctacctatgagtgagaacatgtggtgtttggttttctgtccctgcaatagtttgctgagaatgatggtttccagcttcatccatgtccctacaaaggacggcattattcacaatagcaaagagttggagccaaccctaatgtccatcaatgatagactggattaagaaaatgtggcacatatacaccatggaatactatgcagccataaaaaatttaaactttctctatttcagtactgcccccagctaccaggaagaagcaaacacatctcctctctggagaagcacacattaaatacagaacaaaaaaatttccagataaaaacaaaagtcactggaaacataagaaaacaaaacaacataaggataagtcagcaaagagcacaaatggcagaatccaacacataaagattgcagacattgtaattatattcagattatagaataattattagatcatacgaaattgccatttttataggtcaaagctggtaactatctgcagttccatatgcttaacataatgtttttaaagaaataagagagtactggaagtatgttgaagaaaagaggattaaggattctcaaaaaggactagaagctttgataagtagccaaatggaatctctgcaaatgaaaaatataattgaaattagagacttaatagaaacattaaacagcagatttgacacagctaaacaaagagttgataaactagaagataaagcagataaaagtactcagaatgtatcacggaaaggcagaaacaaataatatgaaagagaggttaaaagacttgaagaagagagtgataaattctaacatctaaccaaattttgagaagtaaataacagagaaaatgggaagagcaattcttccccattgtctttattatttccttccaaatttaaagatctaatagttgacagtttttctgagtggattaaaagcatcgggttccaaaagccaaaaaaattccaagcaggataaaatgaaaacaaatctatatctagctacattgatgtcaaatttcagaacactaaacacaaaaagaatcttcaaaatgactagagagggccagctgaggagacttcacctgtgttccaagcctgagaaacagcaccatgggccacccctggcagacacgtccctaggctggctgagcagctgtgcacccatgtcctgggcctgagaaagagccccacagactgctcctggcaagcatgcccccaggccagctgagaaaccatgtgcccctagacagagtaacagccctgtggtcccaaccccagtgagccagaccccaagaaagctgacccactgtgtgcagacatatgcctccaatctgagcaacagctcagcaagcccacctctggaaaagttgcaccgctaccagcacaaactgtctaagcctaggccactgagacattcataaatatcgctagtatggattacagcttaagaaactactggagactatactactgtgtctacccagaagcaaagccaatgcactgcattgagcccacaccccaacacccacataaatgaataaatcttttcctattaaacctactccataaaattggaagaggtgactgtttcatcagatgtgtagaaatcaatgtagggacacaataaacatgaaaaagcaaggaaacagacctccaaaggaacacaataattccctagtaataaaccccaatcataaggaaataaatgaaatgacagaaaaagaattcaaaataataattctaaacaaattcagtgaaatataagaaaatatattcaatgaaatcatgaaaacaataagtcattattttaatgagaaattcaacagagatagatatcatttaaaatgaaccaaattctatggctgaagaactcaatgagtgaaataaaaaatacaattgagaacttcaacaccagactagaccaagcagaatttgttcttacttgaagacaggtattttgaaataatacaggcaaacaaatagatgaaattaaataaataataaaaaggaattaagtcaaaggatttatgggatatcattaagtgaacaaatatttgcattgtggacattctggaagaagagaagggaaaaggtgcagaaaacatatttaatgaaataatacgtgaaaactttccaagtcttgggagaaagatccaggaagctcaaagaaccccaaatagatataatccccacaggtcctctctgaggcacattttagtcaaattgtcaaaagtcaaagacaaacagcaaaagaaaagcttcaagtcacatataaggtaatctccatcagattgatagcagatttctcatcagaaaccatgtaggccaggaaagaatagaatgataaagtcaaagtagtgaaagaaaaaaaataaaacttgccattcaatattatgcccagcaaagccattctttagaaatgaaggagaaataaaaattttcgcagacaagcaaaaattaagaaaattcatcaccactagaccaaccttacaagaaacgcttaagagagtcttacatctagaagcgaaaagacaataaccactgtcatgaaagcatgcagaactataaaacttattgatggagccaatacacaaaggagaaagaaaaagaatcagaccatatcactacagaaaaacacccaactgcaaaaataagagaggaagtaaggaacaaaggatatacaaaacaagtaaaaagaaatcgataggatgataaaagtcctcaccgatcaataataaccttgaatgtaaatagattaaaatctccatttagatgtagactgactgaacagattaaaaatacaagatacaatatacagcccacaagaaactcatctcacctataaagacacaaatagactgaaagtgaagtgatggaaaaagatactccatgcaaacagaaaccaaaagcaagcagagtagctgtacttatatcagacaaaacacacttcaagacaaaagctacaaaaagagacaagggcattatatgatgacgaagagattaattcagcaagagaatataacaattgtaaacatatacacttaacactagggcacctagatatataaagcaaatattattagatctaaagggagagatagactacaatacaataatagttggggactttaacaccccactctcagccttcgacagatcatctacacagaaaatcaacaaagaaacatcagatttaaactgcactatagaccaaataatataaacctaacgacatttacagaatatttcacccaatagctgcagaatatgcattttttttcatcagcacgtggaacattctccaggcttgaccgtatattaggacacaaaacaaatctcaaaaagcttttcaaaatcaaaattatggccaggcatggtgtaatcccagcactataatcccagcactttgggaagacaatgcaggaggattgtttgagcccaagagtttgagaccagcctggacaacatagtgaggctttgtctctacaaaagattaaaaaattaaccacccgtggtgctgcacacctgtggtcccagctactcaggcggctgaggtgggaggctctcttgagcccaagagggttgcagtaaggatgcagtgagccatgatcatgcctctgcactccatcctgggcaatagagtgagactctatctccaaaaaaatattgaaattttatcaagtatttaatctgaccgcaatggaataaaactggatatcagtaacaagagggacatttgaaactatacaaatacacaaaaagtaacctgctcctgagtgaccagtgagtgaaggaaaaaatttaaagtgaaatttaaaaattccttgaaacaaatgtaaatagaaacacaacataccaaaacgtacgggacacagcaaaagctatattacaggcaagtttatagcaataaattcctaggttgaaaaactaaaaagatttcaaatcatcaacttgagatgcatctccagaaaccagaaaactgagaacaaaccaatccaaagttagtaggaaagaaatgataaagatcagagcagaaatgaacaatattgaaactgaaggaaaaaatacaaaagatcaatgaaataaaaagttggttttggaaaagaaaaacaaaattttaaaaacctttagctacacaatgaaaaaaagagaagactcaaataaatcagaaatgaaaaaggaaacatcacaatgaataccacagaaatacaaaggatcgttagagactataatgaacaactccatgccagtaaatttaaaaacctagaggaaataaattcctgaacacatacaacctatcaagattgaaccaagaagaaatagaaaacctgaataggtcaataacaagtaataagattaaatcagtaataaaaagtttcccaaaaaagaaaagcccagaattggatggcttcactgctgaaatctaccaaacccttgaagaaaattaatgctaatttttcttaaactattccaaaaatttgaagtagaggaaatttttcctaactcattctatgagaccagtgtaactaactagataaggatgcaaccaaaaaatgaaaaaggttatacaggttaatatccttaatgaacatagacacaaaaatcctcaacaaaatacaaaccaaatccaacaacacatcaaaaagataatacaccatgatcaagtaggatttatctcatgaatgcaaggatgattcaacatatgcaaatcaataaatataatacatcacatccatagaatgaaacacaaaagttatgtgattgtctccaaagatggagaaaaagcattcaatacaattcaacatcccatcatgataaaaactctcaattaagatggtatagaaggaaagtaccttaacataataaaggccacatatgataaacccacagctaacatggtactgaatggggaaatctttaaagctttttcactaagaactggaaaaagacaaggatgcccactcttaccattcttattcaacatagtaatggaagccctagccagagcaattggcaaaaaaataaataaagggcatccaaattggaaaggaggaaatcaaattgtctctgtttgcaggcacatgaacttatatgtagaaaaacctaaaggctatatcaaaaaactcttagaactgataagtgaattcagtaaagttgcaggttacaaaatcaacatacaaagatcagtagtgtttctgtacttgaacaatgaactaatgaaaaagaaatcaaaaaggcaatcctacttacaatagttacatttaaaaaaaacctaggaataaacttaaccacagaaatgaaagacctttgtaaggaaaactacaaaacactgatgaaagaagttgaagaggatacaaatggaaagacatctcatgctcatggataagaagaattaacattgttaaaatgaccatactacccaaaacaaactatggattcaatgcaatctctaccaaaataatgatattcttcacagaaatagaaagaatcataaaaatgtacatggaaccacaaaagaccatgaatagccaaggcaatcctcagcgaaaagaacatagttagaggtatcacactgctagacttcaaaatatactacaaagctgtagtaaccaaaacagcatggtactgttataagaatagacacagagaccaatagagcagaagagaacccagaaattaatccacatatctatagccaactgatttttgacaaagatgtgaagaacactcactgaggcaaaacaaaacagtatcttaaataaatggtccccaaaaaatcagatatccatatacagaagaatgaaactagacgctcatctctcatcctatactaaagccaactcaaaatggatcaaagacctaaatgcaaaatctgaaaatataaaactagtacaagaaaacataggagaaatgcttcaggacattggcctgggaaaagattttatgaataagaccccactggcacagactacaaaagcaaaaataaacaaatgggattatatcaaactaaaaagcttctgtacagtaaaggaaacaagaatgagaagacatcttacagaatgagagaaaatatattcaaacttttcatctgacaggaggtcaatatccagaatatgcaaggaactcaaatatcttgacagcaaaaaaaaaaaaccgaacaatccaattttaaaatgggcaaataatctaaacaggcatttctcaaaagaagacatacaagtgaccaaaaaatacatgaaacaagtgttcaacatcatgaatcatcagggaaatgccaatcaaaaccacaatgaggtatcattttaccccagtcaggatggctattatcataaagacaaaaataacaaatgctggcaagaatgcagagaaaagggaacttatgcactgttgatggggatgtaaactagtagagccactatggagaacagtatggaggttcctcaaaacactaaaaatagaactactatagcatccagcaattccactactggacatttatgcaaagggaaggaaatcagtatatcaaagggacatctacacccccatgcttattgcagcactattatatagccaagatatggaatcaacctagggtgtccaacaatagatggatgaacaaagaaaatgtggtatgaatatataggtatatgtgacggaatactattaggctaaggaaaagaataaaatcctgtcatttgtggcaacatggatggaactggaggatattatgctaagtgaaataaggcagataccacatgttgtcactcatatgtggaagctaaaaaatattgatctcatagaagtagaaagtagagcagaggatactagaggttgagaagggtagagagggggagagagttgttaaaggatacaaaattacagatagaagtaagttctagtgctctatagcactgtagaataactctaattaacaataatatatagtttcaaatagctagatggagaatattgaatgttttcaacacaaaaaaagataaatgtttgagatgatagactatgctaattactccaatctgatcactatgcattatatgtatcaaaacatcactatgtaccccataaatatgtacaatttttacatcaattttttaaataaaataaaacaactagaaataaaagacagattgcctatcaaaaaacgactgacagctaacttctatgtaaaaatggacgctacaaggcagtagaagaccatctttcatgtgctctgataaaataacaattagaattctacatgtaatgaaactatctttcaacaagagcaaaattatcatgcaaaagaagtgaaaggaatgtatcactaccctatctttaccaaagaaatgtctacaaaatatattttaggaagaagaaaaattatctcaggatgaaagtttgagatatcaaaaggaatgataaatactgtggtaagtggggcttaatctaaacaatcatggactgtataaagaaaaagcaataatatccactatgaggagttaataagaacccaagtgacttctaactactggaaaataagagcatgcaaattgggaaaggatataaacgtcctctattgttcggaaaaatggtaaagctacttagtagttttagactggtaagaacactcactggggcaaaaaaacagtgtcttaaaataaatgttgctgggaaaactggatatccagatgcagaagaatggcttcttaaaaagccattcttctgcatagctttttaagttgaaattaattaaagtcatgtagaatattaaaatttagtcacctgcattaataaaatttaaaacttatgctcatcaaaagatctattaaagtaaaaagaagccacaattggaagaagatatttgcagcacacaccaacaaagcattagaatcatgaatatataaaagacttctaaaaattgagaaaacaacaaacaatgccatagaaaaatgagcaaaaccatgaacaaacatttcatagaagagaaaatatacatgaccaataagcatacaacagttgctcaatgtcattaataatcatgaaaatgcaaattaattaaaactacagtgagatatcattttaattcactaaactggaaaaaattagactctgaccatgccaggtatgcacaagtgtgtggaacaaagggaatgctaatcgaatgctggtggaagtgtgcattcgcaaaccacattggaaaacgttgtggtgatgcctatggaagttgaactcttacatatttatgacttggcatctccactccaaggaatatattatagactagagaaacaattgtgcaagtgattgaagacactcatcttagcagcattgttcgtagcagcaaaattctggaataatccaggcatgacgtttggctctagaatggaaagagaaagcacattatagtcatatggtagaattatacaaatgaattagctataggctttaacaaggatacaattcaaaaacaatattcctgagaataagcacaggatatctcatgatcccaattatgtaaagtttaaaatcaggcaaaagtaagcattgtattatttagtgattcatgcatatttggttaaatggtaaaaatacatacttgaaaaggaggactaacttttgtggggaaagtagacaacaagaaatgtttaggtgtggaggtactcggtatcaatctcaaagtatactcataatgttttcttctttttactgggtggtgggtacctttattattttagaatacatctttatacttttacatatatgcttatgttgcattttgcaattaaaattttttcaagagtttacagttatataaacatatatactatatttacagccatgaaaaaattgtacatatatatatatatatatatatatatatatatatatacacacaaacacactagtatgtgtgtggatgggagagggagaaagattgattttaaaggaatataaaataaaggtgtatcacgaggtgggactaaatgaacacatttacttgcagaagatgaatttgactttactgtgcttttttggattgtgccgactcataaatctaactgggcttttagtagacaggagacgattgaacattattccatcttatgtattttcaaacagactgtattattttgggtgttgtgtgtctcacccacactgtcaagattctgtaaacctgcaacgtgatccattcggctgcgctctagttattatccaattatcatccattctgcttattaacaggcataaacagacagtatttctgcatggagctgataccctccattatgggtcaccggtcccgttcttaagtaggattgtgaaggaaaaaagcagagaacttcatcttcagtactaatttctctcacttaattccttctgttttactctttctcaagaatgggcatttatcctctactggtgaagaaagggcagagttgtaggagccatctacggtaaatgcaggctttcaaagggtggggggggacggtagagattttaaacgtaataataaaactgaacaaaatttgatctgctgtatgttatcactatgcaattctaaacagtgttagcatgaaaatattcctcccctagaaattattttgttgatctaagagtactgaattgctacagttacttttgcattgtaataatatatctgtaagcttcaaatcagcatattatattctacatggacgttaactcagagaaccaagagttgcacagggactgccagcacactcagtgacacacacacgttttgatcgtataataagtgcctaacagggtggaactgggcacagggcatgtctcagacctgtatggtacttttaaaaaaataagttaaaataaacactggggcatggtgatggaaaagatgaaaaaacagaacgtaagttatttcaatgttgtcactcggtgtggccacttggagtttatatttgcattttactgttgcatttgaaaattgttaaagtgaaagtgacaagtgcaagacacactctttttgtttggtaaatatacatttcagtccacacatgagaatagttattgaatgttagaagtatcttttaaaatgaaatgtatgttttttcctatcttttggttttaaaagtgaaagaaaaagaaattttagaaaatttaaccttatgttacttactagtataatttagtggttgcctaaattgtactgtttgcatacgtttcagttttattaaagatcacttattggctgttgtcagtaaagagaggatgttaaaaatgatgtgttctgagtgtcaaatccataggtgtactctgtgatcctcttttccgatcagttccccgagtgtcagtaggaaatctaaacagctaaggaccaagcacaggaggagatataaccaatggacttttaactgaggggacacggtttgcatattttttttatttttattttttattttttgagacagagtctcactctgtcacccaggctggagtgcagtggtgcaatcttgtctcactgcaatctccgcctcccggattcaagtaattctcctgcctcagcctcctgactagctgggattacaggcttccgccaccacacccagctaatttttgtattttttagtagagatggggtttcaccatcttggccaggctggtctcgaactcctgacctcctgatccacccatctcagcctcccaaagtgctgggattacaggcgtgagccatggtgcctggccggtttgcatatttgtaacggtgtctttagcacctgcccgtcatctttcctaaacttggtctgcttgagaacacaccttgcttgccatgtcgtttataggataattttccatgaatggaattatttgaatctcaaagattttgtcaaaaaatatattcaaagcttgggtgtaatagacattacacctgaaattacatcctttgcggttatctcaatgtactttaaaatgtttagacattatgctaaaaatatgttaaaagggggcgtcattttttcaatttctcttagggatcacacaaggaagaaaagtttttcaagactgctgatgtaaaatagtgttatcagacagtgttcacatttggagggattgttggtagccaagtctccttggtgtttcttgtgaaagaattcttgagaaagaaatatcaggcaattggggtatattccttaaacatatagtagggaatggggctggtgaatcagttctgaatgcctgttttcttctttaaaattccagccaatgatatgaagcccaggtatgtgggggccttttgatgacagtgagggtgagactaaggaagctgacctgccctgcccagggacacaaggctggctagcaacagagccaggacattagtcagtgtgtctggctctgaagcccccatgggggacactgtctcccatctcctttctcctgtgtttagccttgactttcaccttcaatgtcatgccagacaaagagttgctatggggcaagtgggaaaggcaaaactttttctgaactgctctttaatttgtcaatatagcccaaatctagttgcaatctggtacacttttagtcatgaacgagggtggaagaaagctaatatcacatgttgacctttcattttgccaccaagaagctctccttgaatattctgaaggagaacacgttcttgctgggggctggataaaccttaaaaatttcatgcccctgaatgagcatttcccctcatcacggacttgtccctggggctttcttaggcatgggcaggatgtggattgaaggaagaaacccagtgtcatgggcagcaaaggttgaatgtcttctgtgtctagtcctaacactgacttggagcccattcctcatcattttatcttactttctcccatctgaaaatatttacaaaatcatgtttgatgtcaaaatactaaatactatttggggggccgggtgtggtggctcacatctgtaatcctagcaatttgggaggctgaggcgggcagactgccagagctcaggagttcgagaccagcctggacaacacggtgaaaccctctctctactaaaatacaaaaaattagccaggcatggttttgcatgcttgtagtcccagttactcaggaggctgaggcaggagaatcacttgaaccctgaaggcggatgttgcagtgagccaagattgtgccactgcactccagcctgagcgacagagcgagactccatctcaaaataataataatagtatttggaggattttcccagagcatttgggaagcatttgtacacaaatgagtctgtgagcaaagggccaaggcaaggggcaggagctcagatgcaggctgtgttgatggggctcaaatccagagccccatgatccctatcccgtgctccactgcaccatcctattatcctattttgcattttatttttacattcctataaataaaaagtgcaatcaaataacttgaaatatggtattgcttttgtgcttaaaaataatctcagaaatacagcaaacatgccattcacttgaaattctaaaaaagggcaaaactatgttgacagaaaacagatcaatgatttcctggggtgctgggggtagcagtgggtaggaagagaattagctgtgaaagggcacttggaaactttttcagatgagagaactgctgtatcctgatggtgagggtggtttacacagctgtatacggttaccaacactcatcaaactgtgtgcttaaaacactgactatgcaatacctttatgcttatgtctttttataatttaaatagggagaaaaaatatgtattttgtaatatacatattaatacacattataagatatatataaatatcaataaataataccttatttggaaatagggtttttgcagatgtatataattaggcccaccctaaatccaatggctggtttccttataaaaaaaagggagagggggctgggcgcggtggctggcgcgcctaatcccagcactttgggaggccaaggtgggcggatcaccaggtcaggagatggagaccatcctggctaacacagcaaaaccccatctctactaaaaatacaaaaaattagccaggtatggtggcgggcgcctgtagtcccagctacctgggaggctgaggcaggagaatggcgtgaacccaggaggcagagcttgcagtgagccgagatcgcaccactggactccagcctgggtgacagagcgagactccatctcaaacaaaaaaaaaaaaggagagggatatttgagatacacagacacagagttatatattgtacattttacaaagaaaaaaatgtacatatatatgtatacctatatacgtatgacatccctttctattctgtcttccacaaatgtgagtataagtcttcacagtgggaagtaggaatgatcagagatggagtattagtttgccagcactgccgtaacaaggtcccacagaccagatggtttaaacaacaggaatttattatctcacagttctggaggctcagaatccaagatcatggtgggggcagggttggtttcttcggagacttctctccttggcttgtagatggccgccttctcactgagtctccacatcctcttccttctgtgtgtgtctgcatccaaacttcctcttcttgtggggacaccagtcatactggattcaggcataccctgatgacctcattttaacttattttcttctttgaggaccctatctctaaatccagtcacattctgaggtacatgggattaggactccacatatgaatttttggggggacacaattccacccataacagatggagaatagtgcttgaggtctttactaatttactcaccttggctctatttgaggttttctgccaggagcaggtattttataatttaaagtatacatatgggaaaacacacacacatacacatatatatatacacatatacacatatatatacacatatgtgtgtgcatatttcaaacaaggcagagatcatctgtgacccaaatatgtgctgatgagatcaatggactgtgctacttattggtcccataacatatcacttgtaacctctatctatgaccttccacgtcagtgcaataactaatacagccatcatacacagctgtgcaagagttaacattttattcttctgtgactgaacttctgtttcgagtcccccttttctcagagttgcatctcagttggtggggctgggggtgtctgtggtctcaggcagggaaggcaggcagctcttctggacctggccagagtacatggtcatttctccaggatggtctcccttagacagcctcattccctacctggccactcacatgtgttattgctgcaccctctgtcctgaccctcaggcttcttaagtttgactctgaagccgcactctctgggtttgaatcccagctctactcactatgggctctgtaccttggccacttcactttactttacttctttgtgctttgattacctcatctataaattagagctattcataatagtatctacttcatgtggctgttgggaggattaaatgagttagtatgtgaaaacatttgaaagcgtgtctgccccatagtaaaagctgtatactgtaagtgattcccattattagtagtagtagtagtattgttactgtgatgtcacatgcctcattggtgttttattttggggagcacataaagtactccatttgcctctcttagctgcaagagagaaattctcctgggttgtctcgggtccatgtgctggacccatatttctgctcctgcatcatgctgggaatacagattgtggagctggggtgcagggaggtgtatgactttgccagcttcctgtatttcccttgagaagtggagcggtgctaattgtccctgtcccggatgttccatcaactgtgtggtcccataccaacccctcaggggtgtctgcccaacccccaccccagctttctttccttctttacttagcatctactcctcaggagactgctttgcccagtatgccctaagataataaatgaccttctgagagtcaaatgccaggactcactcttggtctgtttgtcctcacccggctgctcccttgggggtaggccaggacacacactgggtgagaagcgtggtggaggaaaattatctgagttaatttatcaaaatacattattccccagtgacactagggaaaccttacagaggccccgccagcatcaaagagcaaggttctgtttcccatgttccgttacccgatccccagggcctgaaacagagtccagggaatatttggaaactaatcgtcatgagtggtagcatcctaagcagtaccattgtttacctcctaagatcccccaataattgtggttggctatttgttttctagtcatttagacacacacacaaaaattgtttttcaaatgagaaggggaatccacaacaaaaaactgtggctagcttattttcgagtttgaatgctttgtgtaaattaataaagttgaagtctatcccatgtgtataaaaatcttggagttatgttcattaatgagtctattgaattagttttcataaattcttctgattcaattgcatattcttaaattaacaacaaaagtccaacttgtatcattaaagactcaaaacagatggtgggaacagtaaagtgtaggaaagtgggaaaaatccttaaaaaataaacggttctttaaaataaatgaataccaaataaaacagaaaagtataaagagctatagttctttttttttttttttttttttaactgagacagagtctcgctctgtcacccaggatggagtgcagtggtgcgatctcagctcactgcaacctccgcttcccgggttgaagcgattttcctgtctcagcctcctgagtagctgggattacagatgcatgccaccacgcccagttaatttttgtatttttagtagagacggggttttgccatgttggccaggctggtcttgaactcctgacctcaggtgatctgcccacctcggcctcccaaagtgctgggattacaggcatgagccactgcacccggccgggagccatagttcttggtggaaagcaaagcttttcacatcagctagtgtagtgtctgaaaaagtcctcattatagatgggacaaaaagatttagtgggaagaagaaagagaacattgagacagttatgaaaagttttaattgtaaattttaattctcatgtgaaatgaaaattttgggatactttcacacacacacacacaaatgttatcctcagattaaaatatttatgtgggaaatgtttagaggtaaaatgtttagaggggaaaaaaccacttaccatgattgctgccagaaagggtaaaccttagaatcataatactgcagaatttaatgatcctttgtgagcttctggttcaacactcgttttacaagcaaagaaatggaggctcagagagattggttaggtgagccctgcaaggactcatggctaaatagtggtgaaatcagaagctaaagccaggttttctggcttttattccaggactgagatgtagtgacctgactctcgtaagtttctggcttcttccttttggagccacaggtaagcaccagtctagaaccttccactcagacttcatgctccagggttgtgaccagagcttacaagggtgttgtcctgggctggaagcagagactgtgaaactcaaatatacttaggcaaatgcaagcatatgaataaatcaccgaaatcaggacaaacagcttttcttagataaattgcccttggaaagaaaggtgaaaactaagccataatgcatgaatgtgttaattgtttttctcttctacagacactaatttattctgaagggaatgcttcatttccaaattctccttctactttaaagaaattcaaacttcaagaaaaaaattcaacaccatattgtgattgcttcaatagttaagaatttcggctgtcacgactgaaaaaaatcattagcaaaaactggccgtggaaaagggaagtctgtctagttcatgacaagcatccatcatcgtatgtgagttagtaatttctcacctctcatttgagagaggcaaggtacctgtgtgccattggggtgggctttccccgcagtgacagatccggatagatcaccagcctggctaagctccaagccttaaattcctttacttctcacccctgggccatttccgccacttttcctccatctcctttatccatttaacatctgttacatatatgtatatacacacacactttaagttctagggtacacatgcacaacgtgcaggtttgttacataggtttatatgtgccatgttggtttgctgcacccatcaactcgtcatttacattagttatttctcttaatactatctctcccctaggcctccaccccctgacaggccctggtgtgtgatgttcccctctctgtgtccttctgttctcattgttcaactcccacttatgagtgagaacatgcggtgtttcgttttctgtccttgtgatagtttgctgagaatgttagtttccagcttcatccatgtccctgcaaagggaatgaactcatccttttttatggctgcatagtattccatggtgtatatgtgccacattttctttatccagtctattattgacgtttaacatcttttatttatttttatgttttactttttgagacagggtctctgtcacccagactggagtacagtggtgcaatctcggctcactgtagcctctgtctcctaggttcaagtgattcttgtgcctcagcctctccagaggagactttgacaaatatatatatacacatacatacacaaatatatatatatatatttgtcacaaggatttgaccttatgcaattatgtttgctggttaagcagcctctgtgaggctgttgtctttacatctgaccatgagatgttggagcttgaagtccaagaggcaggtggtcagcagaggaagatggatatgaagtcgggagagcagggatgggctgggacccacaggcacacacagaacccatgaagacccaccggaactcaggtcagttatcgctgcctctctgggtgctatagttgtcctacaggatatgccggctcccatcatcacagacatacacacgcacctggcccaagagtcacagaagctgaaggaaaattcagggaaggtagagcagttgtgacttggctactgccccacccagcaacatgagccacagataaaacaggtgtgagctacagaatggctgccgcttccctgcctcctctgaatctcacatgtaagcatctcttgtggcccactctaacaagaaacattcaggaaaggagatctgggggagggggagcctctccaagctgacactttgcaagccacccagtctacaatgtggagaatggttgcaaagccttccacacttcttcctgccaatcctcaccctggtctccagggtcaagtgtgcactttctggggatgcagcctctccaccccacacacaagttgtaccgggaaaaactgagatttccagcaggcagagattgagaagcagcagctaataacattacaaggccatttggcagcagcgcaaaccttcaccattacaattagagcaagtggaggtaaaagagactctcttaatggccaaatcaaataaaaagtgacaggcttctgaagattatgttgaaccctgtatggcatgttaatgaaacaaagggtcagataccatttcatctgtggcttatctgcttagatagaagggatgtttttctgcctagtcctacctgaggatttccaagccacccctatgcatgaagatctgacacatttttgtccgcacttttctcagagtgttggggaaccaggactgagccagcagcgaaatattctgtgatgtaaggtggaatttagaataaaggtattttggtgatcaagcagctcaatggtccttaaccttgactgtaaccttgactgaatcacatgcaaagctttatagcctttctgatgtccaagctgcccagagatttttagggtgcacccaaggcatcaccagttagtaacgcatcccaggtgattccaaggtacaaccagagtctagaaccagggatctagtctaatccttttttcagataatgaagctaagtcatagagaagttaggtgtgttggccagtagtaaatacaaacagtagaacccaagtctcccaactcttaaacttatcaccttccactatatgccctgccatatctgctattgagaagagtgagaaacacacattaaaactgcatactctactgtgttccaagaatgggatgactttgaaatgcatgctatttgtagaatataggtagtgagactgatgcctggtcattcgcctacagccttaacacctcctggaagtctgattctttcagtttaccttgcccatagtgtgagacagagaaggaaaatagacgagtctcagaatgcattgttcagtggaatgcattttggaatgatcctacaaattacaggaaagctttaatcgccaataattaggtgtcttaaaaatggagttgtcttctggcgtatgctgacattatcagtccaagatagacttgagccaggagcctctgtgacagtatgctttagaaagagtgagagagggagcatgtgtaagctaagaaaacctttgtaaataagcaaagtcttattcaacctacagtctgtcctcagagctatcatttatcaggggaacccacccctgataattcaacatgagtccttttctattttccgtaagcgtcggccggtctgagaaacaaagggaaagagtacaaagagataaatttttaaagctgggtgtccgggggagacatcacatgtcggcaggttctgtgatgccccctaagccacaaaaccagcaggtttttactagtgattttcaaaaggggagggagtgtacaaatatggtgtgggtcacagagatcacatgcttcacaaggtaataaaatatgacaaggcaaatggaggtggggcgagatcacaggcccggggcgaaattaaaattgctaatgaagtttcaggcacgctttgtcattgataacatcttatcaaccgtaaaagacagacattcctagagcggccattttagagacctcccactaagaatgcactctctttctcagggatgttccttgctgagaaaaagacttcagcaatatttctcctatttgctcttgaaagaagagaaagatggctctgttccgcctggctctcaggctaccagacctaatggttatctcccttgttccttgaacattgctgttatcctgttcttttttcaaggtgcccagatttcctattgtttaaacaatttgtgcagttaacgcaatcattacagggtcctgaggtgacatacatcctcagcttacgaagatgacaggattaagagattaaagtaaagacaggcgtaagaaatcacaagaatattgattggggaagtgataagtgtccatgaaatcttcacagtttatgttcagagattgcagtaaagacaggcataagaaattataaaagtattaatttggggaactaattagcgtccatgaaatcttcacaatttatgttctgccatggcttcaaccggtccctccgtttggggtccctgacttcctgcaacaataattatttattttaaaagaaacaaaatcaaattattagacatttcaatctgtggtagtaacatgatattctggcatctactttcattatcacctttattaaaataaatttaaagaaaaatggcagtatgtttctgtgaagaccacgagtactcattttaaaggactcaagagttgcagaaaagtaaaaagaaaagagtaaaatcattttctaaatctcaccttccagaaataacgatgttgagcattaagtggacttcatttcatactctttcaaagattatgtaggcatatatatgtgtgtgtatatacatatatatggatacatccttagagaagttggctggctagatagacacactataaaaatggaatcatactctaatgccatttttaatttaaaaaatacatattcagatccactgtacttatatacagaagtaaatgaaactaaagtaacacgagaggaattctgaccctcatataattttttttactatccaacataattattttttttattatactttaagttttagggtacatgtgcacaacatgcaggtttgttacatatgtatacatgtgccatgttggtgtgctgcacccattaactcgtcatttaacattaggtatatctcctaatgctatccctccccttccccccaccccacaacaggccccggtgtgtgatgttccccgtcctgtgtccatgtgttctcattgttcaattcccacctatgagtgagaacatgtggtgtttggtttttttcccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgccgcaataaacatacgtgagcatgtgtctttatggcagcatgatttataatcctttgggtatatacccagtaatgggatggctgggtcaaatgatatttccagttctagatccctgaggaatcgccacaccaacttccacaatggttgaactagtttacagtcccaccaacagtgtaaaagcattcctatttctccacatcctctccagcacctgttgtttcctgactttttaatgattttcattctaactggtgtgagatggatggtatctcattgtggttttgatttgcatttctctgatggccagtgatgatgagcatttttcccatgtgttttttggctgcataaatgtcttcttttgagaagtgtctgttcatatccttcacccactttttgatggggttgtttgtttttttcctgtaaatttgttggagttcattgtagattctggatattagccctagccctttgtcagatgagtaggttgcaaaaattttcttccattctgtaggttgcctgttcactctgatggtggtttcttttgctgtgcagaagctctttagtctgattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaggaagggatccagtttcagctttctacatatgtctagccagttttcccaacaccatttattaaatagggaatcctttccccatttcttctttttgtcaggtttgtcaaagatcagatagttgtagatgtgcggcattatttctaagagctctgtccttttccattggtctatatctctgttttggtaccagtaccatgctgttttggttactgtggccttgtagtatagttagaagtcaggtagcatgatgcctccagctttgttcttttggcttaggattgacttggcaatgcgggctctttttttggttccatatgaaccttaaagtagttttttccaattctgtgaagaaagtcattggtagcttgatggggatggcattgaatctataaattaccttgggcataaattaccttggccattttcacgatatcgattcttcctagccttgagcatggaatgttcttccatttgtatcctcttttatttcatttagtagtggtttgtagttctccttggagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgcccgtttccaaagggaatgcttccagtttttgtccattcagtatgatattggctgtgggtttgtcatacatagctcttattattttgagatacatcccatcaatacctaatttattgagagttttttagcatgaagcgttgttgaattttgtcaaaggccttttctacatcttttgagataatcatgtggtttttgtctttggttctgtttatatgctggattacgtttattgattttcgtatgttgaaccagccttgcatcccagggatgaagcccacttgattatggtggataagctttttgatgtgctgctggattcggtttgccagtattttaccgagaatttttgcatcggtgttcatcaaggatattggtctaatattctctttttatgtggtgtctctgccaggctttggtatcaggatgacgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagagtgtatgtgttgaggaatttatccatttcttcttgattttctagtttatttgcatagaggtgtttatagtattctctgatggtagtttgtatttctgtgggatcagtggtgatatcccctttatcattttttattacatctatttgattcttctctcttttcttctttattagtcttgctagtggtctatcaattttgttgatcttttcaaaaaaccagctcctggattcattgattttttgaagagttttttgtgtctctatttccttcagttctgttctgatcttagtcatttcttgccttctgctagcttttgaatgtgtttgctcttgcttctctagttcttttaattgtgatgttagggtgtcaattttagacctttcatgctttctcttgtgggcatttagtgctataaatttccctctacacactgctttgaatgtgtcccagagattctggtatgttgtgtttttgttcttgttggtttcaaaaaacatctttatttctcccttcatttcgttatgtacccagtagccattcagcagcaggttgttcagtttccatgtagttgagcggttttgagtgaatttcttaatcctgagttctagtttgattgcactgtggtgtgagagacagtttgttataatttctattcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccaagtctctttgtaggtcactaagggcttgctttatgaatctgggtgctcctgtattgggtgcatatatatttaggatagttagttcttcttgttgtattgatcccctttaccattatgtaatggccttctttgtctcttttgatctttgttgatttaaagtctgttttatctgagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattagagcatttggcccatttacatttaaggttagtattgttatgtgtgaatttgatcctgtccttatgatgttagctggttattttgctcgttagttgatgcagtttcttcctagcatcaatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttgaaatgaatgaaatgaagcatgaagagaagtttagagaaaaaagaataaaaagaaacaaacaaagcctccaagaaatatgggactatgtgtaaagcccaaatctacatctaattgatgtacctgaaagtgactgggagaatggaaccaagttggaaaacactctgcaggatattatccaagagaacttccccaatctagcaaggcaggccaacattcaaattcaggcaatacagagaatgccacaaagatactcctcaagaagagcaactccaagacacatcattgtctgattcaccgaagttgaaatgaaggaaaaaatgttaaggcagccagagagaaaggtcgggttacccacaaagggaagcccatcagactaacagctgatctcttggcagaaactctctaagccagaagagagtgggggccaatattcaacattcttaaagaaaagaattttcaacatactgattttttacagatgccttatcaaaagagattatgaaagctattggaattgtaatacttttattaattaatggttcacttttatatagtatcagtgaacttcgagcaatgaaagaagatgattttaatgcttccttcatttctctatcacccacctcctgatttttatagatcattatcattcattcattcaaccagtgtttatttagagaatactttgtgtaaggcaccttcaaggtgctgagcctagagctataagctatcgatggaacagacaagattctcacacataatggggcttgcattttaatagaaagaaaaaataaatcactattttgacattgcgctgattctgttcagtaaccataagcctcataattgttcagtattgtttctatatttgaattctttctatgcatatacataagtagaagtctggcagactagagagatagccagactcacttttataaaaatgggatgatactataaattcacttccgtcgctgacagcccatcctccacctaccttcttatctctgatcctccctagcagccctatccaggtttccctggttagaaggagaagctcggtcttttccagattcacagggaaaggttcccaagcaggaggagtgaggaggagccaggtggcagggccaggccaggccaagcctttctccactgcttctctgcagaatttccttggctgctggttttggaagtgtgtgacattaggttatgtccatttccttggttggtggctgctgataaaaattttgactggtttcactattttgatgctataattcttcatttttttttaggcattgctaagttagataaatcttatgttcagtcttttctatcttatctttaccccaagtctacctccttaaaatacttttatgagcacaaatccctgatgtaaaatcaagccataatgtgtttcctggagtaggggcggacaaatatgttaactaaattctttttgcgtgcttcatgttggatcaattcttaaggaataattttgactgagcctcttttaagcttttccaggcctggcttgttttcctgaaaagcttcaaagcagagaggagaatctttgtcagttagctgggtgagtggttcacaagcctcactgttgtgacacactccgtcatttgtgagggcatcacagccattttgttaatagaaatacagagccaaaagtcaaacatgattttatatgtgtgagatgttgcccgagggaaagggcaaagaatgagaagagctggactgggcaactctcatgtgaccccaggtccctttcaaagttgagtttctctagcaagtttgggatttccaaatgtttctactgagaaaaaaaaaaaaaggaaacgtgcaattaaattagaaaactacacagctcttactgaagagctgaaattttaaaaagatgcttaaaataaagcaaggaagataaggagaaagaaacataaagcatccaaacctgaaagaataacattcagataggctaacactcagaaaagattggagtcttgccaaacatcctgaggtcagccgccaccacagcaaaaagactgtttgatttggagtgacaagaaagatgatgtgatctcagaggaaacagatggctcactaaagatatttgaggatattttaataaaaagaagattttaaaaggtgtgagtaggatacagggaaagtgacaaaagatggagcaagttggaacctgatgggagtaatctggggggaaggaacccatagcagaagtggtggctctcaatggtggagcccagccaatccgtgggatcgggcaggaagggagctgacccactgtctgctccacgacctcctggtgctgcctccccttggctgaacccagccagaaggcaaagagagacccattggtccattccgtccaagatctctctcagggctcagagcagcgtacagaaaggtagtgtttctggaggaacaaatagaagatatccagcagtaagggcaaggaggcacagaagtacttcctgcttcaaggggttgagtggctatggtagttgatgttgagaaggcagatgaagtaaaagcaacttcgcatatatctttcctatcaaagacaatggtctaactggaaagaaaacaataaacagggttgtgactaaaaactgggcaaatgatctaaacagacatttctcaaaagtaaacatacaaatggccaagaggtatatgaaaaaaatgttcaacatcaccatcatcagggaaatgcaaataaaaaccacagtgagatattatctcaccccagttagaacggctatgatcaaaaagacaaaaaataacaaatgctgacaaggatgcaaaaaaaacccacttatactgtgttggtaggaacgtaagttagtacagccactatggagaatagtatggcggttcctccaaaaaactaaaatagaactaccatacaacccagcaatcctactactaggtttctgtattgttttgttttatattttttgtttttttggttttttttttttttttttttttttgagaaggagtcttgctctgttgcctagtctagagtgcaatggcatgatcttggctcactgcaacctccatctcctgggttcaagtgattctcctgcctcaacctccccagtagctgggattacaggtgtgtgccaccacacccagctaatctttttagttgagatggggtttcgccatgttagccaggctggtcttgaacccctgatctcaagtcatctgcccactttggcctcccaaagtgctaggattacagataagagctaccatgcccagccccattactaggcatttatccaaaggaaaggaaaccagcatatcagaggaatacctgcaccccatgtttatcacagcactattcacaatcgctaagatattgaatcaacctaagtgtccatcgacagatgaatggataaagaaagtgtggtatatttatacaatggaatactattcagccatttaaaaataaaactctgtcattcatggcaacatggatgagcctggaggacattacgttaagtgaagtaacccaggcacagaaagacaaataccatatgatctcattcacatacagaagctgaaaaacagttgatctcatagaagtagagagtacaattgtagttattagaaactgagaagggtaggaggggaggagatggagaggttggttcaaggttacaaaattatagccagatcagaggaatatgttctagtgttctatagcactgttgggtgactacagttaaaaatttttgtatattttcaaatagctagaatagaagattttgaatgttcccaacgtaaagaattgaaaactctttgaggtgatggatgtgttaattaccgtgatttatcattacacattgtatctatcaaaataccactctataccctataaagatgtataattattatgttcaattaaaaataatgtaaggaataaacaatattgaaagcaaaagaaaaaatcccaaagtggtcaaagcaataagccaatacttaactcctttaagcccatctgcaggcctaaatgaatcttacctgagagtgctgaaagaaaattatgtttaatttccagaaagggtcaaaagagtacattattgaacctgtaataaagttactgaaattaaaaggaatgttaaagatctcaggtttcttgatttcaggaagctatttgatggagcctttcaaagtttggttggtaatgaatatgctggagaaacaccggccatacaagaaggtttccctgacctgggatggacagtcatgcacagtgtttactagtgttgctcgcatggcatgaggaggaaagggcacaggacccttctttttgacccactcctattcaagtttctatgaaggtcttgaatgaagataggaggtgtaggtcaaagtcgtggttatgactgtttcaaagtcagaaaggagaatcggttctgtggatcttacaagctcctttaagatgcctcaggctatgaagctgtgggagagctggaaattctggatggatgggataatatttcctgaagcttgagggaaggtgtttgctgaagtttgtccaatgtgctctgtatgaagccagaacccaatgtcccatctgccttgttccagcactgcctcggattccagatcctgagaaccaccctttaccccagggaaacccctgatgccaccttctctgctgccaaccattatgtggtgtgagctgtccccaggttgcaagtctctgccagcagccctgcatgcttcaagactctctgtgtggccccacagggcaagcacaacaaagaggtcaaatgacagaatttcaaaagatttcaactgatgaaccaaattaaaggacatgttaggtattggaattttccaatttacagagctagtttgtcctagcattggccagaatgaaggctgaaagagtggcagggctgccaccatggttactgcagcaggtggaattcgagtgcctgaattgagggaagtgggggtcctcctgcatcccgagatagcgagagcacctcagaagtgctggcttaggtggtggcacccactgtaagagaacgatgacaaatctcagtttctccctaggagagtgcccagcagggtgatgagccaggaagatctgtcaggatgaagagtagtgagaggaagggggaaccctggagaagagaagaacttaaagggattcacaagaagttgaggagggcagagctgaatgagacaaggttgcagggaaacagactttttaagatcagtgtaagggaaaaaaaaatccttgacaatcagaattgtttcaaaacagagtcagcagcttcttgagactgggtcgctgtgctaagaacgtaaagggggagctgggtggcaccagcaaagtggcaggaatgtgtccctgcagggtctttgctgccttccgaatcctctcctttgtgatcctgtaatttgtgagagagcctggagggtagcatggaaaagagagaggagaggacctgacagcagtatttccatcttgtcccctaacaattgcctaggcagtctcctctcagcagggaagcaaactggtcaccaaataataataattatccccctacatttccttaattatttaaacttctgaaaggacatcaaacacagcaaagagtcaatgacttgctttcagaagtgattcagactgtagctccacccataacagtgtcaccttgagcagtcacatatgccttaacatccttctttctaaagcaattccatcttcccaggttgattgttgagcgtttagacatgatgacatatataatctttatatatgtatatttacaagtatatgtttatggataaattttgactgcctgtaacccatgtggccttgtgtcatcacacataagttcactgaagctcccaacaaccagacttttggggaagtacaaacctccacattagcactaggtctccttgcctgcccctctgctggaagaatccctggcaggggccttctttggtgatgggattgaattttctatttcctgaaatgtaatcagctttcagtttcaatggtggtcacccccttgtaccttcttttaaagattggaacgctgtattggtttctcagggctgctgtggtcttcatagaagatgacccgcgtatttccaaggtttcctccaggattgctggggctgtctgcgtccagatgttaaggttactgtagacaataaatgggagagggtgaaggaaggaggatgtttagagaaaattatccagtcacctggaggaaaggctcttagctgcaaaagaggaaataagggccaggcacagtggctcatgcctgtaatcccagcactttgggaggccgaggcaggcagatcatgaggtcaggagatcaagaccatcctggccaacatagtgaaacccatctctactaaaaatacaaaaatcagccgggcgcagtggcacacgcctgtagtcccagctacttgggaggctgaggcaggagaattgcttgaacccgggaggcagaggttgcagtgagatgagatcgtgccactgcactgcagcctggtgacagagtgagactccatctcaaaaaaaaaaataagaaactgctatttagcacaacatcaaataagcagtttgttgcttatgtctgaacacttctgtgaaaacaggcaaaggcagtcgtgtgtaggttctggtgaccaggaactggagctgcacagaggtgtagaggctcccaaagctcgtcaattgtttatgaagggagtaaaggctggaagtcagggggtgggtgtcagtttctgccactagctaccagatttctcctaaagatgggaaagctccctttatagagctggagtgcaattttgtgttttctttgtgtttggcaatgtctgttactgacttgcaatagatatgcaacagtataggtatgttcatcttagtattttggggacaaaactcccaaaccagccaccacacaaatgtatttataggtaccagtaggcacctttggactcggagggaagtcagcctccttaaagccgtattcagtaaggagaatgaagggtaggcatggctgcagcttgggttgtgcccaccatgtggatatccagccatgatctcaatagtcaggttggtccacattgtccagatatctccatgtaacattaactcagactttatgaaaataaccggtgagaataaccaaagccacattgggtaatgaaaactgtatgtacaattttctttagttacattgatgttgttacatactgttcataattaattacattggtttgtaatgtatcatgtcctattgtattgtaggttctaataccaagaccctaggtgttcctctcttaaaagctggtgaccacctttaactcatgtggtaaaagaatgatagttctgggaggatctgcattctctctgtgtccatgcagcattgccccacactgcctgtgctgagctgcatgatcctcatagctacatcatagtctttgcttgtaggcttgtcgtttggagaaccgtcttggagtctttattggttgatgtcaatggaaagctctgcttccctctggatgtcctatggtattgctgttcctaatgtctttctaatgagtgctacgtgtctgtatgtgtgtataaagagatttatgtaaagaattggctcatgtgattacggaggctgagaaaccccaagatctgcatttgccactaagtactcagatatttggtcaaacatgattgtgagtgctgttgagtgctgtattttttaactgccacgtaatcccctcaaggtccgtgttattctagacagtaaaccgggagaggcttctaaagccccctttgtcaggaaatgttactttagaatctgaccttgtgtgaaacacagatgacagaacctctctagtgcaatgacattaaaatcctcccccagtacttgaagtgcaagggaaatagctcattgctattatggctggatcatctcatggcctctcaacagatcaagagcaccattactactgttgctttcttgacttgtgttttacttttattctaacatttgttgcagtctgtgttaaatagggaggtagaccaaactatgagaaggagccctatattggaaactgtatagccaactatgaaacctccaggcttactttgctttctcattacaggcggccttcccctctgctccactggagagagtcagagtaattggctcttgctttatatgaaggatatgctcccaaaaaagttgtatttaaatcaagttttaacaaaccgactcatgcttgtttatccacttataacacttactatttaaaggaaatgataaagagtccttttctgttgttacagcgtagttggcaaagctgtatcttctgaagactgacttgcactcagcagttttagatcaactcgagtctgtttatactaagatccacagacccctggtggttctcagatgacttgcaaattctactagtttttccaattgtgtgttttttgatgataacttaaaaattttttatgataatcttttcattgtttagtataataatgtacagataaaccctagatgatcaccttataactgagtgctgtcatgagatttcagtgcctttgttctcagtcctgtaggtaaccaagacttcatctaaaatcacatcacttgactttaaatgtttgcaagacacatctgactgtcattgggttgataaaatctgtcttgtcctcattttgtgttgtgtgggactctatcatcaggtacaaaagcaaaactcctttgccatgagcgttcacagttgaatgacttttttatagaccaagagtttagtttcttagagtatatattgaatcaatttggcatcatggaaatggcatagtacattagaggcacatactatgttaactgtcacaatctaatgataaagaacagaaaaggacatattacataatcggtgcatttctgttaaagtcatggcaagcttattgaactagttttatagcaatttggcaggataaaaatgatgggaggatggagtcatcatagggtgcctgccctgtagcatggacacctgggacacaccttgctggatgatgtcttctttgggttccatcttaatacatgacaactggaaataattctgtagcagaaagtagagtgtaaaatagaaaatgactcttattctgatgaatcaaagtttttaagccatatatgtcggagtacacttgaattacttctgtaaaaactagcacattatataaaaatcataataaaaacagagattccagtgaggggtccctcttgttcagagtcgaaagattcaagtcaacaaaaatggaacctgtaagttagtctttttgccactgttaaaagaaaaacactggacacaatacttttaacagagtttatgtgagcattagaggattcatgaattgggcagcacccagaaccagaaaaggttcagagagctctacccagcagcatgggtagtgagctttaataggcggaacgtggaagtaagacaaagaaaacatatttgatttgttagagtagaaagtccctagttagaggttagttggaggtttctgatggtaacttctctagtttcattttactgttcacattgggctttggtttgcttacctaggaacttaaagtgctgggaatgcttcggcttaatgacctcccaattaaaatttttttaacatcacttttatttatgatctacaaagtggcaactgcctatttttttttaattttattattattatactttaagttttagggtacatgtgcacaatgtgcaggtttgttacatatgtatacatggccatgttggtgtgctgcacccattaactcatcatttagcattaggtatatctctcagtgctatccctcccctctcccccaaccccacaacagtcctcggtgtgtgatgttccccttcctgtgtccatgtgttctcattgttcagttcccacctgtgagtgagaacatgcagcgtttggttttttgttcttgcaatagtttgctgagaatgatggtttccagcttcatccatgtccctacaaagcacatgaactcatccttttttatggctgcatagtattccatgttgtatatgtgccacattttcttaatccagtctatcattgttggacatttggcttggttccaagtctttgctattgtgaatagtgccgcaataaacatacatgtgcatgtgtctttatagcagcatgatttataatcctttgagtatatacccagtaatgggatggctgggtcaaatggtatttctagttctacatccctgaggaatcgccacaccaacttccacaatggttgaactagtttacagtcccaccaacagtgtaaaagtgttcctatttctccacatcctctccagcacctgttgtttcctgactttttaatgattgccattctaactggtgtgggatggatggtatctcattgtggttttgatttgcatttctctgatggccagtgatgatgagcattttttcatgtgttctttggctgcataaatgtcttcttttgagaagtgtctgttcatatcctttgcccacttgttgatggggttgtttgtttttttcttgtaaatttgttggagttcattgtagattctggatattagccctttgtcagatgaataggttgcaaacattttctcccattctgtaggttgcctgttcactctgatggtggtttcttttgctgtgcagaagctctttagtttaattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaaggagggatccagtttcagctttctacatatggctagccagttttcccagcaccatttattaaatagggaatcctttccccatttcttctttttgtcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtaatgcgggctcttttttggttccatatgaactttaaagtagtttttttccaattctgtgaagaaagtcattggtagcttgatggggttggcattgaatctataaatcaccttgggcggtatggccattttcacgatattgattcttcctacccatgagcatggaatgttcttgcatttgtttgtatcctcttttatttcattgagtagtggtttgtagttctccttgaagaggtcattcatatcccttgtcagttggattcctaggtattttattctctttgaagcaattgtgaatgggagttcactcatgatttggctgtttgtctgttattggtgtataagaatgcttgtgatttttgcacattgagtttgtatcctgagactttgctgaagttgcttatcagcttaaggagatttggagctgagatgatggggttttctagatatacaatcatgtcatctgcaaacagggacaatttgacttcctcttttcctaaatgaataccctttatttccttctcctgcctgattgccctggccagaacttccaacactatgttgaataggagtggtgagagagggcatccctgtcttgtgccagttttcaaaggtaatgcttccagtttttgtccattcagtatgatattggctgtgggtttgtcatagatagctcttattattttgagatacatcccatcaatacctaatttattgaaagtttttagcatgaagcgttgttgaattttgtcaaaggccttttctgcatctattgagattatcatgcggtttttgtctttggttctgtttatatgctggattacgtttattgattttcgtatgttgaaccagccttgcctcccagggatgaagcccacctgatcatggtggataagctttttgatgtgttgctggattcggtttgccagtattttaccgagaatttttgcatcagtgttcatcaaggatattggtctaaaattctctttttatgtggtgtctctgccaggctttggtatcaggatgacgctggcctcataaaatgagttaggaaggattccgtctttttctattgactggaatggtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagggtgtatgtgtccaggaatttatccatttcttctagattttctatttatttgcatagaggcgtttatagtattctctgatggtagtttgtatttctgtgggatcagtggtgatatcccctttgtcattttttattgcgtctatttgattcttctctcttttcttctttattagtcttggtagcagtctatccattttgttgatcttttcaaaaaaccagctcctggattcatttatttttttgaagggttttttgtgtctctatctccttcagttctcctctgatcttagttatttcttgccttctgctagcttttgaatgtgtttgctcttgcttctctagttcttttaattgtgatgttagggtgtcaattttagacctttcgtgctttctcttgtgggcatttagtgctataaatttccctctacacactgctttgaatgtgtcccagagattctggtatgttgtgtctttgttctctttggtttcaaagaacatctttatgtctgccttcattttgttatgtacccagtagtcattcaggagcaggttgttcagtttccatgtagttgagcagttttgagtgagtttcttaatcctgagttctagtttgattgcactgtggtgtgagagacagtttgttataatttctattcttttacatttgctgaggagtgctttacttccaactatgtggtcaattttgaaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccattattattgtgtgggagtctaagtctctttgtaggtcactaagggcttgctttatgaatctgggtgctcctgtattaggtgcatatatatttaggatagttagttcttcttgttgaattgatccctttagcattatgtaatagccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattggagcatttagcccatttacatttaaggttaatattgttatgtgtgaatttgatcctgttattatgatgttagctggttgttttgctcattggttgatgcagtttcttcctagccttgatggtctttacaatttggcatgtttttgcagtggctggtactgcggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggtccccactctcttctggcttgtagagtttctgctgagagatcagctgttagtctgatgggctttcctttgtgggtaacccgacctttctctctggctgctcttaacattttttccttcatttcaactttggtgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccctgtcactttcaggtacaccaatcagacgtagatttgggcttttcacatactcccgtatttcttggagactttgtttgtttttattcttttttctctaaacttctcttctcgcttcatttcattcatttcgtctttcattgatgatatcctttcttccagttgatcacatcgactactgaggcttgtgcattcgtcacatagttctcgtgccgtggttttcagctccatcaggtcctttaaggacttctctgcattggttattctagttagtcattcttttaatttcttttcaaggtttttaacttctttgccattggttcgaacttcctcctttagctggtagtttgatcttctgaagcctccttctctcaactcgtcaaagtcattctccgtccagctgtgttccgttgctggtgaggagctgcattcctttggaggaggagaggtgctctgatttttagagtttccattttttctgctctttttttcccccatctttgtggttttatctacctttggtctttgatgatggtgatgtttttggtgtggatgtcctttctgtttgttagtttttcttctatcagtcaggaccctcagctgcaggtctgttggagtttgctggaggtccactccagagcctgtttacctgcgtatcagcagtggtggctgcagaacagcagatattggtgaaccgcaagtgctgctgcctgatcgttcctctggaagttttgtctcaggggagtacctggttgtgtgaggtgtcagtctgcccctactgggggggtgcctcccagttaggctactcgggggtcagggacccacttgaggaggcagtctgcccagactgcgtgctgagagaaccactgctctcttcaaagctgtcagacagggacatttaagtctgcagaggttactgctgccttttgtttgtctgtgccctgcccgcagaggtggaggctgcagaggcaggcaggcctccttgagctgtggtgggttccacccagtttgagcttcctggccactttgtttacctcctaaagcctgggcaatggcgggtgcccctcctccagcctcactgccgccttgcagtttgatctcagactgctgtgctagcaatgagcgaagctccgtgggcataggactctccaagccaggtgcaggatataatctcctggtgtgccatttgttaagcccgttggaaaagggcagtattagggtggaagtgacccaattttctgggttccgtctgtcacccctttctttgactaggaagggaatttcctgaccccttgcgcttcctggatgaggcgatgcctcgccctgctttggctcacgcacggtgcgctgcacccactgtcctgcacccactgtccagcactacccagtgagatgaacccggtacctcagttggaaatgcacaaatcacccatcttctgcgctggtcatgctgggagctgtagactggagctgttcctattcggccatcttggctccacccccccggcaactgcctattgttttacctgatatgcacaacattggccattagtgttaccaaagcaacatccatcacaagaattaatgcttcttgatttgaattttactcctctctgtctctgtttatgtgcattcatttgattgtacacttgtataagaactaaaagcataaaaagtttattcctacatctggcacagctcacgtctgtaatcccagcacttcgggaggccaaggcgggcagatcatgaggtcaggagttcaagaccagcctgaccaacgtggtgaaaccccaactctactaaaaatacaaaaattagccaggtggggtgttgcgtgcctgtaatcccagcttctcaggaggctgaggcaagagaattgcttgaacccgggaggcggaggttgcagtgagccaagatcgcactgcaccccagcctgggtgacagaatgagactctgtctcaaaaaaaaaaaaaaaaaagtttattcctagttttacatttgtagcattgaaattaaaagaatctaaataaataacagagcactgtgagaatttgttgtttaacagagctctatatgcattacacaatttcaaggaacattgatctgaatgttcctatccctcatggaccttgagccctgacaaaagttaataaagatgggtctccttttcttcttgtcccctgctttcagctctgaatgagaaaagttttgcaaatatgtcggtactttgtattaagcctaaaacttataaagtatcagatttgtaagttgactgtattaactttaatttctcaaagtgttctcagttaattaggttaacctaaaactaaaactataaagtgattcctcccctaccaagaaaaaaaaaattaagctgaaatcctctgtttagagtttcaggcctttgggctggactccacaacccttctcaggaagtagcagtagacacctgaccttaggctgtagtgctaatataacctgtgtcagtagctgccccattgcaaacaaggaaatgatcctctgaagtcaaactcaggaaggaacaagaacctgtctctctgagctctctaaagagtgtggttaagagtatgagcattgacaacagactgcctaggttcagataccacctctgatgccagttatgtgattttgggccagtttcttaatctctcaatgtctcaacaacatgagtctaataatagcatatatacccctataaccatggcatgaggattagacaggttgattggtgtgtataaaacacttggaacagggcctggcacagggtatgccttagtagatgttagcactgcatcacgactgctactatgattaccgtccctgtcactgttgctgctgccaccacaggcaggtcagtggaacgtcacccttcagggatttatcagcgccactccctaagcatgccacctgcatgaagggcagacatgaaattgtgccgccagcgttctggtttcttcagcgctccctgccagctgagctgtgtgaaaagcactcagctatgaaaaaatgagaaagattgattgaaatgttggtgaggtcattgtcaaatattctctgtcaactgaatgactgcaaatagggagatgactgcccccccaccaagtcagcctaggagggttcagtccttcatttattcattcacacatcactccttcactgtgccagccagccatgacaattaagtgcatttgggaggaggtggcagctgagctggaaagggggtttggcattatgctgggaaggtgtaaaaagccaggctgaagatttgggccgtctttttttttcccccagatagtggggagctggatttggagacaagaaacctttgtagaccctctggcactctctattgacagatcactgctaggaggcagtgtgactcggagaaccgcatgggctccgccaccagctctgggttccgcactcattagccagatgaccttgggctcattatttagcaagcctgcacttctgtttcctcacctacaaaatatgcataaaatagcagtacatacctcacggagttgttctggggcttaaatgagttcatctgtgcaaacatttagacgaagtgcttgacataatcagagctatgtaggtgctgttaattcttctttgccccactggtccccaggttccatatctgtaacaagaagcaactggaccacataatttcacatccttttatacccaagtttttgatcaagagagctcaggctgtactttaagcttaatgtgacagtgatttatagcatagcttgggggcgatctgaacacttgggggcagaaaaacaagttaggctttccctgtttccatcattctcccacctttcctccatctgcctgtccccacctggacatacatgccaaaagccacggcccattttactagatctaggtagtatgggaaaagaccatgaagcggacacatcatctgtactgccagtgtctctcttcaaaataaactttttttttttttgagcctgaatctcactctgttgcccaggttggagtacaatggcatgatctcaactcactgcaacctccacctcccgggttcaagcaattctcctgcctcagcttcccaagtagctgggataacaggcacctgccactacagccggctaatttttgtatttttagtagagatggggtttcaccatgctagccagactggtctcaaactcctgacctcaagcaatccacttaccttggcctcccaaagtgctaggattacaggcatgagccaccgcgcccggcccgcttcaaaataaacttctttaccaggaaataggattaagaggaggtagaaggaaattagagtaggatcagaaagatagaaaaaggagttttctctgaaacaataggacagccagatacaggctgagcaggcccaatgatggatagagaggcacatccactgctgagctctaacctagagagagaatgtctcaaaactccttgcatggaaggtgcctggaaatgtatttattctcctgttgtttattctcacctctcttcattcctttttctttcttctgtccttgaatcgcagcagataaaaagacaaatctgctgagaggatgcatgtcacaagtggtcagatgaattacagccatagcaccatatagataagaggcaaggctggcgcctgggcaggtctgagagggtccaggaggacacacaccatatcaaattgtgcaatttagcaaatggctggtggcagactgaaatgatagttaatctgttttccatgcactaaaggcttttgccaaactaagatttgctgtgaagacccaaagctggagcccacccagggagcgggctgccttggatgcgtttcccagccttctacagtggatgccagtaaaactaactagagacatgaatgggcaccaggataaacacaaggggatattttgttcttaccattagagaaggatactgctaactggcaagaagtcccatggttgttatcttttgattagtagtagtaaaaatactatttaaagctagtagcattttttgagagcttgctttacactgggtactttttcaagtgtcttacaagtattcgctcattttatctgcacggcagctgtatgaagagaatactgtcattatcttcactgcataggtgagcaatggaggcacagagaagttcagcaacttgtccaagctctcatagctgggaagtggcagagccaggctttgaactcaggcagtctgactcagagtccaagactgccggcctgaattgtaggagagagacagtgcgggtataccaggaaccaaatcctatcggctgaacatcagtgtttaagtcgagcccagatgctctgcacaaaatacaatgtgtctgtgcacatgtgactgttaatcagccatttccttggttcctgctttgtgctggccactgagctggaccctgtgggatggataaatcaatgtcagtcatgcccctggagacctggctgttgcaaaaaggctcctgaaatcatcataacccaaaagagaaaagggcaggtgctgaagagaagtataggtaaagagcagcaaaatcataaaggaggggagactctttgcctctgtggtatcagggaatgcttctcagagcgggtggcgtttgccctgagacttgaagtaggaatttaaaaacatagaaatgcagtggaacgggaagaaggacattctaggtggagagaagtagagcaaaatggtccaatctgcccccctaagggtgtgagacagagaagtggatgggaaggccaggaaggctgtcgccatgtgggccgaacatggggagggaggtgtttgtcagaatcagaatggactcagagggaagctgagctaaaagcttcaatttacagatgaaagaagaaagaatttggatatgtgactcactcagtgtaccaagttcgtggcagaagtaagtctcaaaccccaggcttgcctccaattttctttgcactgatctcctggcataaacatgtggctaacaagggtctcacaatgccaggagggtgttacgtttttataacctgttctatttgagggtctccaaaattacatatttgaagttaatattagccagatgctaactgtctgcaggcaagaataagcacccactttacattgggagaagctagagatttgggaatcaggatttgctgcagatactttgaggaatctaggcctctaatccacagtctcctaaattctggaacttctggcttaattacactttttaataaccagtcatcattgctgcataatttgtgaggtctggtatagtatgattcctgttcccttcagctaaccctgcccccacccccatcctttaataaacgtaaaacttttctttcctgtgaattcatttttttcccttttatcttttggacctttgcaattaacatattaatatttaattcatattacctgaaggtccaagaacacttttaaactcatgaaaaaccttcactagtaatttagctgctaccaaggtatccctgagccctcattatttgcctctggaaaatgccgtaaacgacatctaacaggcttcagctctgtacctctacaaataagaaattaagcagtattcagaacgccattgattattaatttaaaagaaatcaaaaatcaatatcacattcctgtaacctggcagtttttcttaactgaaggcagttgcctgcagaagccttgtggctttccagagcaacggcgccccttcgtggtgataatgtgaactgcaccccaggcgtgattgaaaataaggcagaaaggaatgccggcctcgagcaaggacaccggttcatgcccaaatcacttctgctttcagccaacagactgtttctgccaaaagatggacgcagctagattttttttttttttgtaccgataatctgtcttaaaacttggagaggatctcttttcccctgtgaagtcaggaaaatgacagcaagcagcatggattggttcgaataattttcaccagaaatgtggggtgaggggaagggatgggactggagtcagagcagtgatctggcgggatggggtgatgagccatacggagatgaggtgtggcgccacgggctgggagtcagggattatagagtgagggtggggtaggatcttcctggtcatcaaaactatgagaaatgtaattatttacattttaaactaagccaaagactgtattgaaatgtcttacacccagaacagagaagtggtatcaccaaagttcagaattcccagctctaacgtgatgcctttggggactgcctccccaccccaggctgacctaacacacccctttgagaaaagaggatttagtttctcctgactgtgaattgaatatgtgggatgtgcccctccaggagcttctaaaatcacctctgctttgaccttgaggggccgtggtagaggggagacagcaccggcttagaaaccccacggctcggctctagtcccagcatcagtggagcaccaaggggagaaagtattcatcactgaggtattttatgatatgtatattgttcctgggcagttgcaccccttatcgcctgcaccctgtgtacagctccccattcctcctcccttggaggccactgtgctatgtaacttgctgtgggctgcaagaaagactgggctcccgtttcctcttctgaaaggcaggaatcatgctcccggctgacctcacagaatcattccacagattaaatggcgatatggcttgtctgtgttcacactcaaatccacatgttgtgggagggacctggtgggtggtaattgaatcatgcgggcaggtctttcccatgctgttcttgtgatacagaacaaacctcatgagatatgatggtatcataatggggggaggttcccctgcacaagctctccctttgcctgctgccatctatgtaagacatgacttgcacctccttgccttctgccatgattgtgaggcctccccagccacgtggaactgtaagtccattaaacctctttcttttgtaaattgcccagtcttaggtatgtctttatcagcagcatgaaaatggactaatacaaatgggatgtaaaaataaaattcttatatacttagaacggcaatatgagctttacatctgagttatgctataatatcaatcaacatatataataatataaagtagtatatttattataagttataataacagagtgagatagcttagtaatttcttgttagtatctgcaatcttggggaaaacaaatctagagaaataagtccaaactggagctgcagagtcaagtgggcgagagaaagaagtctcgctttttttgttttccaggaaagctcaggtccagttcagcaggccagcccaagagactgggagagccctatgtactcaggagagcagcctcacccctcgtccttgtccaagattggggagtgggtgcccacagcttgtatgtgtccccatgagagtgggtgtcattatgaggagcatcaaagggccaagcacagtggtgacagatgtgggggaatttgccattctgagggcagaggaggtcaaacacaagtggactcgcttattaagcccagaaagagaactgggagaggaaggccaagtgaggatggaggcggagatccagggcccatctgcaagtcaaggagcaccgaggatgctcagcagcagagccaggagagggcatggagcggactcgcttgcagagcctgtagaaagaaccaactctgccgacactttgatttttaacttctggccttcagaactgggagagaataaatttccattgttttaacccacaaaggaagaaaaagactatcaagagtagaagggcctgacaggtggccacacggcaggtgagtcagagagttgagtcacgtgggaggtagtttagaaaaggatttgtgaagagggccatcccctagcagcgtgttgaatatagtgaggaatatgagatggaaaagaatctttttagagaacatgggtgccagacatagccacagacaaagtcgtgaaatagacagaaatttgtcccatttatggagactgtggttttccacccatatgtccccccaccccatgtcatgtttacctggccctcaggctcacgctgatggccctgggctgcttttttcccctcaaaagctgatgtctggtctctaattataagatacaagatgagatggaaataattgttaacaatgtattcattcaacaatggattgtgtaaaaaaaaatgtggtacacatacaccatggaatactacacagccatgaaaaggataaagtcgtattcttcacagcaacaggaatggagctggaggccattatcctaagcaaattaaagcagaggcacaaaactcaatactatgtgttctcacttataagtgggagctaaacattgggtcctcatggacacgaagataatagtaactgacactgaagactactagagggggtagggtgggagggggacgaggggtgaaaaacaaccagcaggtcctttgctcagtacttgagtgacgggatcatttgtctatcaaacctcagcgacatgcaatttatacatataacaaacctgcacatgtacccccgagcctaaaataaaagtcaaaacaaaatattcattcccaaatcatttactacatacaaatcgttaagtcaggatccctgctgtgacactagggattatagaagtgttgaaagcttcattctcatccagtcattcattcagtgcctggctggggttgtgataagcaaaagcaaacccatccctctccacatgtagcttccagtctcgtggtggcatttcctcagaggatgaagccatccaggtagcatagcaggcatgaggtggttccagtaaatggaggtgggacagtctccttgggctgccaccctgcttggggctattcctggtagggcctggagctctgcctagagaagcccacatgccctctcctggagtcacaagggcaggccaagtattctgtcctattccagtctttgctagaatgtgtcaagtgctgtgggcttgagtccttggcaatttttgcatgggacttagtttgggggtaagttttctggaaacttgaaatgtttcacttaaaaagaaaaatgcaggattcaaagaagtaaagagtaacaaataaatagaggcttttttagttcaggggtcagcaaactgagggcattgcagctgttctggaattaatgcgtgtccgggcaagggtcagtaattctgagatgccgttctgttgctttcaggccttttttggtgaaaactcttaaaggaggtataattcttcccttgctgggagtctttgtttcagaggggttgtaaaaaaagattcccagaggataaatcatatctgtattaacttcctaatgaaatgaaaaattatatcattgctgattattcctccttggctgatatggaaaaaaatactattaatactttttagtgtgattttaatcctttgcattcacggatatttgcattagtattttctggacatcatcttgtttatatggattttattcattgtaagatgccatcagatccaggcatctgagttctgggggggcaatgctataatccctgcccagaaccaaaactttccctgtgcagatggtctttcaatagagtggaatgtgtttggggtttctgcatatttcagtttacaaacccttcagtgatggttgtcttcatcctgagtttggctccatgcttcagaagatgcaacagtgctgagaacggtgcctgacatgcaggaaacattcagtaagtgtttgctgaatgaatgaataaattaattcaacaacagctaatgaaagcacatcccttaaaaagtctcggcaatattgcgagcataataccaaaggcagaaaccataaaagaaagaattgatggattggaaggggaaaatctttttttttgagacagagtctcactgtgtcacccaggctagagtgtagtggtacaatcttgactcactgcaacctccacctcccgagttcaggcaattctcatgcctcagcctcccaagtagctgggactacagatacacattgccacacccagctaatttttgtaattttagtagagacggggtttcaccatgttgcccaggctggtctcaaattcctgacctcaaatgacccacccacctcagcctcccaaagtgctgggattataggcgtgagccaccgcagccggccagaaggggaaaatcttataacatgaatttcagataaactgttacatccttaatacttaacgaattcctgttaatcagtatacaaatattagtacccaaatagaataaataccgatggccaataaatgtattagaaacatttgaatctcacttataaaaacatagttattttcctaaatggggtatcattttttcccaatcagattggcaaaaataaacaagaatacaaatccagcctagcacatgtacgtactttcaaagggaggataatttggttcaacatgttttgaaagctggttgtatggtatgttttgaaaccttgaaaatgacccagaaattttccttctagagatttatcttaaggaaattataggaggcataaaaagtttcacctgcttattgctttgtggcttatcattgcaaaaagaaaatggaaaactacttcttcagctaaaggaagtgatacgctatcgtactagaatattaaaaatgaagaaggtagggaaaagagaaagagaatctaagcggtaaaattgtttgacctttattttcttctttttgcttagctatattttctaaagtttttgttaaaataaactcttttaacaaaaaaattctaaaaactcatagctgcttagatgataatataattataatatttatgttaatttttgttgcgaacgtatgtttatgttgaacttaccaagtgatctaagctatattactaagttcttttcataagcctctgagttcatgtatattaagcccttaacataattcttagagttaagcagagcaggtggcgttattcttccatgaccgcactgagactcagaaaagttacatgacttattcaatatcacataattaataaagagtaagactggccacaaagtccaggatgccacacacatagctgagtgcttcttcctctatcatagaaacaaaaatctggatgaccattaggccgttgttggcctgcaaaggtgtagagcaaactattttatggtattgagagcacttatcttggcattactccatctgattgtttgtgtcaagtaggaaagatacatttattattcccattttgtagatggagaagctgaggctcagagaggttgagtgacattcccaaggttgtacacagtaagtggtaaagttaggatttaaacagttttagtccgaatcccttgctctgtctacttcagtttggcataataaattcttaacttccttaacagtttgtcccatcatattcctaaagttttatgatttgatgaagtctctcttaagctccttttccacatgggtggcatgggttagcaagattttgagggctgatcttgtgtgacagattgtatttccaaagatgtctggaataatatcttgtgtcccacatactgttgtggaactatcacctctccatcccaaaaggtggaacagaagcaacactatgaaactgccaaggctaaatcataaacattcaatgcacttctgccttgctctcttgggatgtttgtgcttagaatccagctgccctgctgtgaggaagcccaagcaactctgtggaaaggaccacatggaaaggaacagaagtgcccagctcacatccctggctgagctcctggccatcagcctaatttgctggccatgtgagtcatcttgaaagtactgtaggttcaaggtttactttctgaggtttcagttatccatggtcaaccgtggcccaaaaataggtgaatatagcacaataagatattgtaagagagagactatataacttttatttacataacttttcttacagtatattgctatgatttttctcttattagttgttgttaatctcttatgactaagttataaataaaactttatcataggtatgtatgtatagaaaaaacatagtatatgtaggattcagtactatccgctgttgtaggtatccactgggagtcttggaacatatcccttgtggataaacagagactactgtagatcctcctgctcctaattagcctaccctaactgatgttgcattgagcaaagtgaggtgagccgaccaacctctgcccaaattgcagatttctgtgtaagataagtgattattctgttgggggtagtttgttatactcattttccctcctaaccccaaattaggtggcagggatggaggagtcttgcttatcatctctctatttttgttaactcctcctcgttcagggtagactttggcacctggatcacaaccttattctccaccccaaacctgccattatccttggtgacaccattatccatgaaggggacccatttgatatgttagcttctcagttccctgtcttctaccccaaagtccttcaaattcaaagtatcttactctttttgttttaaaattgcttggagtagtagagaggactctagtggaatatacaagccaaaataatcaggaatttttacatgagagaaaggaggaatgtcgtgaagggcatcaaaaagcaagaaagatgctcattttcccttccaaccccaatttaggtggcagaggtgggagcaggtgaaaagaacaaagggcattggaaaagaccacctggaagtcagtgaagaccaagcggtaaagggatccttagcttaggcaaaggctagatggggacttatctcaccaatggagccagagaacagatgttccagatgtgtgtgtggaagtgggaagaggactgattaaggaaagaagaagctcaaagcaatatagagatgagacagagaaataacaggattccagaggcacttggattttactcaccaaggatgagggggaattagttggtctcaacatttctaacggcaaagttacaggtcacctaatacatatttatgtattagttggatcagaggatggatggatggatgagtgggtgggtggatggtagatggcagtggatgaacagatgaatgaatggacagatgtgaggatttctctgtgggagattcagttcgcccaggagtgatggtgtttctgagagagccctagcagcatttgttatctcctaggctctctctgaatgttcgaagcagtgagtggcaaagaggaggctcagccctctctggattgatctgttactggggtgtacaggcattcagtgcagagttctcttcatcaatggtcaaataacttctgttacccacttgtgatggctcctgtagcctctggttcgactccatgtaacaactgaagagcagccttgctgcaacagataggaagcaggtcttatctctgatttgagaatagaaggcccggtgggtacaacctgtagcactttcaatcctgtagaaatatagatagtgatgctgttggtaaaaaggaatccaccctttccaaactttttcctaagtcagtggttgtcaactggatgaggtcttgctcaagcacaagtgtctggacccctcctctagaaggagtgattctgcaaggctgagcaagcctgagaatgtgcatttctcacctgtaatcctagcactttgggaggccaaggcgggtggattgtctgagctcaggagttcaagaccagcctaggcaacatggtgaaaccctgtctctactaaaatacaaaaaaagtttccaggtgtagtggcacacacttatagtcccagctactcaggaggctgaggcacaagaattgcttgaacccaggaggcagaggttgtagtgagccaagatcatgccactgcactcaagcctgggtggcagagcaagactctgtctcagataaaaaaagggatgtgcatttctaataaattcccaagtgatattgatactgctctaggaccacactttgggaatcacttccatcctgcatggctaggtttaaattaggcattcttaacttcatatgtggcagggtgagtggatgttgagggccccaggtatattcttgaaaaacaaaaagaagtcagtgatcagttaattcattctagtctcctgctgagactgttgtctggcttatgaaggccaggatttttgccacctgaggcatttggagaagcctatgaaggagagtagaggagaggttggggacaacagaatgaagccagccagaaaaagagactgggcatagggggaatgggaatttgaggagaaacatatcattcatcagaacttaaatctgcatttttagagaagatattataatgtgcttacgtggcctccagatgtgcacaggtgccataggatagaagtagcccagggaagccttgtcatagatgggctacataaataggaaggcttgcagcagtgttaaaagacagctgatatgattaggctttgtgtccccacccaaatctcatcttggcttataatccctgtaatcccgttgtgacaagggagagaccaggaggtaactgaatcatgggagcggtttcctccatgctgttctcatgatagtgagttctcatgagatctgatggttttacaaagggctcttccccactttgctctgcacttctccttcctgccgccttgtgaagaaggtaccttgcttctctttcaccttctgccacgattgtaagtttcctgaggcctccgcagccatgctgaactgtgagtcaattaaacctttttcctttataaattaaccagtctctggcagttctttacagcagtatgaaaatggactaatacaacaccctccatgcaacctggagaaaatgcaaagtacatatagctctcaaacttcaggaaggggatccatatatgcagacagccattctttaaaataacctttccattctcccatccacttcgctcacacgtgatagatagtctgtattatctcttctctaacatctccacccaaaactaaacaaaacattaaaaccctccagtcattatttaacttgcctctttcttcacctcacttccagtttctccccgattcacattcacaaaagcccaagaatgttatggctgatcaaggactctcctttgagggtgggaagaaactgcaggggtcaggccagaattctcttctgcagacagaggagggggaaagacaggaaataagcatgcacaacgttcacctttgttggctgcacaacagcttgggatgtgcacccagccctaggtctccagctgagatgtcctcagttgtactcagcaaaattgccaccttttctgagttatgaaagccttctctcctagagccccagtatgttcctggcacctgcaggcttttgggttttggttttggggtttttttctgtgtggtgttgttgttgtgtttcttcaccagggcatgagtagacagatcctatgcaggcactttctttgtgatcttcaggatcatttgttttatcttgcctcccaaatgctgatcacccatgggcatgcttcttgagggttgcaaccatggctttaaaacccagaacagctggtgtctgtggtctgcagggcccagaaaatattatttaatccaggaaacattcctttgttctgctctgcttcattcagacctctcctgggtcttttccttcccctgctggctatcgatttccatccaactgaaggggtgaagttcagaagcccaggagacagcctgaataatgggtatgcaagtgttgcatcacacatgcagcaaacatttattaagcatgtatactatacagggctgcaaaagtccatatgtactaggatcttacagtacacttggaaacaacaaggaatctgggtatgaggattctttaggtggaccagatgcctgctctgtgtagcagcagaactcttcaatatggactgtaaccacctgctccaaaatcaccctggggaattgtgaataaaatgcagacttcaaggctcatcctatacttgatgagatagggccctgaaatctgctatcttaacaagcacccagttggtttggctcttcatttttctttttgagacagagtctcattccattgtccaggctggaatgcagtggtgcgatcttggctcactgcaacctctgcctcctatattcaagtgattctcatgcctcagcctcccaagtagctgggattacatgcatgcaccaccacactttattttgttttatttattttattttattttattttattttattttattttagtagacacgggatttcaccatgtttcccaggctggtctcatctcttggcctcaagtgaagtgcccacctcagggacatatattgtatggtactgtagagtgctttatacttatctttctcctaaccagatgttagctcttagaatctcatcctcctactttccaaggtccctgcacccatcaccaggcccccaagggatatggacagggagagccctctggccaaattctcgctggatctcccagtggccgttcagcttggaccgccttttctcctcttattccagtgatagtccaggatatctttttgccttttttcccttaagacttccctggtcttggtatttgggattttctcattttgaatctgggggtgaagaggggaatttaggggatattggtcacttgtcttctgtgtccaaatgtgagtgtcttgctttggattaggaaacccctaactaatgaatgttgttaggggctaagaccactccaacagtagaagctagaaatcttagatactaccttgcccatctctgggtgcagccaggacactgaatgtgattcaggctctgctgattagatgtgtccctgttagacattgacatagaccccaggagccagggttataagggacaggagtcctttgtcctctggcaagggtaatttcctcctcagaaccagtcctgggctatgttgatgggcgtggcccagttgccttgtaccaagtcagttttctagtcctgactagaaattgttagttctggcagctaacaattctacatgatccaaaaaagtgagggatatcatttaaggagggagggagacagcctctgccttggtgtctcaccttccaggagtaaagacgtgtcccaagtaatgggtagctccatgcacaagagaagagacagtggagaagataagacatgcaagaggaaggatcatggaagagagacccagaacatttgcttaaccagatctatttataagttttagtccttaatcagaaagcaatgtatctttcttagaacagtaacctcataatgcattcctgaggagcccagttagtccttgctcctgtccatcccacctccttcaggcggtagaacagaagaagggtcttcatctcaccccagctaaagcatctctgcttccagaaagtgtggatgagtgggagccataaacctgggaaataagccacatgctacccttttggttgttgtttattttaacaaaattctatgaccccaggaccatgtttctaagagtagccacttgaagcagaaggaaatatttagtcaaattctacaatcacagccaaatacagtctaatggcagccagcagacactgtggaaagagagtgtcacacaccattctaatgtggggagtaaggatgatgaagaatcagtcataggtccgtgttgtagctccgtctggggagtggaactcatagggtataagtgattatttcctattcatttccttagccctgaaccgtccaatgaccacacgcaacttgactggcaagaggtgtttagaatgttgagacacggtcagaaatgattggtggtttcatgtgatgcaaagaatttcccatactccgcctgttttctggatcacctgtccccagaaattgcctgaaaacaaatcacaggttgaaactagaaataacttccctctcctaggcagcttggagactggccaccctgtttcttggtttggtaagaatgttccagacacaaggaggggagcaacacacactggggcctgtcgggggttggggtatggggagggagagcattaggaaaaataactaatgcatgctgggcttaatacctaggtgatgggttgataggtgcagcaaaccaccatggcacacatttacctaagtaacgaaactgcacatcctgcacatgttaccccagaacttaaaatgaaaataaaaattaaaaaaaaaagaataatccagaaagtcaagaaaagcctaactaaaaaagtctttttaggcaagagagcatcgtaagtaggatgtagaggaagctcccctgcttaaaacctgttaatggtcttctgtagctttcaaattctagctcctcttgcctccacgactcaactccccagccctccttccgagtgtacaagatgactcaccctgagtccagagccaaactctcggtttgcatcccagctctttgccacttactacagaccatgtgaccttgggcaagtcacctaacctctctctgcctcactttcttaatctgaaaagggggggatgatgaccacccgtttcatcaggttgctgtgcatacaaatgggcgaatatgtgtaaactgctgagaacagtgcctagcaaatagtaagccctatgtaaatgtttgctgatgttgtgttccatgattccgtggctttgaagatgctgctctctcatcctgcaatgccaccttaccttacctagcaaattccaacgtgtccgttaacattcagctcaaggctgggcacagtgactgacatctgtcatccccaaactttgggaaactgaggcaggaggatctcttgagcccaggagtttgagatcagcctgggcaaggtagcaagctctcatctccacaaaaaaattaaaaaattatccagaggtggtggcatgcacctatagtctcagctactccaaacactgaggcaggaggatcgcttgacaccaggaatttgaggctacggtgagctctgctctcacctctgcactacagcctgggtgacagagcgagaccctgtctctaaaaagttttcatttttaattttttaaaaaatgtttttaatgtatctcaagccctacctccttcagcaaagtgttctgagcacccaggtctgatgtagggccttgtccatgcttcctgaaaatatatcttctgtagcattcaatgcactggaatgcctatgttagctgaaagttactgatcacaattccggtggcctggaggattggtgagcccagctgtgaagtttagaggcttgctatcttgcccaggctgatctcaacaagtaaacattagtttattcatctgtcttctccctggtttcaagcccctggagtgtagggccacatcttacttggcattgtatccagcagtcaacatagtcctagaatatagaaggccctcatgttgaatgaatagtaaaaccctcctgaaatccattaaattcatatgtttatttactcactcattctcttcctttgttcaaaaaacatctcttgagcctctgtgatgtaaaccaagtgctttttaaccagcagcttctctctgatgatctatctgcaatctctgtgtcagtcctcacatttaactaggacaaaaagagaacatagattcttagtagctttgctcatgacctgactttaacaagaaaaattttagagaccaaaagtctgactgatagctgagtgagttctttctttcaaactcaaagccctgtttgagcctctaaacttcacagctgggcttgcaaatcctccaggccaccgcatttgtgatcagtatctttcagctaacataggcattccagaagatgttctgccctaaacgtaattggaatcctttttgaatcagttgccacagtacttctgaagttttttatgctaacttcttgggtatatttcctcaagatggattcaagatgtggccagttctcttgtgagaagaatacatttctgttgtcctaagtgtagagaccctctagttcatgtaatagccctgcaaagcaatctgctattaccagtcccagcatccatttctccttccttccttagtaataaaaccctgctttggctgagcaccttgttgcccagaattaaacactgttttaccagcttccctgatgggtgtggtcaggttactaagatctggccaaagatgtgtgtatgagttttctatgctgctgcaaattactacaaacttagtggcttaaaacaacacacatttatcttataggtctggaggccagaaatctgagatggatcttagagactaaaatccaggtattggcaacagaggtgtattcctcctggaagttattgctttttctagcttctcgaggtcgcctgcatttcttgtctcgtggccctttcctctgtcttcaaagccagcagctctctggcatgtttgtgcttctcattctcattctctctctctctcccaccccgcccccgcccctgctgtgttatcacatctcctctctctgatccttctacctctctttcataagaacccttttgattagatagaacccacatggataatctctccatcttgaggtccttaatcacatctgtaaagtcccttttgccatgtaaggtatcatattcacagttctggggatcaggacatggacatcggggggacattattctattgtcatgtataagtagagtaagtaagtagagtatggcattttcagaaatgtgctcaaagggaggtgtctcaactgggaaggaccctctttgacccttctgcctttcctttctaaagctgagatatgatggctgatgctttagcagccattgtgaaccatgaggtggccttgcggatggaagtcaagcactaggatggtagaagagaaacattaagatataaattcctgatgatgccatggagccaccttttaccaaatacacttctatcttgtttaagctactgccatcttatttgtttttttttttctggaacatacagctggacctaatctcaatcccttaaaactatacatgactctcttcttaataaactgcaaggctggttctctcagcctactaccctgcctaaggaacagataggtagtaagcatggatatgaccattgctcagaaaatgtgttccaaaaacagacagtatgtttatcatttattgatcagttcagcctctggctctgcctatacactgagccatacaacctcaatattaatctgggctgttaacattcttccagagctttgatcatggtctacatcttactccccggagaatcaggtgggcagaaatgggctactgacctatcaatttctagtcctgattagctcaaaatgtggtcatttcctcttaacataaatgtatttaacaacctgaaatagcaaatagcaaggtaactttccactgacctgtcttactattaatatcagaagtcagaggtggacctaaaaagtaaccaaacaatcaaaaccaatgtctgtaaggaaaaccagcatcgttattagtgacaccaagattcaaatcattgatttagcaacactccttagtgtattcatcagatgtttattggaaatctatggtgtggcctctgcagtgagtcagagtgcagagttgaagagatgagggtccctcaccttaagaaccctcactgcattaatggagagacagaccaagaaatgcctttgtggtttcaagaagtgcctttgttctgtttcatttttttattgtcaacaatcatggccaggcatggtggctcatgcctgtaatcccagcactttgggaggccaaggtggggggaatcacctgaggtcaggagttccagaccagcttggccatcatggtgaaaccccgtctttactaaaaatacaaaaaaaaaaaaaaaaaaaaaaaattagccaggcatggtggcgggtgcctgtaatcccatctactcgggaggctgagacaggagaatcgcttgaacccaggaggcgggggttgcagtgagccgagatcatgccactgcactccagcctggactacagagtgagactccatctcaaaaaaaaaaaaaaaaaaaaaaggaaaaaaaaaatcacaacctagattctgtaagcacctacagcagctatcctttgctggggtttcctcattcagctctctcctcattcattatctgggtcctattgtattccctttattagttttagcaatgtttaaaattatttgctgcttgaaatctaatccattttgcaagtaaccagcacctgggggcaggggtagtgatgagaaaacagggctaaaaggaataaattcacaatgagttttatatttacaccatccttttcccattcacagggttttcccatttgggaacattcttagcgtgttctctgaacagaagaccgtttctcttggtctgaagttgatcaatgtgagaggaagatggcacattagaaagatgcctggctctgatgacattccaccccgcagtcttccagcacactgggatctggggcttgaagtcacttgtctggctgtgtgactgtatccacttggaagcagcgtcccctgctcctaagttgcacaagatacttcagggagtctgctgtgatttagtgatagacaagtcagaaaacaagtttaaacttgttattaatcagaagagaacacagacatttttagctgtctatctgacttggtcatagggcagagccatcagatgccatcagtggtggtcggtgtagatttttttgtgaatcaagacaggagcaggaaaaaggggggtggaaataacagacaggttccaggagggcctggtggagggttcagctgttggagctcatttttcttgctttttcccgagagaggggaatggactgccattgtcacaggttaagtcacagaagagtgaagctcaggtgacaggagacattccaaattgagaacagacatgccaggggtccctgttgccacctgctcacaagccaaggccttggttccgagcccctcttctctctctgcattttctccttgggtgacctcatccagcctcgctgcctgaagtgcattcctacacaccagtgactctcaaatactatctccagccagctctctccccacaaatccagattcaacagccactccatgtccctactcagatggctcctacagacctcaggcgaaacatggctagcacgcaagcccaggtgtcctccccatcctgttttctcatctcagttgatgtaagctccaccgtgcacccaactagttaagctagaaacctggagtcactcgagactcctctttttctcatgggcaagccccatccatcagagaggaccaggagccttgcctccaaacccatttgcttctcttgatttcaccatatcacctgtgcccaaccagccttccatttctctaacccagtggacacagttccaaactggtctccttgcttctactcctctccctttacaatccattctgcactcagcagctaacatcttttaaaaacataaactggaccccttaccacttgaagccttccaggactttctatttcttttaaaacctgacacagcccctgccttcctggtctcctctccactgtgttctgtgtggccaacctccaggcgtacgagcctgcctcttgccctctggacagatcaagcttgcttcctgccttggagatctggccttggctgttcctctgatggggaggctcttcctccaaagagtcacacgaccatctccttcttgttcctgagttctttattctcaatgaatgaagtttattgcactcccctccccaatctcagtagtccccagtgatcctctctcccaactcccattctagcttcattattgcgctgtttttccttggtttcatgcagtttccttgttcattgactcctccattacagagtaagcttagagaggtcagggaccacatctgtttctgtctcattccccacttcagcacagagaacgatatggggcacagtaggagctcgataaatgctttagtgaatgcataaacaaagtaagaaaccatgaggtgacccaaacctcggtttcttcagttataaaatgggcacatgggtgcaaaggctcaggtgtattgtaagggtgaaacgagaggtgatgcgtgtgaggcctttgtgagctctagatctctttgtagatgcaaagtatcagtgtagattgcagtaaccaggacatcagaagaaaaccctgctctttggaagcaaagtgtgccaaataacaaagcttagctctacaaggctatcgctaagcctatgcaataaatactttctctcctccacatctgagctggacattctccacttgtccctccagagccactctccacccttcttacctgcctctgtgcctcacgggctgtcactacagctgcctcagtaagctcccttgccctctgggtacaaggcttcaactgatgggtgacaccaacaggagatcagaggggaggagagggagaccaggtaacttattccctggcagaccttcatcagagagtagctgtgttctgctgaaggctgtggcttctgtctgtccaccttctcctagaaagaccacatcctgtgggttcctgtaactgttcctccttgctaccccattcgacctgaggttggaaacttcctctagttgttgctctagccgcaggctgctccacaatccctaacccacccaaacctttgtctaaagcaccttccttacaccctccccagctgtggcatttcggggccctgttagcatccacgtgatgctgctttctacaaatgtgtctatttgtggtgacagcacttgcgctttgctttcttccctttcttatcctacctgatatcccagccttctgcccctcagctacaagaccactccataaccatagaggaccaaaatcacctaggagcttgagagagaaaatgtatttgacatcttgaaaataatgcagtttgctcaggggatttatttctccctcccctgggctctgcgctcagaccctctttgcttctgtccgactactgcaagcaggcagttaagattatttctagcaaatggacttagagaagctgagcatatgagtgatgttgaaatttgacctacacttcttttttttttttttttttgagatggagtctcgctctgttgcccaggttggagtgcagtggcatgatctcggctcactgcagtctgcctcccgggttcaagcgattctcctgcctcagcctcccatgtagctgggattacaggtacatgccaccatgcccggctaatttttgtatttttagtatagacggggtttcaccatgttggccaggctggtctcaaactcctgacctcaggtgatctgcctgcctcggcctcccaaagtgctgggattataaacgtgaaccaccgcgcctggtgagctatgcttattacttagatttctagcagataacatatagttatttcctaaaactctgttcttaacctgagctgtttttgtcatttttcagggttttagggggtgggaacatattacaggagctattaggtgcatgagtgtgagttgcgggcatatgtgagggttgtgtgtcttgtgtctatgcacatgcgcaggtgtgtaagtgggtgtgaatatgtgtgagcgttgcatgcatgcatgagttgtatgtgtgttgcatctgtgcgtgtgtgcaggtgggtatgagttagtgtgagtgttgcctgcatgcgagttgggtgtctgttgcatctatgcatgtgtgcaggtatgtatgactgtgtgagtgtgtgcaggtacagcttctgtattaataagagacgggcaatcactgtgcactgatattgaggggtagggattagagggcaccttgtctatttgggaggtgaaggagggctggaatgagaggctgaaggggtacagaagaggaaggcagacccctgcaggcctcagggacctagcctccctcccttcagtgtcccttcctctccctgcaggaaccagaaaaagtgtggaggtctgaattgcagtctctaaaatctctcctcagtctcacatgactggcttcagttttctcaccagtcctgcaaagccaggccttgaccccttatctaaatatccaaagaaaaaaatggaattagggatcttagaaggaaagagtggggcaggaaatgcaccaccagggcagtgcagcttggtcactgccagctcccctcatgggcagagggctggcctcttgcagccgaccaggcactgagcgccatcccagggccctcgccagccctcagcagggccaggacacacaagcctttgacttcctcctgtcactgctgctgccattcctgttttgtggtcatcactccttccctgtcctcagactgcccagcactcaaggatgtcctgtggtggcatcagaccagaggcccctgaagaggagtgagttgggtgttttttgccgcgcccaaagcagctggctgtcccctgaaagatggcaagtggggaatgatgatggtgcaccatcgttctgcacaccaagcccttctggataggaggcccccagcagtggagggatgggggctgccaactggcattgcccagaggcccagctcctggtcacatagactgacctagcagtgcaccagctacccgaggcagcctgcaggaaaggtgcactcatagcgatgctggaatgccatgaggcccagccatggggttgagaactggaatggagggaaatgtttgcatcctgatgctgggaaacaggagatcagtcctcaccaacgctgagatgatttccctctggttcttaagctcggttctctttctgcttgatgcttgaatctctggtgtctggcagagagtctggtgtctggcatagtgctttgtatgtaggtcatgccagagcatgctggtgactttgcccttctaggactcttttccatttcatagggacttgctgtgaaaccccgtttgacctggatataaatgttagatgtcatggagtcctgttagcatggtgagctgcaggctgttctgcatgagtcctccttgagcctgcatctaatacccactgctcaatcaatctcttttcactgtttcccattgatcccaagtgtgtcctctgtgagccttttcttgacactgggtcacccagaattactcccctgtctgtgtccccatagcaccccacaaatagttcaatcatagcccttgtaacattctggtgcaccagtttaaggacagagccctgtcttattcatcattgctggtggatgaataaaaatgttcaagtcgtaataacggcaatgacaacaatgataaactcaccacttactgaccattggctgtgtgccacaggacataggactgaacatcttacaggtgttatcctcatgtccactctctcagactgcacttctatcgtattctacagaaactgaaggatggaaggtcacagagctggtgggaggggagcctggattcatacccaagccgtgtgcctcctggccactcctatgggtgaaggaaagcaaagggcttagctgtagctgggatggagaaagaggaatctcaggcttctcgtcatattttgcctcaagaactggaaattgatctgggagtagatcccacactgagggagaaggccccagaccaagaaaggatgggctcatctatttgattgaaaacagagaagcttggaagacccaaggtagggcaattcctgaaccgtccagggctggaaaacctgtagcaaaggcctggggagatggggcagaaaggctaaattataacttaggaatctccaccaggagatcagctccaagacagcttccagtttcggcagatggaagggatacttgatggaaaaggagggagggtaagtgtcagagactgctaaatgtctttacctacatttcctcatttcaaactctcacagaacagagtctgaggtagactctagggctggccccattttgcagatgggtaaactgaggttcagagcactatacccgtaagatctttgctcaagaacttgtatgtcccagaccatgcttgaaacctggtttactcacacaccctgctgtgcagacctcctccgttccaaagtggtggcagacttcagtgtgctttgcagactttcaatctcagcacatgctgtggaagtgctagcagtgttgctgtgctaaccctgtggttaggctgatcacagtcctggtgagtaactatggcctgcagccctggcatctgaaagatgaccccttgcctctcctgctgtcctcaagaaagccttagccccctagattattttcaatataaaatgttcatacactacttttcagattcaaatttgcacaaatgaagtgaccgttagacaccactggaaggtaataaaacccccaagcctgccagccatcaggtccctcccagccatcccagaaatatgctcagctgccctcgaaacatctgtcatgctctctggtgggtgctactgggcacctgacattagatcacttctctcccaaagctgcagctctgcttattcgattcttatttctgcctttggattgagtggaaggcagtcatcagtgacagccaccctcggggaacagaaacgatgtccacagtggcaacgatcctccatcttcctgcactgaggcctaatcaatgtagcccatacccagcctccatttaataagctgattgttgagctaaatcccgcacactctccccttgccctggacgcttttgattgacaaaactaatctctcctccacccccacgtctgctgctgcccacatcctcttgcaaatcatgtactcggctgctgacaattagatataagacttgggattcggatgtgggagggttatgaggttatgaatcaattgtgggggctcaggtgagataacaaaccaggggaacccatttcagacacctcgccacagccctcagagcctcctggttgatttatgagttggtaataacctcgctgggtctcctggcccctattatttttcataatgcacaggaaagctttaaatatcagagaatggggaagtgcacagtctgagtgggagggaggtgaggggggatggggcttgggggagaacagtggccaagggcttccccgcagctgattgtctctcctgccccatctccccaggccttcgctgcaggtcttctagtcctggacgtttcaggaattgctttatcttggctttttcaagcttctctgtttcattcaaatagatgagcccatcctttctcggtctggggtcttctccctcagcgtgggatctactcccagatcagtttccagttcttgaggcaaaatatcaggagaaacctgagattcctccttctccatcccagctacagctaagtccttcgctttccttctgtgggtcaccacggggtgccgttgtcatatacccatggaggccagcaagctgatctggccaacctgggagaagaccccaggttgatgacccctggtttaggagtgcatatggcaggatgcttgagggatcactgggcccaaaatcgtatttgctgtgtctggatgtaatgcctcccacctgttcaagaccacgtcagaatgactcagagacctgcctgttaagaagggaaaattatccgctggacaaaagccagtcaaaaagcaggctcaccctgcagtctggaagccagttgagcagcgaggacaggccaaaaaggtgggagggggccagtgagtgtctctcagcctggaggtaaagagctgaagactttacctttccttctgcctgctgtcctcttcccagtgacagccagtttttaataaggaaaaggaggaggctttgaattgctacctaatatttgtttaagtagtaatttgttgagatttctctgttttgttttgttttgttttgttttttgagacggagtctcatgctgtcgcccaggctggagtgtagtggtgcagtcggcttactacaacctccgcctcccaggttcaagcacttctcctgccttagtcatccaagtagctgggactacaggcacctgccaccatgcccagctaatttttgtatttttagtaaagacagggtttcaccatgttggccaggctggtctcgaactcctgacctcaggcaatccacctgccttggcctcccaaagtgctgggattacaggcaaaaagatgtgattttttttttttttttaacagtatcagtgggtgaaagaccctgaacctttcctctaaggcagtgtttgtaaactgcctatatgatgtctggtactagattgtgatgatgttttcaagggccacaaaacaattgaggaaaaatttaaaacatactgaatatacatgtgtgggtgtttatgtattatgatgtgtatttgaatacaactatcaacgaataagcattcattagaccccaactctgtaccagatgtttgtttactccatgccagggacagaactaacagggtccctgctctcttggagctacagtttagtgggcattatgggttgaattatgttctctcaaaaattcatatattgaagttctaaacactagaactccaaaatgtgaccttatttggaaatagagtcattgcagatgtaattagttaaggtgagataattagggtgggccctaatctggtatgactggtagtcttattaaagggaaatttgggccagtcatcgtggttcacacctgtaatcccagcactttgggaggccaaggcaggaggatcacttcagcccagaagttagagaccagcctgagtaacataaggagaccctgtctctacaaaaaatttaaaaattagccagcatggtggtacatgcctgtggtcccagccacttgggaagatcgggagaggcctgggacagattctccctcacagccctcaggaagaaccaacccgttcgacacctggatcttagctgtctggcctccagaaccatagacaataaattgctgttgtctaagccacccagtttgtgataccttgtcatggaagtcatagcaaactaatatagaagaggaaacagacatcgatcaaataattacattgtggctaattccaaactgagataaatgcttcaaggagaaagaaccttgttctcttgacgttgaaagccaaaggaccttgagccagtctggagggcaatgaaggccttcccgagggagttagggctgaaggatgtgtcagagtcagctagagctgtgttccccagcctttttggcaccagggaccagtttcatggaagacagtttttccacggaccagggttgtgggggatggtttcaggatgattcaagtgcattacatttattgtgtactttatttctattattacattataacatataaggaaataattatacaactcaccacaatgtagaattagtgggagccctgagcttgttttcctgtaactagacagtcgcacctggggggtgatgggagacaggaacagaacatcaggcattagattctcataaggagcgtgcaacctacctggcatgcacagttcacaatagggttcatgctcctgtgagaatctaatgccactgctgatctgacaggaggcagagctcaggcagtaatgtgagtgatggggaggggctgtaaatacagatgaagcttcacttgctcacccgccactcacctcctgttgtgaggcctggttcctaacaggccagggaccattacctgttgggaggctgaggacccctgagctagaggaagaggtgggaggaggaagggaaggcacgacaggcccagggagtagcagatgcaaagatcctgtggtgcaatggagactgttgcattctgggaagggaaaggcagtcccaaggcaggagaggtgggggaagaagaagagggtgttgggatggatgcaaccagagcaccccaaaccagaaagatgtttactccattaccttcaactgaattacagtggggtgagggcacctattttgctttctgccctcacttccgggaaatgcgcatcctggatcacagaaaagctgctgggcagaggtcccagtctctcagtgaggcctcaccagactagtagagttgtccagccacaatgccctcctcatttccccttctgtccaacaagctgtctatcggaagatcccagtctaaaagcaccagaagacattttgagtttctctaaggcctaaaatttaaaagctgataagtaacacaaggattccaagttactgctgtctctcccagccacgcagatgactgggttagacacttggctggtatgaggtccctgaaacatgggctctgtgagtagccaatgtgtattaatattaatgcttatgatatgtcaggcactctgcatgggttcattacccctcacagtcaagatgatgggtcccattattactgtcctgttttctttatttttgagacggagtttcgctcttgtttcccaggctgcagtgcagtggcacgatctcggctcactacaacctccacctcgcgggttgaagcaattctccctgcctcagcctcccaagtagctgggattacaagtgcccgccaccacaccaagctaatttttgtgtttttagtagagtcagggtttcaccatgttggccaggctggtctcaaaatcatgacctcaggtgatccacccacctcggcctcccgcagtgtactgttctcttttcatatgaggaaataaacgcacagggccagcagatgacttgctaacaaccagatcatttcagcaaaaccatgaaccaggcattgtgaagagagttttgtatacctggccttattcttaactagacagcacttcaccctagttgacgtatgaagaaatggagatcagggcaggtggtgggtaagggacctgcccaggttcccaccgtttgtaagtgatgtaccatgagttgctctcaagtgtgtctgactttataaatgctgcaccttatcatttcctatgcttggtaagcaagtgagtgtgaaatttgccacgcttttccttggaaaaactcaagcccattgaccaaacaatactacttgaaaatgacactgaacttttcatcactgtgtttctccacctgtgttcccttctgtcttactgccacctactcattgtgctcaccctccaaagcccagtttaacatttcctcttagttaagctttctctgctagctgatcattgcattttttttcaattaaggcataaaagaaaaaaaaaagacggtaaagattgtcctacttagaatatccttccattcatttgcaaaatggagataataatatgctatttacaacataggattagtatagcaggattattccagagcctggaatatagaaagtactcagtaaattattagttcaacagctaataatagtaccaattattattatcactaaattaatgcctctgtttcaggaaaaaaactgaatacatacagaatatcggttttctaattgttttttctttatactacttggaaagttatacagagttaagagacacagaatagtatagtggaaataatatttggcatgaaattgcctggattccatcagtagtagcctgtggtcttgagcctctctgggcctaatctttaaaatggatataataattatcatattggacacaattattgtcaagataacatgcgataacagggtcaagtgcccagctctggcctggtacaccatgggcactcaggaaatgtcactccgccttcataagcattggcctgtgcatgacatctatgtgataaggtggcctgaagctgtcctccccacccagaggtgcagcagaggcctggcaggaatgtgaaaatccaatggatcaagtcataaccttgactgaagagtatggtgagttcactcatggcaggaaccatctgatcattcatacggctccagaaacattttactcaaaagaaagtgtctttccccaacagtcaagattgataattagtttatgaattgcttcatttatcagtactatgatgtactgtataatccaccaggtttcaagttactggaattttgcaggtgatgggaaccagtctttttatcaactttgcataatctgatctgggctcagattgatagaatgctttgggaagaatcaggggagtgttttatactaggatctcctgcggttctgatgcgttaatgggaggaagctatccctgtcaaattctacaattttggaggagcttaaaacacctgaagacaaagccctgaattttatgagtgtctgcctgaaaccagaaacagaaaccccttacagcttactcaacagcgttaattcagcatggaaaggcaccaggaaaagatcactgcgtcttactcccaccaagtaaacaagctaacaaacacagaggagaggtgcaggttggcacccttaggccggactctgggtggacagccctgtcagagtctataaagggtcgctctgaggctccaggagtggcagatggccagagagtggccaactggaggcacactattgagcctcgggattgagcctcccactgtttacccctcaggaaaaagagagctttgagtctcctggccctttccccagagagcaggaaatggccagggcttgaggatagccagaggccgtccaaagttacccataccatctccactttggcctcagaggccagctctttcttctctctgtgctttttaaaataaaaacttatttttctagtgtaaaagtattatatgaatgttctatgaacttcaaataatacagaaatgtaaagaatagaaatttcccattatttgatgcctcccgctccccaaaataacctaaagttaacaatttaaatatatatccagaatttttcctctccatatttatatatatctatacatatataattaatagaacataaatattttacagtaaccctgttctcaagatgcttttccactgtagatgtttaataaatatttattgcatgaatgagccataatttatttattcagtcctctattagaggcctttggtttgttcccagtcatctaataaacatgattttagatataaaagacataattgaaatacatataacacatacagaaacataacccataactgcatatcataaatatatccttaaatatactaataaaacacgcatgcaatggagaggtgttttgggtgccgtctggtgtatatcctggatatccctggaatatatattgataaatcagcctcaaaaagaatgctttcagacagtgttttaggatctgtgggaacaaagggtggccatcctgcatttgttatgttgtttcaacatagcatttgttatgttgttttattaactttaagtccttggcaaagcagcttgactaagataagatccagaaaccagtcgtggtaacaaggcaacaattaatcttagatagaacagaaaaggaatccgcttcaaattctctttagaacaggaaggaaagggtgatcgtgggttagcaggaaggaaggaaagaggcaagaaaggaaagtgaaaaaagaatggaaatgctttctcctgctggtgatttggatgtttggactactcttgtcagatgctacagcgtaatcactgtaaatgttttaaaggacgcgatattatgacagatttccctttctgacttgttcctggggctgcacacacaatgatttactccctgccacgggctggaggcttggccactcctgggttggtccaaggaagcctggaatacccaatgcctgtgagagtgagcacgtccccctgtctctaggtgttgttgcttgtgctgaaatggagtctaccaagcattgccatggcatggaagggatggtggcggagtagatgccactgcagattgagtgcagtgtcccaggcagccaggggcagccgctcagcccttgcctggacctgaggactgttgcatcagtctccagatgagacagcagctgtcatggtggctgaaccagggaaaagaaactccactctgtggtctccatggggctagggaaaaaaggaaatgggtttttgtgattttcccttctttagaaacaaaagtgcttaaatgtgattctttagctctgtaaatgcaaaccacggcctggtggactggggagaacaattaggccaaaggctgagcacaggaagccaaaagcgggtggaaacccagacaacggtgctgagccgggggttggggtggttggggggagcggatatgatagcaaggaaggagtttcaatgtgaatgaatactaattagtgacatggatattaatgatgacagtaattaacaggggaaaggaagggctgtcattgtcccagggtgagtaatcaatcttggcaggtgataaataatggttcagcaagctcagcagaaagataatccgcaggcctgggggagaactcagctaatgcaggaaacctcacagtttctaggcaacccacagaaaagaactattttttttttcttttttgagacagcgtctcactctgtggccaggctggagtgtagtggcgcgatctcggctcactgcaacctccacctcccgtgttcaagcaattcccctgcctgagcctcccgagtagctgggactcaggcatgtggcaccacgcctggctaatgttttgtattttaatagagacggggtttcaccatgttggccaggatggtctcaaactcctgacctcgtgatccaccctcctcggtctccaaaagtgttgggattataggcatgagccactgcgcctggccagaactatttttcttttgaggaaaaaacagattagagtatctctcccacccccagcttgggactacagttcttatttgatttctgctttgttcttcatttcctgggacaaatgttgaacttgtataacttggaggaaagggacacacaggcacatgtacacacacacatattcattctctctctctctctctctctctctctctccaagaatacgaatgaatacgagtgtttttgatctaaagtttgactcacagatgctgtccaggagtagcaagagtgaggagaagcctagaagtgctgcctttgaggttggcgcggggaaactgcaaaattgcaaggctgtgtcggcagaactggggcacacaggaggatgaggatggccctgggggtcccactgtgcagggttacttcacctgccatggacccagagagaaacaaaatgtctaggctttctgtcctgtaccagtcccacttctggccaccagtcacatatctaagaaaactgatttctgggaagagggcaatcctcatgaagcccctctgctggatccccaggccttcagccaggaatccagcccaggagagttcttggcacatcccctccctctcaccaaagcctcagacccacggtaggactctgatatctaaaatgtctccccttgcaggctgtgttccatcaaacaatttagaggtgacaaagccacaccttcaatggtctgcactggtttaaagtgagatctttgggtggcaaaggtagattgaccagaaattcagaaccttccagaaaactgaactcctctactgccatgtacacagtgctgctctcagaacattgtttgcgggtcacattttcaaagagaggcagacagaagggaacttattcagaggattgggaacatatggtgaggaactccaggccacaccctgcaaggaagcagctgagggacccaggcctgttgcacttggagggaggacgtcgctggtatgccgcaggactgtctgaatagctgaagggctgtcgcacagagtggttaggttggggtttgtttttctatcatcaaatggcaaaactgaggccaaagggaggaagtcagagaggggcaagtttctgttcagataaatcaaggctgatttaactgggtcaggctgggtaggggggagtttgtgagtttccaggtactagggattctaaacacaggttacagcacctcttgtccagggtgttgtgaatgggacatgtattggctggggttggagtagacaagctttaaaagttccttcagggccgggcgcggtggctcatgcctgtaatcccagcactttgggaggccgaggcgggcggatcacgaggtcaggagatcgagaccatcccggctaaaacggtgaaaccccgtctctactaaaaatacaaaaaaattagccgggcgtagtggcaggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaagttccttcagactcttaagatttatattcgttaaggtaatactagataccaaaacagctaagtcccaaatttcaggggcttaacacaacaaagttcagtcctttcagtcctcaatcaagtcagagccccacatgggcgtaatgtccatggttggaaccgtggctccctgcctattgtggctctgcattcccccaggtctttggagtcccccacatccagccagtagatgggattgaaaggggcagagctaaggagagccatgtaggagtttttatggtccaggtctggaagtggcatatgccatttctacccatattctattggcagaactcagtccatatctaagtgcaggggaggctggaaatgtaatctagctatggcacagtgaggagaggaaagaggtcttggtgaatacatagacgtttctgccacaaatgcagggacacattcattcaggataggcctgtgccggaagagatgagagttttgcaagaacctatgaggtcacctgtgttggtcagcccttgtaattgatggtagggagctgatgaggcctccttcttcaagaaatggtctgggggccaggcatgataaagcttcacctagcacgtctcagggaagtcctctatagacacttcctagaaacatgaatataagctcatcctgcatcatcagaagtgagtgttttttggacaagaatggaattgtaactatggaagtgtactgaagaatggaaagggttggttaggacaaaaaaaagtgcccatattatcctgctctacagtgtggactgtttggaattaggattctcttaggtaaacatgtttcttctgccacagtgttaaacacccaggaggtcttcagctgaaattgctttatcgttgcaggtactgacattgtgcagtggcttatgaagaacctttccattgaggacccaggtacttgacctttgaccccacccttatctcccctggtatcagtaaacatcccataaccaagttccaaactagattcccctgccctcctgagaactggtcttgtaaatgtgaattccaagacgtggaatcactctatttacaaataaaattaatttattttctccactgaatatttgtctttaaatttaaatcatgctttgaggaaatgagcaactttttagaatgccaaagagcccaatacaataatgtgtgaaatgagttgaattctcattagctgcagcaattaaagataagttgtagcactgtcactgaacagccttctagagccagctcttaaaattagattgcctgatccacaattaagatgtttaattatttgctaagactccctctgttttctgcttctgcaagaagtgaaggaatgattttttttcaactttaattgcgcatttcaattaggaagaccttaccaggaaaacaacaacagaaccctggccaataaaacaatttcccagtctgttctcccaccagaaaataggcagtaaaatttattttcacagtgtaattaggaaatggggggggtgttccagaaaaataaaaattcaagataagtaaagcttattcccatgtgctgtcagttaatacttttccgaatttattacatactcctttgccttgattaactgagtattcttgatgcctgaaggtcacatttataaagatccactaatacactctgatgttcttaatggacattggcgtgattagacttacctgccccaaattaaatggccctgaaccacaatgctttttgaagatttttttgaagtgcccattctgcatccgtgaccttcagctgtgagtccctgctggaatcggtgtgtcagcttggcactcctgtattttaacccaacatttctaatctgttgactgcaaaacaatacagtttctatgcagttcaattatatacagttgttagaactctgagtgccagaaaagcagatcattcatagaagtggcccgagtcttttcacccccttgattagtggctactctcacaactagtgaaaattcttaattctagtcaagttcttgattcacagggaaaaaactataaatgctaaccctttgtaaaggatagaacccaaagcaactcactatgtgttgtccctgatgcagcctgtacttctgagtgtccgcttggaaagcctggactgaatcagcatctacctgtttagttacatttatctaaagtcagtatttcttgtgattataatgctaaactaaggaacgtgtttcctcatggccaccttttctcttccaagagcactggtttctttgcctcctaaaataatcgttgtatttctgacatatattttattattactattatgagaaccctaaattggcgagcagtatgtgagaatgagcttcaggaatcctccagccctggcgtgagaagcttctgtgaagggtcctgaatgatgagagttatttctatgaaaatctgttatactctgatgcccttgggaagacatcatggtataggggcctgtttgggcttctgagaagtggctgaggagaagctaagaaccatttgtcagctgggaatagtctaaggggggagatgaggcaaaccgaggccttgggaaacagtcagatccagcatctgcccctctctcccttctttttcccatcagtcgatttcctgtggttattttttggtttttgaggcaaggtctcactctgtcacccaggctagagtgcagtggcacgagcatagctcactgcagccttgacctccctggcccaagccatcttccacctcagtctcccgagtagctgggactataggctcctagcaccacatccagctaattttttgttttattttttgtagagatggggatctcactgtgttatccaggctggtcttgaactcctgacctcaaacaattcttctgctttggcctcccacagtgcttggattacaggtgtgagacactgcacctggccccattggccaacgtctaagcaaaaacatttttgctcagagaatgaagttagagtcttagctccaagactggtggcatgaaagtcaccttcctacaggattttgttctttcttctctggggaaggagcaactgctgatgatgaaacttctgttctagctggactcatggttcttgaagcatatggactttaaaaagcaaaccggccagacatggtagctcatgcctgtaatcgcagctctttgggaggctcagctgggaggactgcttgagcccaggagttcaagaccagcctgagcaagatggcaaaaccctacctctaccaaaaaaaataaaaaaaaaattagacagacgtggtggcatgtgcctgtggttccagctacttgggaggctggggcagaagtatcacttgagcccaggagttcaagtctgcaatgagctgtgatcatgccactgcactccagcctgggtgacaagagtcagacctgtctctaaaaaaaaaaaaaaaaaaaaaaaaatagcaaattggtcatcactaagcaagtaaaataaaactctattcattccaattccaccagttacatgtatgtttctttcaaaggagaataggtggttcttgatacgcaaaacattgcattgtattcaacttcttgaaaagtttgcaagtaaagccaaaacaaactactttaaaaagtcagagctcgtgaaattaataattgctagaggctccctgagcacattaacaatttccatgtccaaaaattagttttaacctgtaacagtacttttggatttgtgaaagattgtgtgtggtagaagcattgaggtttgttattttttcttagctctgctcaggataaatctaaattcttaacttttttttttttaattgagacagggtctcgctgtgttgctcaggcttgtctcaaactcctgagctcaagcaatccgcctgcctctggattacaggcgtgagccaccatgcccgacctatattctcaactttctatgtgcatctatttatggctggtgccaaaggaacgaaggaacagattgactgtggcaaaaatataagtatttctatcaggttagcctctctctgtcactgcccacttcagtgtccttcctctaattttcaaaggaagtgaggttttcctctctgtccataagagaagggtgacacccttctcattcctgatgggactgtcatattggggaacgcactgggagtcctacgtctctatgggcagcgaggctgcattcttactgctggggatgatgaaactggtatgaatcagagctgctagcacttacggagtatttgacctgtaccagacaatcacttcatgtgaaatatctcacttagttaaatacaggttcttctatgccagaacttatgcccttgaccctgaagccagactttcttctgaaggtcagggtgaggaggggttaagccatgtcagactctcagaggtgggattcagacaagtcccagacacatagttgccctttccagccattggcatctcccctcctcacccccacactgagcaagggcaattgtatcatcaacacagacatctgggggtgatgacagttgacttctggtctcccagcttaattttcagccaaataacctgctttctaattccttctctctctatgcactgttcttacagttgaagcaatacacttggggagccttatcgctgcccagggctacatctttccaatctcagaccatgttctcaccatgaaggatgatggcaccttttatcgtttccaggtaagcctgctggctcctcctcctgaagaaccttttcttcacaacatcatctgatcttaggttagaactacaaagaaaacctagggatatctgagggagtagccctcactcctcatcagcactgggaaagccaagagaacttttctctgggccactgggtgacccacttagagaatagtaaaaggctgtcattgagagcctaccatgccctgggcactgccttagtcccttgggctgctacaacaaaatacctaaactgggtatcttataaacaaacaaacaaaaaatttacttctcatggttgtggaggctggcaagtccaagaccaaggtgccagcagattcggtgtctggtgagggcctgctctctggctcatagatggcaccttctagctatatccccacatggcagacaggacctggggcttatatcagacctcttttataaaggcactaatctcacctgtgagggcttcaaaggccccacctcccaataccatcaccttggggattaggatttcaacatgtgaatttgaggaggatgcagacattcagaccatggtagacactttgtacagatttcctcatttattctgaagagcacactttagggggtaaatattacccattttacagaggagaaaactgaattgctcaaagaattaaagtgtcatttagtaaatcctggagcagccttcatctgaacctaagtgagcctgatagcacagaccttgatctttctactgtctcatgttgccttctcggagtgaagtttctatttgcgacctaatcaccctccccacccatttcacactccttctcccagatccttccgtagagggaatgagggcagaggatatgggcttgaatcaaggtctaaccaaagggtgtgggagaagagttcttcagactaggttaaagggaggaaaggaacatgggcttaggtgcccagtaagttatgccagcctgacttttgtacttagacctctattgtctcaggataagaatatattgccctgtgaacaaaacttaacatttttgcatttgttttgcttacttacattttgcttctcaatgcctaggttaaaatgttgactcaccttagctgaattagagaagaggagagaattgtggggtagcatcagcaagaaggagatgggggagagcctgccatcagggaggctcctccctgggtgtgggagggaagcgcaggcatggcgcgcccctgagcactaacacccatgctcctttgcaggctccgtacttctggccttcgaactgctgggaacctgaaaacactgactatggtgagaactgaagccactgggaactctcaacttcaacactgtgtgtcacttctgggggtgcagaagacaaatgcttggtgtgggccatggtggtacatggggaggagggtcctttctgcttagtcctttctcatattgttgctatataacaaatctcctgttccacataacagaggaaggcccagcttactgaaagatgtagtccttggaggggaagcaggagagggaagaaaaatcttatcaagggtggtcagtatgttcatcttggggccatggagaaccaggatcccacagcaacactatcagatggtgacttttaattgttctttccagggatagggcttcagggagggctggatcaaggggctacctcctcctggccctttctgttctcatagacttgtcaaaacttactaagaaccttttggtgttcttgacagttgcaatttagaaaagagacagagaccagggaggagtatacagaagtcactctggactaggaaaatagagtgggtgaagttgagagttctgtctctctagacagggacctacaagacttctgccagatattctcagtggagattatttaatattcctatatgccaattctctgaagaagttttattatcgctatgcttaagagaaagaacctgaggcccagaggggccacaccctcacactaccacattgtctgaatgctcccttgattataagcctcttgagggcagaggctggtccagcttatgcattctcatatctccagggcatagcctatgtctgaggcagaattagtgctcagtaaatatccactgacagttctggttctttattgaaggtgaccaacagacactcactagagggagcagaacttgaactcagatctgagtggctccaaaacccatacttctttcacggtcccatgtgtgacatgcctgaaggttgtagctgcagcactgcccctttgcatgcatccttgctgctgactcagctgctgtggcagtctcatctgtggctctccttgggactgggacactcaatgagacctgcagcttctttgcagaattgtttaagacaagaaggcagatgcagctgtggtgagtgggagggagatgtgcagctgggtggtgatcaggggagcctgtctgggagacccatgggataagatacaaccttggagtcacacgtttgagcaagaggaaaccaacaacagggagccaagctgaggatggaatacaagcgagttgtacctactaaggctggagttgttccatggtcaagtgtggaggacgtcagtcatgcagaagggcaggctctggggctgtctgcttggctatccacaggcaccactgtgggccctctgacactgtgctgcaccctaaccaatgtgataagtggatccaggaagacttccgactgcaagtgagagctgcatttgaccgctcataaaactagtgcttctggggctgaaaagactgctcatgaaagcccaactcagaatttgaataattatagctcagttccatgcagcaacgtgtgcccttgtgaatgtgaaaaccagtatttttccaggcagtggagagggtgggaggatggtaagaccagatacctgggcccaagtaagattaaaatatttacttccgtaaagcttagggcatcttatgctgcatactaaagggcatcatctccctgttctacaggtgttcttcattttataattttaattgtgcatcatgaacagggagagaaataatagtttgtttcaggctctcattaaacaaaaattattttaaattcctgtgcctcaatttatggcaaatcagagggagaaatcaaggttcaggatgcacaagtgttcaccagggaccaggcatggtggtgcatacctgtaatcccagtgactcgggaggctgagatgggaggatcacttgagcccaggagttcaaagctgcagtgagctatgattgtgccactgccctccagcctgggtgatagaggaagaccctgtctctaaaacaaagaaaaaccagtactccccagggtttccaaagcagtttagttagaaaatcaggatgtatttatgaagagagaatccagcacaatgagcccccaggatcaacccgttccactagctgggtgatcttggcaaattacttaacctctctgtgcctcagagacctcatattaaaattagagtagtaatggcacttgtctcctagtgttttgttaggattaaatgaaatgcatgtaaggttctctgagttaatacggagtggtggttggtatcactactggggtggggtcggtattattgccactgggatgttggttgatattattatgactgaggtgaccgtctcaccaggaagcatgtgaaactgaagctaagaattcaatatagtatgatttggactgatgaagtaccagaaactttcattcaattgacaaacgtttactggtccctactctgtcaaattctatgtcagagatttgaataagtcacagcctttccccgcaagcattccaggctgggagaggcagcatgatgcagggaagaaaggcatggtgaggatctggcttgagtattcaaaggttttatgtgatgaatgactgagaaggctgaatagcttgggaggggcaggtttataaaaaggccttggcagtcaagtagagacatttagaatggattcagcagtttggggaagctattgtgggtccccaacaatgaacacactttcccaagttttttccctacttgggaaaaaattggttcatctataagatgggggtaataacagaacccacctagtagggttattatgaggattaagtggactgtggaagattaagtaagggctgtgacttagtcaaatagttcctgatattcagtgggctcaatggaagcagtagctgctacgatggtgatttttccagcacctaaaacggtacttggcccataggagacactcagtacatttttgaatgagtgactgaatgaataaatggatcggtgaatgtcatagaggaaactctgcactggtcctcgattctaattccatctccatcactaactagcccttgggtccatcacttcatttctctgggcctttagtttccccatctgtaaatgaggggcctgtacttgatggttgccaaggttacctccagtctaaaattctttggttctaaaaagtcatcagaaagtatgaggaaaatagagaaataagtgagttataggttccctagtttaggagattgaggtacataatgatgttgctagtaaaggcagaaagtaaagaaaggggtcagtttcttcagtacattgaaactcgataagctcaatattttttaagaaatttaattgcacatataatacatgaatgtgttccctttatacaatttttaaatatgtcccagttttgtgtggtgacacatggtgaacttgagatggcagtggatttctctgagtgagatgtgagatataggtaagggtggaatgccagatgtaaggacaaggaaatagaaatttttcggtaagaaattaaatatccaagagaaaccaatatctgagcttaagacagttcttccagatgccctcttgtagggctggctattgtcaccagtagtcactagagtcggttggaagttagagcaagccctagtgagggcactctgggatgcagacaagccccagggagttctgtgccaagaacagccacatcccaccttcctcattgtggtgaaaagattccttgtgtgactttaggcacagggacattagctagtagcatgtgaccctgtgactcatggccatcaggagtggccccagctctgcattccatgcatgataactcacttcacaaccccgctgtcccattttgaccccgcttacccatttggacatttcttgggatgactctgcctgcataaaacccacagtcaaatccaggttagccttttctgagttttacatttggccagtgcaaaatcctgtccagggcagcattgtcaaagcagctgccacctccactgacctgcactgctcaaaggtaatcatgacctggcccagtcgagctggtgacatgtcaagcttcctgcctgaggttgtccctaattctgccaggggtccaagagactgaaggaggtactttgtgatagatcggacacccctttatcagacacagtgaagcactatagctgcttggttcattggaaaagttggtaagtagaaaatcatttttaaaacgacatatgcacaccttaagcacctcatgtaaaggtaagatatacaaaggaacactcatttgacagccttgtgaagtaggaccaaagtgttctctttgattatgagctgaataattttagtttcttaaatcaaccgcactcaaaataaactaccctgttttggtatctttaaagtgcatcaagaatgtaaagacatttttgtagtcttttgtatattggcccctcctagatttttattatttttcttactttttcctgttatctcacctgtatcaaattcaccagcaattgccttagctaactctccttcattaaattgttccaaaccattcaactgagttttcatagaagcaacactctctctcttttcacattaatttcattgagacgtgtgatatttagtgaacttgtgtgattaaaataacagatgtgcctgatataagcagatttgggaacaaccacaactgactcctatgagcacacaattcgccgggtggaagcagaagtgtgggcataccagagggtaggctgctagcttccaggctccaaaatgtcataggtatcagtaaatttttcagaacaaatgaaggaagttggttgatccagcaaagagttgactagagatctcttagtaaagagatcttgttgtccaacaacaaaatgatcacaggttctctctggccctccctcttgatcattctgttgttcatttatttatgccattcatctactgttttccctggattgttccacttggctctggagaaggaggaagacattgaagaaggaaaggtagggagaagaagtgatgatgaaggccatgtttgaggaagaaacagggaaaccaggggccaagaacctttccttagcctgagttgagagacctaaattgtcttccctttccatagcctttttactgcacctgacaagacaggctatggtgctagcaacagggatgaaagctgagcaggacatagcctctgcccttaaagagacttcagcctagagcaggggacagtctagtaaatacaggatttcagtgcaatggaatttagttccatggtcaaggacatgtagatgctatctgaaacaccaacttgggtcttcaaagattagtaagaggttgccagatagagggaaggagagaagagagaaagactttcctcaaaaaggacacatatgcaaaagaatgaagctgaaaagagtttggtggcctcacagtgcctgcatgagggagaagaagttgatgagataagcagtgagcagatcataaagaaccatatttgccatcctaacgagcccaaccttacttctgaggccattgaggactccaggcagagcttttaggcactggagtaatgtggtcatgtttgtgaaatatcactctgagtgtaggatgttcagggtgaagcagagtgaggaggaagaaggggagttgtcaggattggaatatggaggagtcctcatttgatcatgactatgaaaggatttatagaggtcaggggtcatgaggtccacttagaaaacatatttttcccaggacagtgctcatgaggtccacttagaaaacatatttttcccaggacagtgctgggcacatagcaagggtgggtgggcgggctgtctggatggatggatggatggatggatggatggatggatggatggatggatggttgggtggatgggtggatgggtggatggatggatggatggatggatggatggatggatgggtgaatgggtgaatggatggacagatggatggatgggcttataattccattgtgctgctggttttgtacatgttgtcatttcctttcttccctcagccatctatctctgtaagaggacaatgcaaaataaagcaaggctggaactggcagattatgaagcagtaagtatgattattttccaggatacatataagaagagagtaaaatcatatctgcagctccgtctaagtttattttttttttcttttgtcccccttttgtccctttcagacagtggaagggaagtatcttctatttctcctcccttgttctcagctcctctgaccatcacaataagatggtgtttttacataaataactcttaaaactcaacaataaaaaaataagcagctcaacttaaaaataggctaatgacttaacagatattttaccaaagaggacacaaggatgataaataaacccatgaaaagatgtccaatattattagccatttaggaaatgcagattaaatccgtggtgagatactgttacatacctattagaatggccaaaataaaaaatactgatgataccaagtgatggtgaggaagtagaacaactggaactctccgctttgctagtggtaatgcaaaatggtacagccactctagaaaatagcttggcagtttcttataaagttaaacatacacttaccatataaccaagcaatcccacttgtatatacataccctagagaaatcagaactcatgttcacacaaacacctataaactaatgttcatacaagcttaatctgtgataaccaaaagctgaaaacaacccaaatgcactttaacagttgaatggttaaactaactgtggtacatccatacaatagaatactactatgcagtaaaaaggaatgaactgttgatacacacaaccacttgaatgagtaccaagaacattatgttgggtgaaagaaaccaatctcaggccagccattccatttataggacattcttgaaaagataaaactatcatgatgaaaagcagatcaatgattgctagtggttatggatggggtagggaattgttggaaggtgatggaactgttctgtatcctgatcgtggtggtggttgtatgaatctatacatgtgttaaaatttacagacttgtacaaaaggaaaaaagtcaaatttactacataataacatttcaaattaaaattttaaattgcacctttatacccactctcctgtgcttagtagcagaggcagaatctaagggtaaaattcaattcagaaaataagacaagatgtgtgtcacatgaggtatctacttcccagctttcttaccttccttctctatctttcttcataagatgagacttcttgcaaaaattagaggccccaccaccaaacttgggtccattcccatttgacagagcccagaaaccaaagcacttgaaaactcatagatcatttaattttttttttaacttttggttgcaaaatttttcccccaaactgaactttacatgggtcacagagaatgggagaaactggctaaactttcttataccttctacttccctctccctatatgtcttccaaaggatgtgctgctgagccatgaatgactgaagggccagcagctatggaaggaggggcaacattaaggggagcagagaatccttccctggatagtccagcattaacagcatcttcagacccacccaccgccaaagcccttcctgcttttactgcctcagtctttcaaaacaagtgtgaggccccactctgccaggccttacctctcctaggttcatgttcccaagcctaccaagcctaccaagcctaccaagccagctgggccatcgctcccctctctacagcccaagtgtgaatgcgcatgccattggggagcaggacgtgtgcatggtccttcacctctttgatcccactggcattgtggacctgtgaatggggtgcagggggccagaagaggaagaagcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgcccagcaatcacagcacccctccttcaaaagactgctgttgtactctttgtgcgcccagtgcaagtagctttgacatgatgacattacctccttaacacaaccttgaggaaaggcccagacagtagaagcctggggcccctccctcctgtgtgtctcttccccatattttcaatgttttggaaaaaggtcccatacagaaatcagacagcatcaactcctgctgtatttgattcaatttctcttctcttgtcccttaatgttctgctctggtatttgtaaagaatatggcattgaggccaggtatggtggctcatgcctgtaatccccaaggtgggcagatcacgaggtcaggagatcgagaccatcctggctaacatgctgaaacccgtctctactaaaaatacaaaaaattagccaggcctagtggcacacgcctgtagatccagctactcaggaggctgaggcaggagaatcccttgaacctgggaggcggaggttgtgagccaagatcgtgccactgcactccagcctgggcaacagagcgagactccgtctcaaaaaaaaaaaaaagaatatggcattgagatgtgctctcaggttgaagttctgcacaaaaatgattcaaaaccaaaaaagcattttgcttccaaaatgcaataatttttttatgaattttctgattacatattctttttacaaaaacaaaaattcaaacagcaaagaaaggagagaatataacctgtgactccccctcacctaagttttttctatgcatacatttttttctttacaaaactatatcagaatcataacataaacattcttgtggcagctgcttctctttccccagtcattatactgtaggtatctcggggtctttaccatgtcagtaactataatctacgttattgtgtttaatggctgcctagaattctatgctatgactgtgtcacagttgattgacatttaggcattaccagttttgcttcctatgagcagtggaagagtcacaaagacagtttttagaagtactttcacaccaagcctgggtgataactgtgagctcatgtgtggtactctccaactgaagctccttttatattaataatccattaatgagggtaatcaattcgtgttggcatgagctctatgaaaatacatagcataatatgggctccggccttgcattcatcagaattaggaggatcattagggcgcctgtcaaactcccctcctcgccgcccatcctcatgttccattaggtaactctacagacttagagaaaatacttttctttttctctaacggcagccctcaatgacttttctttctgttttgggctttttctttcatgaacatcacaaacgtagacactccgtttggggcacttttttttttttttttgaaacagtttcattcttgttgcccaggctgcagtgcagtggcaggatctcggctcactgcaacctccccacctcccgggttcaagcgactctcctccctcagtctcccaaatagttgggattacaggcacctgccaccatgcccagctaatttctgtaattttagtagagatggggtttcaccctgttgaccaggctggtctggaactcctgacctcaggtgatccacctgccttggccttccaaaatgctgcgattacaggtgtgagtcaccacactcagcctcggccactttgaatcctgacattagaaaaagcatgaaagccaggtccctttggttttcctttcctgtgtccttcccagctccccactggaagaggagtcctgagaaatccagcctttggttttgctcctggagataccagcaggtggcaaagactcgttaattccccaataaccacagacaattttcccgattttcagcaacctttgaaacaagtgctgtgtgagttgcattcttgtaaaacaccttcatgaagagaggaatcaggtgaaccatagagacttcagacttaatgggtgtgtaaatgaatattaatagttcagctctgtacggagggtctggcgcaaagtcaaatgggatacatgtccaggggatttaaagcaggtcttgctattttgttggaagtaaccaaaattgatggatgccttataataagcataggtgtcgatgtgctaatttacgatgattaatgccgccttgttgattttcatttctcattaggaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaaggtgggattgtcaaagtgaagtttccagatggcgttagtatttctaatagggcctgagagcaactgagtagaaattaaagtcaggatggataagttttgtcttcataatcaatgcttctctaaagcaatttcagaaatgtgtgtttcagcagacaagggagatcctcccaaaggtagaactctggttataagaaggtgtacctatttccccaagagatttccagttattttctgtgttcaaaggctgaaatcccattttacccgttggactggagattttgtcttcatgggaaaacaggttggagttttaggaagaacaacaagtagcccctgtcttcttttccctgacaggggaggagtttagaaccaacagaaaaagaaggcacagaagtcagacagttggagtccaaaatatcagattattacattaattaaaagcaagagtaaggctgggcatggtggctcatgcctgtaatcccagcactttgtgagaccgaggtgggggtggatcacctgaggtcaggagttcgagaccaacctgactaacatggtgaaaccccgtctctactaaaaatacaaaattagctgggcatagtggtacatgcctgtaatcccagctactcaggaggctgaggcaggagaattgcttgaacccgggaagtggaggttgcagtgagctgagatcgtgacattgcactccagcctgggcaacaagagcaaaactccctctcaaaaaaaaaaaaaaaaaacaagattatagggcgtgacactggatatgtggccccaggtgaaaattaaatctgcccttcctgtacagaggtgtgtatctataggcctcctctccccagcatctccaccccaccccaccagggcataggtgacccctgtaagttttctgcatgcagagagcagctatcctgagcacaggctgacccagatgggggcccagagagggagagtctgaacttcttcaatttcttctttcaagtctaccaattagttaagtcatttttcctccacaaaggacaagagatgaaaggaagaaaaaagttggaagggtttttcccagatttttttctcctggatacatagtggacatttcttcctctctaaggaaacatgaggaatgggtactctatgttccccaccccacaaacatcgttgtcaaccagatccatttaattctgggaaacagaatgattggatctggatctcccctgtccctcccagggatgatgtctaggttagccaggatggttagttaacaggagaagtgggacaggagcaggaaagggatgctaagctgggagaatgggactatgtttcctctgggtaccacctgcatgtgagcagccgctgagtcttcagagcaacattcctgggcgatgttgcagcccgtggcctggagccgggtctcaggctgtgtgggtgtagactcatcacagctatggtcacagttggaagtgacctgaggccatctggtccagtggcctgtacactgccattgctgtgaacctccccccacagtctctgcctttctcctgtccatgatgccagccacctcctgaccacccagcagccccccggggataggcgggtaccaggcactgggtgcccccgaagaggtgcaggtgggagagtaggtaggatggaggctgggattcaactggactaaggcagaattatgcctgtgtactcagaagccactggaaagcaaagaggaacgctaatttgttcttccagaatcaaacagcatcacaagttataaacagaggggaaattgttacttcataaatacatggtatttctcgattaacttttttgattaactctgtgattacattataattgtgggccacctaagtacacagtaattatcacaaaaatcgcagggtgattatgggtttatttcagtccagtaaagtaaagcgttcccgagagagccgagacctaggagttacacggcaattaatctgagttgctttttacttgaaataaaatgaagtaatacatgcttttttaagaaaaaaaaaaaaagaaagaaaaagaaaaaacctcttatctatgctgcagatcagaacaataagaatctgtctttgtcacctgcaatttccctcttgcaatttgtgcctcccccagctgaggccagtgatatttgcctcctggatcttgtctcattctagggccattattctgcctttagaaagccagatggtgtaagtgacttataaaacacataattgcagcattttaaagacatttatttctactgattctaaatctaaagcaaactttcaaatttgaacatggaacactggcaagatggtggttacattccatcttataatttgtatatgcagtatcctttttgataagggggcatatcaatggataattcagtttttaataatccaaatcttaatacttcagatgaacagctgcattcttattcttcccttaggccaccatgttcattacacatgtatggcaatctgtaatctagcctaaaacaagttctcttaccatgtgtggaattcctgaggttttcggggggggaattatacacccctatttcacagctctgcagagagcaggcaccatgcaggtaccaatggccttgtgttcacttagcccctagcaacaggagcaaacgctggagcaagtgtcagaagggaaaacagaatacagagcttcttatttccttcctctctttactctttcaggattgaccggaaaaaagacaagacagaaaggaaaattttggatagtcaagaacgagccttttgggatgtccacaggcctgtggtgagaaagcgctactcaattctctagatttttttttcttaattgttcatttttatctctataaagaaaagaccgtctttagccaccaggtgtctcattcttaagaaaatcgctcagctttgtggaactggtttcgccattcatttatataatctcagtaaattttctggaatatatgtaagttccaccttttaaaaattattcattcggccgggcatggcggctcacgcctgtaatcccagcgctttgggaggccgaggtgggtggatcacgaggtcagtcgatcaagaccatcctggctaacacggtgaaaccccgtcgctactaaaaatacaaaaaaattagccgggcgtggtggcaggcacctgtagtcccagcgactcgggaggctgaggcaggagaatggtgtgaacccgggaggcggagcttgcagtgagccgagagcgcaccactgcactccagcctcggcaacagagcgagactccatctctggggaaaaaaaaaattattcattcctgaaaatatggaattgcaaatggagaagctatgggaattccaccaaaagacctttgtgtcccgaaggtttacattccccaaattaacaatttccatttccactgctattcaactctgaatcttcaactattctctgtcgaatacggttaattcttgttatccatggcagttatgttctataaagtctttgcaaacactgaattagcgcacattgaagcatcactcccgtgggaactaccaagctaggtccccgtgagcctgtggccacaacatttttatcagctgatcgatacataaccttttaaatgtgtttctgtataaagacagcttatgtaatatatatcattgattcattaacattaaactcatggccaacagcactgttgctcatgcctgcatgtttatttcctcctaaggcacatcagagaatggtgaacagcacttcagcactgtccttggggccattttaaacagcaaaatcaccaacaaaaagtacagaaatgcagaaaagttggcactaaattagccctaaatagaagggtctgaaacaaaaaggcaggacgtcaccttgttcaatttcagtgggaaacacacatatcaggctactcaaggtacaactactgagtaaggagttataaatgaaatttagcaagcaggcaaattcacaaatgcaaaatttgtaaataatgaggtttgactgtatttctgatttcacgttattaaaacaaatcttgcattttcctcatgaaatggaactaaaaaataaattattggtcttcttaaaatttgattaaaagcaaaaaataaataaatagctactcatcctgatatcgtggagtctttttcaaacggttaagtatgtaaaaaaaaattttaaggactgtgtctgaggcaatcttgccacttaaatagctaatttgctcttagaaactgtacactataccctctacatatcatccttagattatgaggtaagcttttctagatcgtatgggaactccacagaggaatgcatattatggcaaaatggaaaaaaaaatcatgcattgtctgtaatggaaaaagataaagattggtcctgatggtgtgacatgggctaaattggaagtgtaattttcacgtagtaatttatatgatgtgttttttttttctcagccaggctgtgtgaacacaacagaaatggatatccgaaaatgtcgacgtttgaagaatccacaaaaggttaaaaaggttcgctagtttagctgagttaaaaattcctgatgtgaatagcccttccagttctagtactattcaaatagtaatttgctacttgtaattctaccaccttttgtcatttgaaaccataaccatttcacaaatattgattgagcagctgatgcatgcttggcgctgtgctcgtgctaggatacagtggcaggtcctcatggagcccacagcctggcaggagtaaaacaagccaacaggcaacagggccatgaatgctgtgttaggagaggtacaggacagttgaggagcccaggaggggcagctaagccagacctggagtgggtgggggtggggggcttcccaagggcttcctgaaagagggtcaggtgttctgaagggtaagttgcagttgtcctggggaggtggcagggaggggaggaaacaaaaggagcaagaagtggcaaagctcacaggtgaaagcaagctttatacttagaagcaaataaaagtcttttttatggtttttttttttttttttttttttggatagagctggatcacccaaactcaaaccaccatcttgtccaactgtgaatgacccagtggtcacttgtgtttcactttactcaaaggagtagtggtcacagcatacccgagggtgccatgctcagactcccccacgattcatatgtcccaccctctccacagcaccagggacaatattgcaggacagcatgaccagactccgtaatattaatttccaaagagtgggccaggtacggtggctcacacttgtaatcccaacacttgggaggccgaggtgggcggatcacctgaggtcgggagttcaagaccagcttgaccaacatggagaaaccccgtctctactaaaaatacacaattagctgggcacagtggtgcatacctgtaatcccagcttcttgggaggctgaggcaggagaatcgcttgaacccaggaggcagaggttgcagtgagcagagatcgcgccattgtactccagcctgggcaacaagagcgagactccatctcaaaaaaaaattccaaagagtggagatgtgtccccaaacattcctatttcttgtgatgaccaattagctctctctcatgtatgcattaaaaaaaaatacacgcacacacacacacacacacacactagacatggcgtatgtatataaacttctttaatctacttacatattttgttcgtcactgacttaacaatatccactgtattatattttaaaatgttagtcctaaaatgtcctcatttcatcttcaagagccccataattctaacattacagaatttcatggagtcacatccaccttatctgagcccttctgcattttgatgattttgactacacattgcatgcccttcagtgtttcatttctttcccattgcaaagattgtgtttagtctttccgtaatacgaggaacagctttaaatgtagctatagctacggacatgtggaaaaacttaggccagaaaactgtttaacttgaaagggaaaccctgaaatgctgccatcccagttttgtaccagatgggaatctgctgaccaacggaaatgtagaggggatcttttgtgcatactctttggcagtggctcttgaactttctttattcagaatcatttggggcatttgataaaagtgcagatttccaaacccacccacaaagattctgatgcagtaagtccagggggcgaggggatactcagcaacgtgtcttttccaagcacacccaggtgattctttgcaggtggtctatggaccatatttggagaaacactgagatacaaggaggctattttcagcccaataaaagataggatttgggttatagtggtaccccaaagatgagatgacatgccttaagaggcagcattctcatcattgaagaaataaaagcagagaccaatctcttattgtcatgaggggattcacgaaattggatgagtcattggactagctgacccctaagccaccctccaattctgtgggtggatgatcctctgtgcttgcttcttctcctagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgccatttcagcattacttggttgaatgttattttctttcatgatgagcagcccaggtcaacagacaatggctaattatattacttccttctgatatttactggtaacaaagcaacctactgtttatattatgccttgctggttcctagagggcaaaacccaaaggagtaaactttgaggtgcttgcccttgacaagtttattatctgatgggtaagaggtaatggatatatgaaaaaaaaaagctatttggcggggctcggggctcggtggcccacacctgtaatcccagcactttgtgaggctgaggcaggtggatcatctgaggtaaggagtttgagaccaggctgaccaatatgatgaaaccccatctctactaaaaatagaaaaaagttagccgggcttggtggcgtgtgactataatcccagctactcgggaggctgagacagcagaatcacttgaatctgagaggtggaggttgcagtgagctgagatcatgccgctgcactccagcctaggcaacagaatgagactctgtctcaaaaaaaaaaaagaaaaaaagaaaaaaaaaccacacagaaaaaaagctatttgatgattccagtcaagcatgccaaggacatgggtgtgacgtgcctgtgaaaggtgggcagaggaggggtcactggggattgttcaaaacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagaggcacaagtaatttgctggagggcagagctgagggagttggagatgtctggccagaggaggtatttggatcttggtggaaatgcaggatttgggtttgtggagcgaggggaaaaaaataattttagtttggtcttaacatctgtgttctctattttcccagataacatttttgaacgcacagatcgacagacattgtttgaaaatgtccaaagtggctgaaaggtatgttttcctttaataatattactactttcttctaatttaacagggaagaaatgttacagggttatggttaacgaatgtgttcaatgccaagagttagactgtagttattccttagactggggtgcagaaaaacccacaggctccatgtgagtataactaagataacagacctcccttgagtgatgtcaagaaatgttccgttgctaaggctttacagggggtggccacgggaccttgtcaatcaaggaagaatgtcctttaaagctacataatgcacctttgccttcagcctctggattaattcaaatggaaattgctcccctttcagctataaaatgcccagattcactttataggggaaaagaaattatgtgtgtcctttgaggtgctggctgcatagacaggaggggactggatcatcgggaagtgttccgcctccacacgccatcaaccactgaactgcatcgaatcagctgtaaagaaaatatttggcccctccagcctggcttccacagcggtgtgtgtgcttcattctgcaccagtagctagttccactccgttaactcatgggagactcaattttatcaactaaatggtctgtttttttaactcttccgtgaagatgggagaccacatggggaatctatatggaataaatctaaccaggcagctcagtagtgaacatttattcatccatatgctaccgttaaagcaatgaccaattgcttaaggaatcaagagcttaagttgggtcttggtatttattggatgtcagataaactgagtcttttaagcccagctcctacagggggctggctgtgagagccatctataagcctgtaagcctttctctgctggctcctgggttgattcacatcttttttctagataaattacaacaaatggaaggtataaaaactccaaccccaaacaaagagtctgattgaataccctaccttcaggggctaaggacatccctggacttgggctcacgtctttattccagggtttctcgattgtggcactagtgacattctgagccagataattccttgttgtgttcttaatgtcctatgaattataggatagttagcagcattcctgacctctccccattagaggccagtagtcccccaccaccacagctgtgagaaccaaaaatgtctccagacattgccaaatgtcccctgggtggggtgaaagtcactcccattgagaatgactgacactcctgctttttctatgcaaatgtgctggaaagttgccctggctggagctcagcttacactgaggtactgatcactctggagtcgctgtttcagctagctgtgtaggctgcagaatcacctcatacctcctctctcatcatgtgtggcttctggccagagtaccaggctctgaaaatgctttttaggtctcactgtggttcctttgccccagaaaggtggctgtgagtgaaacagcagcatggcctcaactctcttggtgtcatccatggcctgtgaggaaccacgagcttctttctctgtgaactagggacagaaatggctgtcctagtatactttgagggtcggtgtgctagcaatgctcatgtctggccttggaaggtggaagagctctttagggtttgcaatttagaaagagcgtatatatgggagcatctgtttctttggatctatttgctcaggtccagtggttctaagtaccgtaatccaggtgagggagggggttaaaaaatggaaattcccaagcctcagccctagggattcagattcagtggttccagggttgagccaagaaatccacattctggataatcttcaagtggactgatctggtctttcaggatccggtgaagccattgcctgctactcaggctgacctgagagctcacatccaatttgttatatctttgggatgcagagaaagagcctgaacctgtcagcatgagggaggcagactccagggcaggtgtgcagagagtccaaggaatggaggaaaccaaggtggaggcggggagcccggcccatcctattgtttgtttgtttccttgctgtcagggaggggccccacctggtaccacctaattatgcttgagaggctgctcatattgaaggattattccaactggctactcctcggtgcccagctagaagctttcatgagtctctgcccggcagaggctggattttattcccagcagcaataactggcaacttttcaatgcgacacgagggtttttcattagagccacaaggaaacccccagataaggaggaggagggaaaggagacgcgtgttagctggagataaagcagctgggagccgggcctgtcagtggctctgtgaagatggggccagggaggaggtgctggcagctggtgagaagctgccagagatgcaggctgagctctctcaggtgggcacgcacatccacatccacatccccatcctgatctggcttccctgggcctgctccaggtgataagtggcaattccatatcccccaggaaaccgcatcccccaggaaaggtcttcatcatttttcacccagttctgtgagaactaatagtgaggagaggcaggagggctggggacagcgaggctgggctctgggatgtctacagtcagggttggactaaagggtgcatccagaccagcagggagggaaaaagggaactttgcaaactaaaggggcagaacagacagtttaggggatgggtctgaaaccgaccatcgaggtttgaaacctacccctgccatttcctgttttctaactgatgaagccagtggcttcttctctcggtgcctgtttttacctctttagaggggagatagtagttgtatttaaattataggattaatgagttcatgcatggcaaaagtatggtccagtccttgggactcagtctgcacactgggaatgtgaataataattattttccagcatgacacttaacttgtgctttggaagagagcagaattcaaggccatgagacagaatgaactggatatatggtgcttaaaggagcaaacaaagggcaggccaaggagggaggctgctaatgcaattctttcctgcaccctctgtctccccccagtctcccacacagagatctctgcaggctgcccaaggctgaccttgcactgcatgtctccttccactgcctcacacgccatcactaatctggggctttgcgggagaaaagacttgctcttctgcacagaatttctcagatcatcccagttccaaatattctgtccattgtcttcctgagtgcttaagtgtccccaaaatgccagcatcgtggcaaccaaactgcatttcctaggctgccttttgcacctggaagcaacacaaaaggctttctgagctgttacccaatttttgttgcagaatgtattgtctctgcacacacacacatgagtgtctcagataaatgacacttaacaccctaagctttttattttaactttttttttttttttttttttgagacggagtcttgctttgttgcccaggctggagtgcagtggtgcaatctcggctcactgcaagctccgcctcccgggttcacaccattctcctgcctcagcctcctcagtagctgggattacaggcacctgccaccaagcctggctaatttttttgtattttttagtagagacatggtttcaccatgttagtcaggatggtctcgatctcctgacgtcgtgatccgcccgcctcggcctcccaaagtgctgggattacaggcatgagccaccgctcccggcctattttaactattttttaatggcagtgtttcttaaatatggttcatccactttacttcctaataaaaggacactacatttcagttaattttgctagatgactcaagagtcagtagtcttctattatgctttaaaactgtcagtggtcaggatcttataaggtgccctgcttccccttccctaaatggccccagataataatattctttgaattcctgtttctgccttttagttgtctgtctgtctgctttctctactaacccttccccccaacacccaacccctgctttccaatctgtagcataccatgtgtatcagttagctgtcactgagtaacaaaacaccccaaaactcagtggcttaaaaaataggcttttactattgctcacatgtctatgtgccacctggctccactggtctcagccatgtttctctatgtggctatgggttggcgaggcagctctgctgatcttggctgggctctctcacatgtttggcttctgctggtttaggatggcctcagctgggacagttgagcactccttaatatggtctctcaccctccagcagactagtttgaccttttccacatggggatagtgggattccaagagagagaacagaagcatgcaaaactcttgcagattagaactggcattctgtcgcttctgttaccttttattggctaaaacaagtcactaagctggactagattcaagggcagaagaaatagactccttttttgaaactgaactaccacaccaggaaatcaaataaccaaattgattagctttgatcctaaagcaagtgtgaaaagtcttttttgtgaggtgtgttgttcccgataacaatgaaccttgaggcatggtgtttatttcatctgtagactatgcagaggctcttatgctcacttatctcatttgtgttctctggatacttgaagttgccagataaacaaggtcctactcttctctgcaagcgtccccaagggagtccctttttttattcatctaagccttatagcacttgacaaaccaactttgagaagcaacactccatgcattttagtcccaaactgtctagtctccatgtttggctgcgattccccagagacttctcccgacccatagcgagcttacaccacaatcactgcagctatcccagtgcactgctgcacacagagggatcaaaatgtttcattccgtacctgcatctgtacttggctcatcctcaccctattactgggagccattcgtgtgtcacagctgactgctgaattgattttttttagcatcatctcacttgcctgtatctgagattgccgctgctccctgaaattggatgctggttcttcctccacctcctgaccctcagtgatcatgaaatgtaattaatgaaatgagataagacagcaagggactggatacccctaagggtctattaaaaacctgctagggtgatagaggtttgggaacttaatgtctaattatagtttcaggggaggaaaaaagagggtcacagaagtcattacaactttgcttttatgggatttcagaaaccatggggtctttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccaattccaggtcttctcatgtagaggctctgatttcataatgaatgctttagtgcatttgtactgtatttctaaagtaggactaatggtcgtatcccataatgctttagattccaggcctcgtttttgttggattttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgcttaactcaggatggacagcatttcttcttcctccaacttgtcatagttttgtgtggtttttttttggtggggggcggtcacatctatacaatttgtagcaaaattataagtcttttgttaagagagaaaggataaaatctacaacttttatttttgtcatattttctcaagtggttggactgtatgtttactaaattctctttcattatttccttcccctccatgtttatcaaaggtagaccctaattagcaatctaaattgggaaggttttgcattaataactgtcctcctaccaggattggttactattgttagaagctgtgactttgctgttagctcagctctaacaactctctgagatccagagagctgtttgctatttaatggcatagtaggctctgaataatggctactaaatgactgaccacagagtgtacccctggtagccatctggtagattttttttttttttttttttttgccattactaaaggttcatggggcaggagtatgtgaacaaatagccagttccacatttccactcaagacccagttcaaagcccacgacaatggtgggtagcacatttgctaaaggttcacagatcagcatcttctagtgatgtgagaatttgtcatttgaaaataacaaaagcatataccaatcaggagtcagggataaagggacaagaatgctaaaattgctcattgagaaatattgttcctaatggacttctgaatttcctatatttattttatttcttccatctcatcccaattctgcttttctgccactcacacccagcggttggaggaccattgctgctgtgtactgttatatgctggacatcctacaaagctctttacatacctctattttcttctccctttttgcttctcctctcctacctctagtctttctgtggtcattggtattgactttggactgaaatggtactgtgcgttggccattgctgcctccttcattggcctgcctggccttctcattgtcttgtgtgtcccaagcagactctgttcatcttgtaatctgtacactaccaggaagcacatgttctgaaagagacaacctctctggctagttctacaaagggctgccttgatgaacttgccttcacactcccatcaccttcattcccttttcaactgtattggtttgattccaagcaataaaaccccagcttgaacctggttctgcaaaatagaagcatgccttggctcccagaatacaagaaggggctgtggaattgaaccctgggaaaggcagcaatgctactgagctcaggaaaagctggagccagggccttcagtgcctccaagacccattcttcctctctggtcctgcccactttccatgctgaccttattctctttcatgacagacatgtgttaggaaacatgacaccaccagcccttgaactttgtgactatacaactttgatatggtttggctgtatccccacccaaatctcatcttgaattgtagttcccataatccccacacgtgatgggagggacccagtgggaggtaattgaatcatgctggtgttttcccccatgctatgctcatgatagtaagttctcatgagacctgatggctttataaagggcttccccccttcattcagttctcattctccttcctgtcaccatgtgaagaaggacatgtttgcttccccttcccccatgattgtaagtttcctaggcctccccagccatgctgaaccatgagtcaattaaacctctttcctttataaattagccagtcttgggtatttcctcatagcagcaggagaatggactaatacaagcttctactgctgaagctggggaaagaagatatgaacctcacttgcgtcaggtatctgttcctggacaaatcaaccatggccaggagcagggcttataaataaatacatggcagctcctgaagtagccttgtgtacatgtcagagtacaattctcaggagacaagcagaagtgagcagaaacccatagaggccctctatgcctgctcacccattttggagtactcaccatccagaatccctatctgcttcactcagattcccaagagacccagcataagggtcaacccttgtacattcactgtattcctaggcagcacttctatctccatttggatctcctttcatgcctaagaaatggtgctggacagcctaggcacaaacccaaaagccttttaactctctgcattaagcttagatcttatcctatgtggccaaccttcatttctttcctgtgtcccaccttggaagctctagctaccaggcataaggcacctccagcccagactaaagagacaggagagcaaggaaagggtaaggagtccttgctttcatttcttgtgctgtttctgcacagtctgatgatgttgagaagcataagggaagaggagatcgccttccctctctgcccagcgtggggtgttctttcacctcctctcagtctttggctaccccagctgtgaagttaaccctctctgctactctctctgggaaggatcaccctcccctcccaccaagaagctgggagagcagttgaggcagcagactgctaaatgcccaggtcacccatgggaaactccaagatgcactttgctgtctcctgtcttttccatgcaatgatgatggcaaataggacaaatgagggtgcatagattcatgaacactgggtttatttgcgtgggttgtgatagtggcagcaaaataaaacatggcggtgccattatgcaccttttatctactgccacactctcctccaggtgactttattttctacatagataaatatagtaagaaatacataataatacatttattttttcacataaattgcagtcaaactacacctgtggtaggcagaataatgatctctcaaagatgtccatgttctaatccccagaacctgtgaataggttatgttacatggcaaggagaattcaggttgcaggtggacttaaggttgctaatcagttcaccttaaaatagagagattatcctggattgcccagatgggcccagcataatcacaggttcccggaaatgtggaagagagaggcagaagagtcggtgtcagagtgatgcagcatgagaaaaccatagctggctttgcagatggaagggggccacgagccaaggaatgcagggagcctctagaagctggaaaaaggcaagcaaatgaattcttccctagagcctccagaaggaacatcgccctgctgacaccttgattttagctcagtgagacccatttcagacttctgactcttagaattataagacaatacatttgtattgttttcagctgctaaatatgagataatctgttccagcagcccttagaaacaaatataaaaccccagtctctccccttctcatagaatctgaaggccaaattgttcatcctctttgtctttaatataccagcatctccgagcaccccgctgactaggagtgcctcttatagccccaatacgtgtatgtctcattctgatgattcaatacttccttttcccatcaataaaatacaacattcaaaatatgtatgcccatctaattttactgtttcctttacaaagcctctgactttatttatgtaacttaacaaaatagatttccctcttctaatacaataaatttcccttccgaccagtaccactcatctctgacactggccagcagattagttgctcgtaatgactttggctttgttgcctggttcaggttgtcaggactttctgtgttccttctccacgtgttcctctatagcatgtcttgacgcctcttgcctagaccttttttagagaaggcatgacatggcacaagctcccaggaacaatttcattcatgcttaatgcctgttgcaaagtcatattttttgctcttatgttgggtggtcacaaaaatctcaccttgggctctcaaccacattctcctaaaccaacatcaccatgagctctcaccacctctcttccacccacttctctaatgatattccaggatttttcttaaagagatctggctatgagcctgtatttcattacagcttaaataatcatattatttcccatttccttagttgctctctggacttttaagattctactgccttaggctggtcagcggacagctgccttcattgccatgcatatagtaataggcagctggagcctgcaggctcctcttgggaccaggtgctggctgaactctcaccacagcctctcctgagccttccctattgtcccctcagcccagcactcactcagggctccatatggggacttgtccacaggacctgacctggctggttggaccccacttcccaggttggagatgtgaccacatcgaggatctgctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccaccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtgaaacctgtgaatgtgacctcctttgggaagagtctttgcagatgtaattcagttaaggatatctacataaatcattatggattatccagagactccaaatccaatgacaagtgtcctcataagacaaaaaagagagcggatgacacaggcacagaagaaagccatgtgaagacaaagacagagatgaaagtgatgcagccacaagccaaggcatgcctggagccaccagaaactggaaggaaaagaaaggaaaggaaaggagaggcaaggcgaggtgagacgaggcgaggcgaggtgaaattatcccctagagccttcggagggaggatggccctgccaacaccttgatatcagacttctagcctccaaaaccgagtataaacttctgttgttttaaccatttgtggtcatttgttattgcagccctagaaaactaacatattcctcaacatgcaatgccatttcttttataaagaattcaatcagcccaagtagctaagaagtggcttccaggtgcagcaccaacttgtagcctggtccttcctgccatagtgctttcttacagctcccttgcccaggttcattctgcctgagatgtcgtaaagctcttgatatggtttgcctgtgtccccacccagatctcgtcttgaattcccatgtgttgtgagagggacccagtgagaggtaattgaatcatggggcaggtcattcctgtgctgttcccatgatagtgaataagtctcatgagatctgatggctttaaaaatgggagtttccctgcacaagctcgctctctttgcctgctgccatccatgtaagacatgacttgctcctccttgcctcccaccatgattgtgaggcctccccagctacatggaactgtaagtccattaaacctctttctcttataaattgcccagtctcaggtatgtctttatcagcagcatgaaaacaaactaatacagctcttattggtgaagcctggccccagggaagatgcataccttgcaggagatttataggacagaggatgtgcctctagtgtgcccgtggtttcgcttgtctattttatatttgtagaggattgtcaagattctttggagatgctttcccattttctatcacaatggtcctgagtgctcaacaagcctgttatataacatgatgaacttgacaaagatcagttaaatgactcaaccaagaattcaaactaaggcttttcaactgggaccactgctgcttctaccccaggggtcatgataaacacctgggacagcgaggaggctctgaggtgtccgaaaatttacatccatcttcaaaaccaaaattaccaggggctctttcattttgatttgatgaataaaacatcttgtgtcctgaatgtttcagaaaattgaggaatgagatatggttctctcaaacttggatgtgcatatgaatcacctgggggatcctattaaaaagcagaatctgactcaggaggcctgggctgggacctgagatcctgcattgctaacaggctcccaggtgatgccagtgcagctggtttatggatcacacttccagtagcatgagatggcacctctgactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttacaatttttatacatttctgtatgcctgaaatatttcaaaatttaataaaaaagaaagtgcatagggacagagtaaagaacattctaacctacatgttgggggcagaagtgatgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagatctcagacacatcagatctcataagaggccacctgaaaataagagaattaatggaagctctacgcactgaactgtggggcctgtagggatggaaagtgtgatacctttcctcatctaccataaggattacggccaacactgctataacaaaagaggttaacaagagaaaagcataaatgcatttatttcatcagtttcacatgacacagaagccttcagaaatgaagactcaaagacccagggaaaactgtatttgtgcttaggttccatgaagaatgggaagccttgtagaaatgtgattggacaaaagggtgtgatctactggtaacagactgaggggaggaaacccagcaaggcctgtctgttcagattcttcttagtgtctctgagtagcattcctacctcccaggtaggacctctctggaatgagggttttcaagggagaagggagcgagtgacctttctaggttttgtggcttgctttgcaggagaggcattctagtttctatgacccactttggcgaaaaagaattcttgtttctatgacttacgtcgggggagaaaaagggatgggagacgggggcaggagagaaggtgaaagccttggcttctgaggcccttccattctcctttagttcaaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgccacagcagtagagctgagtagtggcaacagacaccatctggcccacaaagcctaaaatatttactatctaggccctgcagaaaaagcttgccaatgcctgccctagggaaaaatagacgccccagaggaaagactccagatccctcatttggagctcccattaaaatactggtaaacttccctatgacaatgaagcccatcagtgacaagccccatccacacgcccactgagccgccaagcaggtttcagtacctcagtcttaagtacaaatggatgtccaaagattttccagacactccaggaaggctcagcgtgaaagagtataatcaaaataaaccgacagaaaaaaggaacttggaagaaccaaaataattcaacaactggaagaaacttacaataaaagtatagaactcatattatctgagaaatgagaaggtatttcatccataaaacaagaactagacactatgataaccaaaagtgaactctgaaacttagaaagtaatggctcaaaattaaaaaataaataaatagttaaaagagagtttaacaaaaagacaaggagatgaaaaatgggagggaaaataaacaattcaggatgtccaatattgaactggaaaaaaaaatataggacaagcaaacaaaggaaacaaagggtttaaaattagtgatgaatactataaaattcctgataattattttcttatctatcacacactgtgcccagcatagtaaataacaacaaccagcaagggccatcatgaaattgcagaacactctagcaataaagagatgattctaagttgacagagagaaaagaaactgaaccaaagaacgagaatcaaaatggatccaggcttctcaatagtaacactgcataccagaaaaaaaaaaacatggagtgatgcctacaaatttctaaaggaaagagatttttcacctagtgttctatgtctagcactatcagtcaagtatggagataaaagcatttttagacttgcaaggattctcatgcatcctttattacgaaactactaaaggatgtgcttcaacacaatcagggagtaaaagcaagagatagacatggaatccaggaaacatgggcttttcaacacagaagtgaaggaagtcccaaaaagatcattttccatcaagtctatagagcaaatgatccagtttcgagcaagaagactaaagacttcaggaaagaggatctctgggaaacaagaggacagaactgctcaattatttgatgtgtttaaggtataaaaaaatgattgctagatgttttacaggtttgttaaaacacttgcttggaaaaagtagtatgatatttagctgaacagcaaacaatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaagtagatgcctctctgagaagggatgggaggaaaaaataattgcttttgcttttttagtatatataatcatttggtactattttattattctaactattcacatacattttgataagaataaaaattagtctaaaataaattatatcaatctataagatcaacatatctattagatcataattataactagaaaagttgcttttttggaaaaaaatgcaaatgtttactccttgtggtctgctgatatttaaaagtctttatcataagaaagtccttccgttgggaatgctgagctggcagtctggtggagctgtagtgtcttttgtgtgttccagatgcctcgagaatcagtctttgtgggagggtggaacacaaacagttttgaccagtgtattagtatcagtaaggctagcataaccagggagagatgcaccaaggttcaggtaaagaatcaagtgaggaaaagatatataaaatgcatgtatatatcatggctgcaacagtgcaaaaatggtatgttcgttataagaaggaaataaggacaaatgaaaacagtttgatgtgtcagaagtgggagcggaaataaattttttcctttaatttagaattatgtgaagactgctataatgtttgtgtaaaacagaataaaggggttttctaaggaaatcagtggcattctttgctctgcctccctcctgcagtttaattgcctacacggaacaatatgtggaatatgaccctttgataacaccagctgagccatccaacccttggatcagcgatgacgttgctttgtgggacatagagatgaggtaaaaaatgttttaaggtttgggagtgggatgaatgtagacaaaaatccatgagatcatgagattaccttatattctatcttaatttgacattttttatcgctagaacagaaacccctcaagtagcctcccagctgagttctacttacagtttctacctccttatagctttgatttgtgcatggatcctttgtggctcccctctgaccctttggataccatgataactgagacagtccctcaccattccctagttctgattgctggaagaaaagaatctgttgttccaattttttttcctgttagacagcaacaataatgataatagctggcacgtattctgcattggccacatcctgcagtaagtgtctctcactgaatcccctcgacaggtaaacattactattctcaccactcagcagttatggaaactgaggcacagaggagttaatgaacttgcccaaggtcatactgctagtacagcagagttaggactagaactcaggcagagggctccagaaccatgatttcatcactctgttcttctggagtaactgccagcaacgattccagccagtttctccttccctgtgagggaagccactgtgtttacttaagaggggaggaaccaaagcccagagggacttggaccactttcagaattacagaaggaaacacacagacaaagctagtgtggtgtgccttcacaccccctgcaccttggctggatgaatttttatttcccttttcatgtctctgtcactcacattgtctttcacttttgccccttttctggctgcttttcctgaaatggaaaaaatcttataaaaataataaaagtcgcagatgctcattctaaaaagttcaaattatccagatgtgcataaagaagaaaatgctctcttcctccaacccgatttcaccttccagaaagaacctttgtttatagtctaatgctgtggttcccagagtggatcagagcaccctgagcactgtggggaactcacagagttaccactggatagtccaaattttttatggaaacacagcgatggttgacacatggcagatactgcataaactactagcttaagatggttcagtttcaacattagagcacgttacatcccttatgatgatacgcatctttgcaaatctggcttttcggagcagtcactatgataaaaagcaagaactgcacaaaaattaacatggaataagaaatagggacggtaagttccaacctaattccaaaatttaagaaaatgcgtagtgcccaataggtgcatattgtagttatttaagaatgaaaacaaaattttcaatttatgtgtctttcaaacagctactaagttgttaggatacaaatacatattaagttgattggtcctagccataataaatgacactgttaagtatttcttttggcccaggggcactgtgaaaaacttactgagacgctaagggtaccatgagctcagcaaatttgggaacatctgatttagtgtctattactttggatttttatgcacatataacattctatccttttgtataattgggttcaatatatatacccaaatatgtacatatatatatatagtccaataatttttaaattaacaataggtcgtggcagtctttccatgtaaacacatatagatccaccttactctttttaatagctacatactatcccctggcaccggtgaagtaagatttattttaccagtacctggatcataaatatttagcttatgtcctccttttttgccaccataaacaatgattccgggaacatctttctacacaagttcaattatttcatcagtatatattttccaggagtagaattcgtagaaatggtatgcatattttaattttagttcgtaggtccagattcctcttgagcaaaactgtaacacatctttttcattcccttagcttaaaagtgcccatttccccacattcttaccatcccaagcatcatcaatcattttgtctttgcaaatccaaaaggttaaaataattctcattttactgttttgtttccttgttaatatacttgagaatcttttcacatgtttattagacagattctagcaatatgttttgctttggatatttggatataaaacagtcacatttacttgaatcatatattttatctttttcctgatatatttctgaatctcattctttgttcttgtttctttttctcttccctgacttttactttattaatgttatattaactttgtaaaaaccctagtttctattctagttgtattaacttttaaatgttttaattaaaaacatcatcgatttaaacaaacaagagtgaagtatataaaatagtgaagttacctttgcctcccttaaatcccattcttcccagaggtatgttaacttgatatattttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattctatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttttcttagtagcctgctctgttctattggtgtttatcatgttactccccctggagatgtgatatagatttttttcatagtttatattttttccatattttcatatctcctctctatttctgccgcttagttttattcggggttattcattagagaatcatcatttctgctcattgtttcattcattcctctggtcactgctcagagcagatcattctttttgtatgcccagctatttggaagactgctcatttttataaatgaaggtcttagctttcaatcctgccatacattagaaccacctggaagtttctaaaaaatactaatgcctggtcctcacacacagccaattaattcagaatttctcacaattgaacattgttttttaatctccccacatttttttttaaatctccctttttaaatcagggagatttaaaaagtctaatgtgcagccatggcctaggactctatcagtagctggtgagggtgctctcagtgatggtatgggccaatggttctaagccatgctgtgcatcagaatcacctgggctcctctttaaaaatacacgcatactggggtggctctgggcgtctgcatcttgagcaagcaccccaggcgttctgaggcacacgacagtttaagaagtcctggtttggttcacggagttccccggcaggctttcccctgagcagttcacacaggagcagggctgcacctgaatgtatgaatggatgggcatagatcaattgccaaggttcccctctgggtcccgggtatgtggtccaagaacagattaaaagattgggccctctcttacagtgagacaggtggcaatgggagtcttggggaggtagacccccacccttcctagtgtgacatccctgcagccaagtgttctactctgtgggtcaagccctgatggagtttctgatgtctttctatttcctcgccaaggtactccccaacaagtcgactcttctccctccactaatgggtcttaggggaacccacttggatctgcgaaagccaatgagaggtggggagaaagctaatgtgtctttaaaatctccctggttcccaagatgttttttctctgtgtgtgtgctgtgctggcaggaacacaatcctctggccttactgtccatatgagaagctggccgggaaacatcccccttaacttagcaaacccttttggccatgtggaacctgatccatgttcctgagttgcttccatatgccccttgtctgatgccacccactgcctccacttccaatcctgctgctcagagctcggggtttcccaaggcttctgttggggacactcagctattttcttctctgatgcctccactggaatcgtaggctgctgtcgatcagatatgtcacaagttcagtctatgtgcttcgtgccttcctgaaatttctcaaagctctcatctgctgataggaaatttctttgcctctacatactgtgtttagtttttttggggtttttttgttgtttgtttgttgttttttttttacttaactgagctctgggcttttgcctgttccctcctcgttggccacttgtcccccagatcctcacatggctggcttcacttctcattcaagtctcactcagcactggtgtcccttcctcagaagggctttctgtgaccaccaatctagagtggccacctcatccctccagctgttctatatcacatcctcctcctggttccctttctaaatagaatgatttcagcgcctaggcctatctggcatacagcgggcaccgtgtgggctggagggaggatggatgaacaagtcattctttatttgatcgtttcattggtatttgggaaaggaggagaggcaaatgtgtgaacctaattcacaatgataaaatgaacttcctcttttgttcttgaaagtcagcaaagaagtatgtaatcatgtaggaaaatggggtcgcatggcctattggtttattccaacctattcagcactttttccccaaggaggtgctacctgccccctactactcatgccctggttctactcctgttgttctagcttcgactctgaacttcatgcctaatctaggatagctacagtgttctgtccacttacaggcagaatcaagtgttcagatacaagtgaaaacgaagccctgtttcttctcccaacagactactcctacccacttagttgctggcagtgatgttaggaaaaaacagggtggaatcagtgtcaacatcacactccagccaagggatggtttctgtccacaaaacgaaggctgaagatgaccaataaaataattgagtcactttctctcggtttcagtttaattcaatacatttgtatagtagtcaactatgtgctgtgttctgaacaagaagggctctcaagataacaaatgtagcaaggtaaataaaacatgctatcttaccatctggcaccagaactcctccttgcttggcaaaggacattaagccacttggggcagaaggtaaggccctaagggcagaagggttggcagagactgaaacaacaaagggagagggttgtgctgtcctgctgagaaaacgagacaaatgtattctctgttcctgagaggggagaactaagggcaggggaaagcaggggagggagagaagccagaggccaacaaaaactaagtctctgtgcaaggccagggaaatgcctagcattgaggtgaccagggacttttcaaaagcaggaatgtctagtatgtgcttttttaaatagtaggctgccaggaggtgcgatatgtacccatttttcaagaccctcaaattcctgtaaggcccccaccctcccaaacgcttcatgagaggaggggtttggtgggtgtgggtgaaggtttgtgggaaaggagagacagtgagaatgcaggactcccttaggaattcctgccaatctcaggtgggctttggacttcactgggctgggtgaaggggtccaggcaggctcgttatgatttccagggcccaggatgtcaccgacaatgtctaaattctgcaaggtggagaatatactgagtctgccgtggggaggttacagacagccaaatggaggatggccatagcagctgaatagaatcacggataagatgacataggatatacaataaatagcagaaaattgtgctttaattctttctccttctcagacaagctattcgatctggaagtccaaggataagaaagttatattcagaggggaaaaaaaggcaactgttttaaaggatgggcaaactacacctcaagtttatgcaacatagtgagctgtgatcgcaccactccactcccgcctgggtgacagaacaagacccctaaagaaaaagagtaaattctgagaagtaaagtttaattaaagaaaatagtgattgccagggcttctcattgaggagaagtcagtcaaaagttgccagatgacgtaattctttatgtcatctgaaaaccaccaggagagtgtcccagggatacgtatgtaaagtatttctggtggtgccactaactagatgctggagtctaatgaaacctggtgttgtcagcagaatgtggtttgtgatttgctctctccgcatgacttcagtttagctctccctctctgctgggtatcaggcacatgagcaaagagctacaaggaacctggcttgtccagcttggccgtaggcattcactcccagccaacctgacctgctgagaggcagagatcatccctgagctgcccatgcacagcgagtttgacagaactattaatccggaatattagtcaagctcctttcttatggtggtggatctccaaatatggccccattggtgccttccctctttacatcaagtaggacaccaagaccaaggccagatgaaaagagagggagcacctttttccctctctcaaactatttgagaaccagtaatccagaacccctgtggtggcttccaccttggtcatttgaaatatttgctcttgagacattccttcttggaatccatctgccatgcttggagaagcccaagccgttggagaggccatgtgcagacagtctggtcagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccctcaggttgttcttgaggtattaaataaaattatgattgtttctttagtagccttggctctgagatggggacattggattattttctttttaaggaattgccttatttcgtaatttttctaataacttgtcttagtctgttcaggctgctacagcaaaaatgccatatactatgtggcttaaaaacaatataaaaatttttttcacagttctggaggctgggaagttcaaggtcgagatgccacagattgggtgtctggtgagggcctccttcctggttcataaatgtctgggtcctcacatggcagaaaggcaagagagctctggggtgtccttttataaggacactaatcccactccacgtgacctaattacctcccaaaggcttcacctcccaaaaccatcacattaggggtcaggatttcaacatataaatttgaaggggaacacagacattcagtccacaacattctacctcaagatccccagaatttatgtcatcttgcatgcaaaatacattcattccatctcagtagtccccgaagtcttaacttgtcctggcatcaattctgaagtccaaagtcttatctgaatatcatctaaatcagatatgaatgagattaaagataccattcatcctgaggcaaattcttctccagctgtgaacttgtgaaaccaaacaagttatgtgcttccaaactacaatggtgggagaggtataggatagacattttcattcaaaaagagagagagagagagagagaaataggaaagaagaaatgggtaatgggttccaagtaagtccaaaatgcaacagggcagaaaacattaaaccttaaggctctaggaataattctctttggctcaatgctctgtcttttagacccactggggcagcagccccacctccatagctctcctgggctggagtcatacacccatggctttcctgggctgatgctctggtcttccaggcccatttgggtggcagcatcatccccacagcttggtgggatggccctacagcagctttctcctggggtccctattgctttcccaggctggggttcctcacctgcagctcttctgggcagcccagtccaccatggctctgctgggtgcagcccatattgcagctttctgtggggaccccatcccaagtcactgggcaggagcatcctgatctacctaaattgaagagacgagttgatcctttaaaactgttctgctctcctactacatgtcccttgaactctgggcctatggtgcaagtggcagccctgatgaactctgaattgcttttgagtaattcttccattgtcttgaagaatagttcctggattctgttaagatgactcatccatactaatatacttatcaaacagtcacttggccacactattagtggtctcattttttgcatatgaatagacaaagaatttttcagatcttcaggttctggtttctttttgtgcttaacaattctgtctttaagtcacgttttactataagtagtcaggaagagccaacctgcaccttcaacacattgcttagaaatttcctcagctaaatatttaatttcgttgcttgcaagttttacctttcacagaatactagaaccaaataaaattcagccaaattctttgccactttataacaaggatcaacttttctccagtttctggtgatatatgtctcatttatgtctaaaactcatcagaatggcctttaccatctatatttctaccagtattctgttcaggattatttaggtattatctaggaagattgaggctttctttatagctctcctctttactttctgagccctcgccagaatatcctttaaaggcctggttacagcagtttaggttcctctcccctcctctcccctcccctcctctccccttccctctcctttcctttcctttcctttcctttcaagatggagtctcactgtgtcacccaggctggagtgcagtgtcgggatctcagctcactgcaacctccgcctcctgggttcaagcaattctccttcctgagcctcctgagtagctgggaattacaggtgcccaccaccacgcccagctaattttttttttttttttttttttttttttgtatttttagtagagacggagttttgccatgttgtccaggctggtctcaaactcctgaccttgtgatccgcctgcattggcctcacaaagtgctgggattacaggcgtgagccactgcacccagccaatttaggcttttgctgacatatatctcaagacccttccagcttctattcattacactgtaagccacgttcacatttttagttgttcattacagcagcttcccactcacagtacgaacttctgtcttagtctgttaggactgctgttacaaaaatactatagactgtgtggcttataaacaacagaaatttatttctcacagttctggagctaggaagtccaagatcagagtgctggcaaattcaatatctggtaaggatctgctttctagttcatagatggctgtcttcctgctgtgtcttcacatgacagaagggaaagggagctctctctggtctcttatagagtactaatcccactcatgacctaatcacctcccaaatatcctgcctcctaatacgatcacattgtggatcaagatttcaatgtattaatttggagagggacacaaacatttagtccttaacataattcttaagtgttttgaagatagcttgtatattccccaagtcttagtttagatattgattgaggcaaatgtagtagaaggcaaggtaacagagtggaaaaaaagaataggctttggagacaggcagtcctgggatccaggtcctggctgccacctaccagctgtgtgaccttggacaatctgacctcttttgaactctggatgtttaaatacaatgtcagcctccctggcttatattaagatttaaatagggcactgtaaggaaagctccttacaccatgtgtagcactatgaagctcctgcagaaatgagcattgatatagacaattgcttcctttgaatctggctttcttgtcctcagtttggtaactttcctccatctctagctgggggatcagcagaaatgaaagacagacacccttggagagctttgctatgtgttggtttgggctgtccagtgggaggcaggaacttgataagaatgaagaggcacagaggacaaataagagttagaaaaaggcatccagctagcgattagaaaacactgtcaggataaggacacttcatccacatcactatacacatttctaaactgatttcattttagtgctgaacacttgccatgtgaaaagtcctatgctcattacaaagacacatgaaatatggtccctgacctcaaagagctaaaaaaaaatagctggaaagacaatggcataaactctcgaaaatccaaatgctgacataaaactctactagagaatatgtcccaaggaaatatcgctacacaatggatgtaaagagactgtgcttctgtggattgtttgcttgaatttggctgagggacagttattgtaccacttacctggagatggatgttgaaagatattttaatttgcagaattattttataaccataagagaccattcagtggtaacaacatgttcaagtcttttcttaaaccttgaagtggatgatattgggaatactcaagtgatacagaagagatatgtatagggaagatgtatctaggaagcttttaatagaacagactcccagtagtgaaatcgtactaggaaaataaggaagaaatgtggatcatccagttgtagtaatacaattgtgaataatggatagttgagggaagccaagtatacatggttacattgtatcgactaaaaattcatgtctttcccagaacctcagaatctgacttatttggaaatagagttgttgcagatgcagttagttaagatgaggtcgtacttgaatagggtgggcccctaatccaatatgactgatgactttataagaagagaaagcaggctgggcatagtggctcacgcctgtaatcccagcactttgggaggccgaggcaggtggatcacaaggtcaggagatcgagaccatcctggctaacacggtgaaaccctgtctctactaaaaaaaaaaaaaaaaaaaaaaaaaaaaaaaaaaattagctggccatggtggcgggtgcctgtagtcccagctactcaggaggctgaggcaggagaatggcgtgaacccaggaggcggagcctgcagtgagccgagatcaccccactgcactccagcctggacaacagagtgagactccatctcaaacaaaaagagaagagaaagcagagacacagacacttacagagcaaacaccatgtggagacacagaaacacaggaagagagagtgcagtgatgcatctgcaagctgaagaatgccaacatcagaagttaaggaaaagtcatggacctggttctcccctaaagctgtccaatagagcatggccctgtcaacaccttgattttggacttctaggctccagaactgtgagagaataaatttctgctgttttaagccacccagtttgttagtcctttgttatggcaatcctaagaagctaatacaccagggtatcctgtctctctagacccatttatttctgctgaactatgaccttgccattttccagatacccccaccttctgtcctaagcatccctctgattctacatctacagtgacaccccaagatttctggcccactccaaaaattgcccttctcccactcttgccaccaccaaggaatctggtggaatgaatgtggactcaccacttgggtaccagaaaggggtgacactggtggtgggtgtgcatccatgaggcagtcactacaaagtctgagtgaatttctacagctgctaatatgggcacagccctcattcgagtacagctgccactagtaccatccctggagagccctgaatcctcctctggtaaagagtaaatggttgggtccatccttggtcatagcatgaccttggcagaaagagacaatgtcctgcagtctctggggcttaaatttactgccagcctcaaccccaggggaattcttccacaaacagtatttttggttcccttgaaagttattgagtttgattaggtctgtggcttgcgtttgagagaatccaggatttgtcttcatgtcttgttgtgaaaggcctagcctggtactttggaagaggtgtttcatggagtctcccattgtttgacctgatggggttagtctaccaccatgaccctattggactatgctggaaatgcagagttgcaagccagaggctccctgacctccaggctcatgatctattggtcatcatcattgtaattagaagatactgctgttgctgattatgtgtgttggtgaagaagtagttgggtttggatgcggtatgtctagagctgcataccaatatagtagccactagccacatgtagctatttaaatttaaatttgaatcatttaaaattaaatgaattttaaaattcagttcatcagtcacactagccagttttcaacagcccaatagccacatggggctagtggctgccatattggagagcacggttatgggatattttcatcattgcaggaaattacactggacagcgccagtctacagttatttgctttcccaagctttccacgcacacaagctcctttttttttttttttttttttttttttttttactaagtggaattttccaagtattgagaatatgtcagctccataataagaggaaacatgatttaatctcttactgtctgttggaaataataaaatatatgcatctattttttaaaagaggaaaaatgagtattgctagaccaatgtttcccaatttgtaatgtggacataaatcacctagggttcttgttgaactgtaggttctgatttagcaggtgcaggtggggcctatggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaagattgggtccatgaagcatcctgggttatagtactagtgaaaaaattagagtcaaaagttgagtccataattgataggaatggtccagggagtttaatcaatggcatggtagacagcagccatttgaagggcatgccggcaaccatcacttaacatgcctccttaaagaaactgttcatcattggttactgttggtgtaccaaagtctgcatttggaatttgtgcagcttttgtagaatctgccccttaaatatgagatgtttccctttggtgagtgactgcaaaacagacttgagtcactgaagagaatatgacacgagcttttctctggtattgatcttctttaaaccttcttccttcaccccaaagcaaagagcccagccaacagcgagtaaaaagatggggcttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagtaactggtgatgtaactgtagcagctacgtaacagtagcagctaataaaaacatgcttttttcttttagaatgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaaagggggtgaattgaaaggaaaagtctccttggttatgaaaaatttgggaacttgtttatttagacttttatggtattagatgaagaatcagaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaactcagagcatgtgctgcgggcaaaggactgcccctccaaagttaatgtgcaacatccatgcacttatttgaagttgagaccatcggtcccatacgtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaatcaaagctgaagtagttaaatcataagctggactttgaagaatacacaggataatagtagacgaagaagcaggagagagaatattccaagctggaggaccaaatgaggaaagaggtggccgtgggactctcccactccataaggtcctgagaggacacgtagatgccgactagctgtatggagcgtgctgttctaggcatccacgtgtctgttataaaccagacaaggttgagtatcttattttgggttattatacaagagcctttccttgtgctgaagcatgattccaaacacatctcagagcttcatttcaatgcctaatgaagcatttgtaacagaaggcttgacttctaatactcttcactagggtggtgctcagactagcctccctgtataggaaggaaggctctctgtggccagcttgatggacccaggtggcctctctgtgtagccagctcagtcccagtttccaccccctccatggtccctatgagccacccctgggagtccttctcatcttcccttcttacctgttccccttgggtctccaagatggagcggtatagaggccccctttacctaactacctctaagcccgtaagtagcctcaggaccctctgctgcctgcactcttgcagagagcttgaagaatgacccagagtttggtcattgtgagggtcccaggagcatccactggctcagctgccaccttgcctggtcagagcattcattctagaaagtcccgagtgtagccagaaccacatatcagttcagactagtttcacaaattatgcatcacacttaaagcccagagtgcaccaaggagtgtgtccctggcaggtgttcagtgcttcttcctgccatcacctcctgcgcctctgccagctcctttccccatgccaggagggctacatttaatcttgggtgaaagcatgcatgtgagcatgtgttcatgtgccagagcctaagccacacccccagaatgcagaaatccagacttcagagggtcacccctgctccatgacaggaaaggaaatagaatagcagggaggaaaaggatagccaagagcctctaaaatcctctctggatgcccaaattccatttttatgatattcagcataactggatacatggtgggtgagagagaagctcagtcgtaaatcacataactgtaggactcttcagtcacccatcacagggcagccttttccccgttccattgcgttcatcccttcagctgcagatatcatcttagcaccaaccgtggcacagggctggcggatttagagctgactgagtaaatatcagggtggccaggcatggctatacagatgcacctccactgtggctcatgccatggaggcccctgggagttgtgcaatatggcacaacttgaggatcctgccaacctgtcatgttggccgtgctggagtcgtcccttctccgcaggattggtgaggggcccaggccactggcattggagcatggcaggaaaaagcctgaccagaactcacctgggtaaattacaaagtgcttctccacttcctctgtcctcctgtgctccctctcatctctccagtgaaagggctgcttagatcataacattcttgcacaacccacggggtgccagttaagtagccaagtggctgaatttctatcagagcttcagaatgcggaatggaggagccccaaagtgtcaccctggatcctttaaggaacaatttctatgatgatgtaatagaagttgacatcccctttgatcagtgtcttctgggtgggtctgtgagatgagggtgggggcatcatctctgtggactgggtggggtatgaccagcagcgcattttgctgaagctgtgagctctctgtggcagggtctacctctttttctccttttctgacccacctgagctgggtgcaggctccctttgcaccgagtggacccacagacagctgtttgttgagtgccttgggaatgctcatggcttctgtccacaaggcaggggcctcacagctctgatgcagggagctccgctcagtttcttggcctcatccttcttcctgctttgtgcattttcccagaataatgacagtcactccttcccatctttgctccctctcccacatctcccctacacaaatctttgtcctccctggcttgacaccctctgctgcacagcagagaatgagttaaaaatcaaaacccacagcaaagagtgtcccccgtacattttttgtgagctgtaacatctcctgagagaaggtagttgttcttctaacctgcagattgatgatccgagttccacacagtgtcggctgaagggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagaggtgactcccacgacaccacaaccatctgcagtgtttcagtcactgcccagtgaacagaactcagcttcagtggtgctgggggtggttactaacgtaggcaccccggaattttagccccaccgggaactaaaccaagtttaagctctgctgcctacgtctctggttgaccagcagagggcatagaaacactttcttctctcctggagtttgctttttctctgggagcgaaccaaaagctgtattttctaacccatgaaaattctagtttatgaaaagatatgtaaactggtgactgagggcctgcccagacctcctggtaggatggagaatgatcaagggccaaatggtttgtcttacccagccagccttgagaaaatcctcttccttgaaagcctctagggagaaaggaggctcccactggggcagcccctggatggtcctccagccctgttctccactgcttcgccccagtggtatctgagcccaggctgcctcgctccaaaagctagtttccccgccagcatttctaagtcatgaacacggatcaaatgcccgcacaggggctgcctccctactgcagctatgacaattggcagagaccaggggcaggtcaggacaggtggtctcccagatattagtccttgtggcctgccagtcacaacggcccttctgctgcaagccatggaggctcagtgcaggatggatggatttgatgcagctgctggcatttcactccctgccgctgcccttggggaggagcggtacctgcaggttttttataagagcagaagcttccaaagcttcaaggggcttcccatgggcagcagatgtgcagagaggagctgctgtggctctctgcagcggggaatgtggcctgggctctgagttcccagctcaggcctgtggggctcgaagatggccaacactaaccaaagcctgttctgaatttcaaattgacacaaaggttcctcaaaaccagtgatggtaaacacatacgggatgtcaggatgctgctgtgacagcagttttgctgttgcctgagagagacaaggcaggtcaactccaaggcagacagaaggccagggagagtccccagtgtgtgcagggagagaaaactgctgtctagggaatgttaccccataccttccccctctcccttcttgccctttccccctccttccctccctttctctcccctccccttcctcttcctccagcatgcctgttgttttcacttgtacttaaaaaaattcttggttttatgtgacaaagaaaacctttttatttttacataaaagtttattaaatttgattccgcggcctggtgcaatggctcacgcctgtcatcccagcactttgggaggccaaggcgggcggatcacttgaggccaggagttcaagaccagcctggccaacatggtgaaaccccatctctgctaaaaatgcaaaaattagctgagcatggtgacatgcccctgtaattccagctactcaggaggctgaggcaggagaatagcttgaacctgagaggcggaggttgcagtgagccgagatgtagccactgcactccagtttgggtgacagatcatgaccctgtctcaaaaaaattgattatgaaatttgtatttccatcagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagcagctcctcctcagtgctgacagaggtgacagaaagtgacctcccatgtggcattgattgagggggcaggaaatcacccaggtgtcatccatttgtgtgagaagttgcaggggcccagggggcgtgggaagacgctgacccagaaggttgcttccagccagggattcagcccagacggcctccctctgtgaacctggttctcctgtctgcctagcatggggctgaggaagcctcactgacttcgtctctggacatttgaccccttctgggccttggaaaagccaacactggcttcttcctatagagccaggttccccgcatctttcacctactggtcagacatggccttccaggcagagaaagccttgtaggtactctcaccagcagatggccattttcacttggcaagcctcccggccacttccttcttttcacagcagacctgagagagtggacagagagccctacagaacctagggcaggcctgggagatggaggagacccatgccccagctcaagagtcaagggcccacctgaacaatgaggtaggggaacagctcctttcaagcccttccttccccaccctctctggactctggataaagaaacacgactgctttcctctcacccagaagccagaaggacctgagcacccaggacttgtggctgtcagagagctgtggaagggcaggggacaccagatggcagcagcaagagctgggcggcagcatctgcccaggccacctgcggagagaaggctggaatccgagggatcacactgggccagcattgagcctgtggccaccacactgacccctcctcagctccccctcacaggacctgaaagcatttctgagttaagtctgcataggaagttttccagagccatgccacatatccctccatccactcagtgcccattttacagatgaagagagaggcacccagaaaggtacaccaaggcaagatatggcgtagacaggatgagggcagagccagcttcctgatctgatggaagtcatgaagccttctctgccttacgcttggctctgcagggtcgctgagaggttcctttaaggagatcatcagaatcctaaatggcaaaaaatggcaaatcaggggaagagttggagcccagcatttggggacacacacacacacacacagtcgtcttgccttgcagaaattgggttgcattactccagtctgccactgagtggcacctttgggccatgcacttggctccaaagacatttctctgaacagcaacagaaaaacatgtttaaccctaaaaaaaaaaaaaaaagaaacaagtacatcttactttggatgaaatttgatgacagattgaatgcactgtctgcactttccaccacgtcatgtttcagcttcgcttgtccctccctttctgttgactagactacctgtgattcccgctgctctcggaaccagcacaggacctactctcttactcactgatgggggagctggcctgtccatgcacagggcaaaggatatgacacccagacctggatcctgctgcaaggctgccttgggaaccatccttaagacccggtagctgttgtccaagctttggctctggctgctgctgctctcagcagaaaagagctcactgctcccatgcggatgctgagggattaaacagaggcaaatacggaagtgagcagatttttctctcttgctctcagcagaaggagaaccattctgcagagaagttttcaacatatgcctcttcagcattgctccagatgcgtccgtcttcactctgaaacccatatattgagcacctactatttgccaagcaccgtgctgagcactgatgtgaattggctcagtttctccatctataataggaatggctggttcattcttacacagatagtctttatgattccaggacactgcctgcttctgggatctctcctccattttgatgccatcacttgatcccaactagatttgacaaagggtctcacactgtctgcatggtggcatgtatgtagcactggggttctcaaccaggaatgagttcatctcccaggggacattgggcaatgtttggaaacatttttagttgtcataacttgggaaggggggttgctattggcatctagtgggtagaggccaaggttgctgctaaacatcctacatttcacagaatagcctcaacaacaaagaattatccagcctgaagtggcaatagtgctgaggttgagaaaccttcatgtagaaggagagaaatcccgttctgataacgagaagcacattgatcttttaatatgcaattcttttctgttctgcaccataggaacacctttgatgttttcacaatctccatggtctttgcagctcatgtagtggcatcagggcaggctgagagatgcagcagaatgggtttcatgggacatcagctctggggccatctcaggcaacatcccgatgctgagccccctggaactgactgtgtttctgctcccacttcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggtttgcttatctactcaagtggttgtcataaggtgttcatttgtccccttcattgcctgacctattaacacaagttcaaggcattgtgggtagttaaaatttcagatttggttatttttaagttcatcagtggaaaccatttcagataggcgcacagcaaaatcccaggatcgttttcctagatgggttatgtattacatagaaaccaaaatgtgcagttatatgctttatttgttccaggaaagcctcaaagtgttttacaaaatctgaaggcttgtaataagtcagtgatagaatctggaaaccagaacacagcattggggaagtgggtgtagtgagttagcagggccatgagtcaaacccacatctgtctacctctgaagcccacactgataaccacctctctacactgcttccgcagtgatctccagctctgcagtgaatattttttaagcacatctatattccaggctctgcgctatgtgataagataccacaaagaacaggcaaaacccctgttctcaccgaggttgagtgggagacagacaagtaaatgggcaacttcaacagtgtgaaaagtgccccaaatgggtgaaccctaggttaaagcaagcctgcaggagggactcccaaccctgtaggacacaattaagatgctcacagatgctagtgatgctggctaaagaaacaggaaccaccctaaccagcagactaaattttgacggctgggaggtgccatttctaaaaataagcattgggttggtttcttacttcctggcccctaatttctatttcctgtcaccatcccacacccagtgacagggcttaagattttgcttatctccttgaccccacttacttctctcacctctggggcccccagtagagaatttgggtggtttgccccttgcagacattattatctgatttaggaaactcagtgtagctgcaccaatgcaaataatggcatgagaacagtgtcccttatcatccagaattaccttgtcatttgctcagaacttcaagatggaaacacctaccaacctcaacaccataactatctacttctctccccctggtcacgagctccatcaaatgcctgtgccaatcacgaaatcatgactccttcatataccccttgcagcttcaaagcagaatgtttgagtcatgagagctctttgctgagatatttttgcttatgtgtatgtacgtatgctttcaagcaccatattgacatggccagagaggagagtgacaggggagttccgtgggggttccctgcatgaacaagctgaagctcaaactccaatatttatgaaacacaagaagagggatactggtcaaaaccttgatgcatctagcacagtattaacactccaagcatgacatcaggagggatttattttaattttttattatgaaaacttttaacacttggaaaagtggaaacagcaaaacagcaaacatttatagaccctcatccagcctcaaaaatcatcagtacacgtctgatcttgctttatctctagccccatctactttttcacctgccaccaggttactttacaacaaatccaagatgttgcatcatttcatctgtaaacttagatatgtatctctaaaaaaaagatccttttgttttaatattgccacaatatcctttatctccctcccttcctcacatccccttgcaatttatttgatgaaggatttagatcctttgtcctgtaaagagttccaagctctggatttttctgattgcagccctgtggtgctatttagcatgttcttctatcatctctctttcctataaattcgttttataagatatttaatcagatttaggtttgatttttatggacaaaaccacttcatggattgtgtggtgctctcctatcagaaggcacatgtctagccacctctctttttgacctttttgcagatattgatgtctatcgcttatatccattagttaattagaggttacaaaacaacaacgtactaattttattctttcttcacttattagctggaatactttcataaagagaaacttccctccaccactatggtattaactagcagtacaattcacataagaaaagcaggataaatatttgattctctcccttcatttgccagttttcaaaatgagtggtttgctattatcttcctatggtaaacattagggtctattttggttttactatctttgtaaactcatgagtttaaacatatatgctatgttttaatccattttgctgattacttttattgatgcttggattgggccatctctggccagttggctctttctgacacagccctaagagtgatctttgacatcatccaaatagcagggaagctaagatattccagtctttgcccttacccagaataagctgtttctccaaggatccctgattcctcttagtgagaaatggtatttagagactaaaatctaggcacttagagtgtttcattgttcctggattgtttatcatttccagcccttttcagtcgacagagctaggaaatgtgttgctgtttataataaaaatacatcctgagttcatactgatacttttaattcaaattctgacctacaggggattttatttaaccgcttgtttcttacacctgtgcctcttttctctatgctgacaatcctgactttcaagggcactggatgatagcataattactcatttgctttatactacacagagcagtctctaaaccacaatgctaaaaatacagcaacagtatgattatcgcctggttctttaattgttgcatagtattccgttgtgtggaggcaccatagtttagtcaaccagtcctctcttcttggacatttatgttgtctctacttcaagaaagttttgatggaagaagtggggaagtcagcctaacgaaggttacatattgacaagtatctcaatatccaacctacagtgctctaccattttccaagtacttctaaatacattctatctaatttctacagcaatctagactagacatgaggatgtcttaagcatccccatcttcttcattatctgctaggattagtctcccatgaattcaaataaaacactcttcctaagccaatccctattttcagaccaatttcctattgcttctgaagtgtatttccaccataaatatacaaagtgttcctttctagcagagtgaccttggacaagttgcttaaattccctgagtcttcctttcctcatctgtagaacagggatacaatggagcctacacataggggtggaatggggaccaggtgaaaggaagcatgtcaaccactaacgatgtctggcccacaataagacagagtaaatactaccatcttatttttctaatgtcactaatattctctttttaagccgtagtgtttaatgtatttggtaaaaatttttaaataatttcacataaccttagcacccagagataacccctattttggtgtattttcttccttgatttatgtgtgtagctacgtgtaaggtctgctcaggctgctaccacaaaatagcacacactgggtggcttaaactacagaaatttatcacagttctcgagactgacaaatccaaaattaaggtgtcagcagatttggttgctggtgagggctcacttcctggcttgcaggtggccgccttcttgctgtgtccttataactctggtctctcttcctcttcttataagaacactaatcccgtcataagggcctctctcatgacctcatttgaacctaattacctctcaaaagacccacctccaagtaccaccacactgaggatcagggcttcaacaatatgaaatttagggagacacaacattcattccacaacagggcgattttgcaaatagcgtgatcctgtaacctgccttttacctaaaacaggggtcagttaaaaaactatacttttcctaaaaagagccagatagtagacattgcaggctttgtgagtcatgtggtctatgtcacaactattcgattctgcatacaaaagcagctacaatgcaacaacatagcaatgtaaacaacataaatgaggacctatggctgtgtttatttatgaacagtgaaatccaatttcatataatttttcacaaaatacaattcttcttttagtttttttcagccacttaaaaacataaaaactgttcttcgctcatgggatgtaaagatctagatcacaggtctgtatctgtagatttgaatcacagactgtagtttgtgaccctgtgctaaataaaatctagcacatggtcatgaaaattattgaaatgcttcaagaaatccagaaagctacaggatagaggattgggcataaaggatcttcagtttttgggggagagtaagttagaggagacttggttttgacgcagccatggcaacacagcaatctgaattgtgaatgtttctacatgaggattgagtgttgcggagcagaggtcagcaggtgccaagagactcacactgccttaccttcctggacagcactggctgcctgccccagcaaagtaggtgcagttcagaagttcccaggtataaaaaggaggttaaaatcctcagcagcccatgaccagccaggacttgcactcagatgtcctcgcttgctggccaagattctgctcagaccacactgtccctggattgttagtgctgagggcttggtggtcgcactgagacctggagaagttctagtccctagagaaaggccaagagtctgggagttccttctagaattatccatttaagttctttaaactttctcttctcggtttgcctctctgttaaatggggatgttaacacctcagcccatggggctcaggggctctgggtggcttcctcagctggtcatgatggttctcataaaccccctgcagtggtcatatgctttaatattagtgctcagtagcctgagagaaagtacagccagatttatggattcactggaagcagggactgggggtggggtgcagcctctctccaatgggttttgtttcttatttgaccacacgcattgttagagccaagttaattgcctgtatttgcttcctgtggaaatatttcacaagacaccctgttatcgtgggcccagcatttgtacttgtgttttgctgatccgtttagcttttttgaaaattttgggccaagaccaaatcttccataaaggtctgtgggctgtgaccatagtcctcagctgtttgctgtgttgttccaatttcatagatttagccttgtgaggggagaaaaatatataggccatgattatttttttttaaggactcagttctttatgctatggatttaattctctgttcccaaccatgtggccttaaaggacctgcattgtcacctgcttgctatgtggtctgaggcaagggccttgaccttttgtgccttagtttcctcatctgggtgatgggggtgatgtcttctttacagcccgctaaggatttcagagaaatcagatgagctaatagccctgaaaaatctttgaaaaagtaaaaagtgctatatatttgtaagtgtgaactcacaaaaattaatgactttagtactctctggggtttcgtaattctaagctggatccaaaagaaattctctcaaaatatctgcccttagatgggaaaaaatgccagaaaaggatgtaagaactgaattttcaggtcctggaatgcatcctaaggaatttgagcttctcatcctgaagacagtagcaaagcattgcaggcttttacctggaagatggtgaatcccatggtgatgggcatagtaggctggagccaagagagagttctgaaccctggggcatgtcatataaagctctgctggcagttgttggtggagagaattaaaccacaggaagtattgagaaccttcagcttccttgtagggcatttgtctctttccaaagccttcacaggctctagatgagatagaaatcaaatgccagcacagtggctgcctggcttccattttaaatctcagagtaccaaggatgttccaaggactatctccctggatccattcaatcatttgtccatctgcccatacacccatgtcatgaacatccattctcccattcaagttgggaaaccttgacccgtgcggcataatattctgtgcagagggaaataacatgagaaataggaggcccagatggctttttttttgccatcaggcagagcttatctaaaagcacatcattttcaaacaaaacaaaccagacctaagaaagcacttcattgagataggattggattggaaatctgtcctttaagtggactgatagtggaataggacaagccagtccagccccattggctttgatccttgcagtttcccacctcaccttcctactcgtcccagccccactgctttcctgacctgtggtacctgctaagatgccccaccctgccctgtacctggagtgtctgggccttccagacctctggatttgaaagttatttcatgggagcagaaatttggtcttctttaccttttataagttcctgcatcacaaaggtaatgctgaatgctgaatgtcagctaaatgctgataattcattccagaattataacattttcagctgtgcctatcaaagaagcgggggacaatttgtcccttagctttcaactttggagagacaaccttggggagtacacctagtagatagtcaagaaaagcaggttaaattaaattcctacaatgtgccgattcagcaaaacttggaatacccactaagtgtcagatgttctaggcgctgtgaatatacaaatgcgtagggaggttcctttccttaagcggccctgggtctgacttaccacagctctgcttggccttgatgaactcacaaaaggatcaaagagcatgctcaaggccagaatgaggtctgcgtgataaaagagctgagaaagataccgtcaagtccacatccgccatgagcagacaagaagcctctagcaaaacgtttatattattacctaagtgtagatgtttaaatgcaacttgattaaggaatgcaaggtttctaccatttgctttgtttaaaagccaaagcccagtagagtatgattttaggtttgcccagattattcagaagtagaagtcttcccagctgttcatctttgctccagtggtggaggtggcggcattgcgtgccagtatcacaagaccacaccaagtttcctggtattaatcctctattggaaggcatttcctggtagactctcatgccagacatattttaataaggaattctgtgacactgcttgctctgggggttgctcattttatcctgtaggtggttttatttttgggagatgaacagcagagggagggatgcattttgcagagaataaatcagtcatttgtgatccagttctgtttattaccacacagactagtagttcctgacagctactgagagaagacgtcaaagagttcaattccaaaatttcttggttgctacatctaagcatagattccttataccaaaccccatgacctccttgaggaggaaatgaaaatacttttcttcttttttttttttttgagaaggaatcttgctctgtcacccaggctggtgtgtggtggcacaatctcggctcactgcaagctctgcctcctgggttcacgccattctcttgcctcagcctcctgagtagctgggactacaggtacctgccaccacgcccagctaattttttgtttttttttagtagagtcggggtttcaccatattagccaggatggtctcgatctcctgacctcatgatctgcccgccttggcctcccagagtgctgggattacaggcatgagccactgcgcctggccaggaaaacacttttctaagttaacatccctggtatttgggtaggtgaaagacaatatgcaaagctgtctttgaagctacacttttctaagagtagggattgaacagcatgaaaatactgtgccctttggccagttaaattaaatctgtttttatagatgctttgcagagtaaaggcaaaggatcatttactctcacatcctcttatgacctggaatgatgccttatgtggaaacacagggctcccatgtcctacttaggaggctaaggaaatccaaagggggcacttcccattttagatccacatgatcccaggttgttcatccaaagatacatccagaaggagcaacagcttcctatctttcacttatgtggatgtccatattgttgcggtatcttttctgttgcctcttctatgtttgttaagcagatactgatttgtgatccacttcaagtcctcaccactgtgctgtcctgcaagaaccgtgctgaagaaaagctcattttccctaggcttcagctaaccatgcctaaggtctgaggacctttggtcaaacatattcaagtctcttgaaaggtgagactcaaggatacagacttatgacttcctaagggcccatcagccctcaacgctttaccaggttgggaccttgtttccaaagatgttcatagctcccttcaagtatagatggcaagttgtgcatggactgcctgttaagtgagaaaccagagcctgggccatccctggtgtcttggccattaccattgctaacagcagtgatagtgaatagtacccaaaagggaattgtaagcagtggccacaccttctactaggatgactcagatttaggactcaagaggaggctcctaactttcctgcaaccacacatggagggattttgtctcagccaaccagtactgactccccttgggacccaagtaaaggacaatgaaaagcagcacttcaatgtgagaagagcgtgagctttggggtcacagagctctgggttcaaatcctggttccatacttaccttgggtaagccacttgacctgttagagtttcagtatcctcatttgtaaaatgggggtgtttaaacctaagcactacttcagagcaaacatcaccaacaactgaaatagtacagctagactctgctcccaaatcctctttgcttctttctccagaatctctctcatcccacaaatcatcccttgcaaggacagtcacagcatgaaattattattgccacttgacatgtataatcatttttgtagtgcttccacttctacttccacatttaattgtgtgattgacaggactagaaaggtgagcttttggctcccagtccagttccttgtccatcaccccacacagcaacaccacattctgtccacacagcctcattttccttcaagagactacatgggacccaaaagctcccaaagtctggatgtgattctaggcagcttaggtatggagggcagagatgaggcacacacacctacaaaaagaaaaataggatacttgaaaatcacaagaagagctcttggccgctgtgcaatgctccagctgggtggttctccactccaggaggacgttctgaagctgggaaatgagatctgtgctgtcttaggagcccacagcacaggggaggacataagggtcttcttgaggagttcagctgcatgcttgtggcccagggccccagtcatttgtctgattagcttccccacctcttgagagagtcactgtgttttgtctaaaaagaaaggagatttccaaatgaggactctctgagcaaaatattgattttcagcaggtgtggttttgagacagtttgtactgcatgctctctccagctctcactgtgcctcggactctattgattctagttggttttgatcctgccttagcattccaggaaagcagagctctcctagcccaagaagagaaaatgaaggtggagtggctcatcggggtaacatccctccactacagccatcaaccactccagggatatgatgcctcccactgctgaggactctggctaagacactggtgtgatttagagccctagagcattggtttatcatcatatagagaaccaccctcatcttctttggaggaggtgcctctccactgcatcccaaggtgggagtgacctctggtagttctgcttgttcatagtcagcttagtcatctctgttgtagaaagagaaagagagagagggcaagaaagggaaagacggagggagagaggaaggaagtgggaaaggagggaagaagataaggcaagacaaaataagacaaagcaagaaagagagagagcacgcgggccagcacgctttttctccatccccttaggaatttactctcagcaggggcttggcttggctggttttgccagtgactcccttgcactttgcagattctgaatatacatttcccttaagactggttgtctgcagaataggggaaacaaaccagcacccccataaatcagcagaggtcactgccaagagctttgtacacttgctgtccctggcagtgataaactcattgcatttgggaaatggccaaagaccctgagtccaatcttaattctcattcccagaaaaatctcagttttctgttcacccacccccgtttactgtctttgtgtttcctagacaaagctggcaaggaggaaagaacacagttcaataactggatcatcaaaggctgcatttcgttgcttgggggaggagttgcagggcaggaaagagtcacagatccctaggctgtggaaaagagaggcccaggccagagggaggctgaagccatggggtctgcatggggtgtgagagatccgcagaggttctcagattctggttttctcagacccgcaccttggatctgctattactgctgtggtcggttgttcccttgaagggtggttcaggctgttataatggtggtcaagggctagcagtgggattggtgtggtgagaccacctcatgggactcatgctccagtaggttgtgttcttattctcttatctttctccccacaccatcctcaccttggtatctggctttggagttggccatatgacatggagaagatgagagtggtgtccaaactgctcctctgacccacatgggcctcctgagagtggacaacctctctctgctgccctttcctccttgccccttgattgtctttctcctctgattgatcagactgtgaagctgcaagaccagacccccccctccctgcaatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctggcacctagtaaatgctcaataactatttgctgaatattattttgattcagtgtttagacatctgctttatcctgctctattttgattgacaagttctttctcttcatgaaccaggcttttccctcctacaatgagtctataagaattagctagatcagaggggaatttggtgctgagccagaagagctgtctaggggaggtttcctcacttcttatggggcagcagaggggtattgtgagatattgagaagtcagaacaagaagcagggaactgttgctttggagaagggtctggagaggttccaggcactatgataggcttttccagatgactcaggagccacctggctctgtcagccagaaagaagtgatgcctgacacaaggagacagtgtgtcatttttactgtggactaacatttgtacctaagctttaaatgttaaaataatttggctgggtgtggtggctcatggctgtaatcccagcactttgggaggccgaggcgggtgaatcacttgaggccaggggtttgagaccagcctggccaacatggtgaaacaccgtctctactaaaaaatatataaaaattagccaggcgtggtggtgcatgcttgtaatcccagctacttgggaggctgaggcaggaggattgcttgaacccgtgaggtggaggttgcagtgagccaagatcacaccactgcactccagcctgggcaacagagcgaagactccatctcaaaaagaaaatgttagaacaatttaaagagacaacaaatgaaaccaaagaccaatgatacccctcagcctgggctctgagaccattagggatggctgagccaagattttcatgctcctctgagctgagtgtaatcctcattctccttctgtgcagagagcaggaacttgatgcagtcataaacccaagcaagtatggagccagtaaacttgctgaacattaaattccaaccggcatttcagtgaacatgtatattcgactaatatctgagcctgtgctagacagtatgcatctgtaaaaataaacacatactgttcctcaaggcacttaaacaagagtgagctggatttttgtctgaaattttcagaaaaacacttagtgaagtgtgttcacactaagtttgttaaatcagaatacgtctggactatccaagtagtctcagaaccaggccactattggaggctgggcgcggtggctcacgcctgtaatcccagcactttgggaggctgaaacaggtggatcacttgaggccaggagttcgagaccagcctggccaacatggggaaaccccgtatccactaaaaataaaaaaatcagctgggtgtggtggtgcatgcctgtagtcccagctactcatgaggctgaggcacgagaatcacttggaacccgggaggcagaagttgcagtgaactgaggtcacaccactgcactgcagcctgagtgacagcaagactttatctcaaaaaaaaaaaaaaaaaaaaaagaaccaagtcagtatttaatttcatttgagtccttccagtgggtttattcccattagtggggtaactcccctgcttttgtaaatatgagggtatctcaggaagaataagtcccaaaacaagattctttgggttccaaccaaagatgaaaccaagagggcctcacatgtgaccaagacattttctgctttctactttcactttctttttgtttattttttaaattgagatgtaaaagttgtatgtatttatggtatatagcatgcaattttgatatatgtatacattgtggaatggataaatcaagccatttaacatatgcgtggtctcatacacttattgtttgtagtgagaacacttaaaatctactctcagcaattttcaagtatataatatattgtttttaactgcagtctgtagtcaccgtaatgttcaagagacctcttcaacttattcttcctctctaattatgtggtgtcctttgaccaatgtcttcccagtccttctcactccccacagcccctggtagaatggccattctgctctctgcttctgtgagtgtgattgtcttagattccatatacaggcacatctcgttttattgcacttccctgtattatgccttatagattctgtgttttttacaaattgaaggtttgtggcaaccctgcatcaaacaagtctatcagcaccatttttccaatagcatgtgcttactttgtgtctgtgtcacagtttggtaattcttgcaacattaagcttttttagtatgattatatgtttatggtgatctgtgattggtgatctttgatgttactattgtaattgctctgggggtgcccaactgcacccgtataagacaatgaacttaatacatgttgtgtgtgtgtgttttctgactcctctaccaaatcagccattcccccatctctttccctctccttgggcctctctactccctgaaatgacaactatattgaaattgggccaattaataactctgcagtggtctctaagtgttcaggcaaaaggaacagtcgcatgtctctaactttaaatcaaaaactggaaatgattaagcttagtgaggaaggcatgttgaaagccaagataggctgaaagctaggcctcttatgccaaacagcctaggtgtgaatacaaagaaaagtttattgaagattgaacatgctactccagtgaacacacaaaagataagaaagcaaaacaaccttattgctgatatggagacagttttagtggtctgaatagaagatcaaatcagacacaacattcccttaagccaaagcctaatccagagcaaggacctaccttgcttcaattctatgaaggctgaaagaggtgaggaagctgcagaagaaaagtttgaagctaacagaggttggttcatgtggtttacaaaaagaaaccaagtccataacataaaagggcaaagtgaaacagcaagtgctgatatagaagctgcagcaagttatccagaagatctagctaagatcattgatgaaggtggctacagtaaacaacagatttgcagtgtagattaagcagccttatattggaagaagataaatctagggttttcatagctagagaagagaagtccatgcctggcttcaaagcttcaaaggacaggctgactctcttgctagggctaatgcagctggtgactataagtcgatgccaatgctcatttactattctgaaaatcctagggccttcaagaatgatgctaaatatattctgcctgtgttctataaatggaccaacaaagtctggatggcagcacatctgtttgcggcatggtttactgaatactttaaggccactgttgagacctactgttgaggaaaaaaataatatttctttccaaatattgctgttcattgacaatgcaccaagccatccaagagctctgatggagatgtacaaggagattaatgttgttttcatgactgctaacacaacatccgttctgtagcctatggatcaagaagtaatttcaacttttcaagtcctattatttaagaaatacatttcataaagctatagctgtcacagacagtgattcctctgatggatttgggcaaagtaaatcaaaacccttctagaaaggagtcacccttctggtggatgccattaagaacatttgtgtttcgtggaaagaagtaaaaatatcaacattaatgggagtttggaagaagttgattccagccctcatggatgactttgagaagttcaagatcctagtgaagaaagtaactgcagatgtggtggaaatagcaagagaactagaattagaaatagagcttgaagatgtgactgaattgctacaacttcataataaaactttaatgaatgaggagttgcttcctatggaagagtaaagaaagtggtttcttgagatggaatctactcctaatgaagatgttgcaaacattgttgagatgacacaaagaatttagaatattacatcaacttagttgataaagcagcagcaggatttgacgggattgactgcaattttgaaagaagttctactgtaggtaaaatgctatcaaacaccatcacatgctacagagaaatctgttgcgaaaggaagagtcaattgatgcgacaaacttcattgtcttattttaagaaattgccacagtcacctcggccttcggcaatcaccaccctaatcagtcagtatccaacaatgtcaagacaagaccctcccccagcaaaaggattatgactcaccaaaggctcagatgatccttagcattttaacaataaagtattttttaattaaggtatgtaccttgttttttcagacataatgttattgcacacatcattgactacatatagtgtaaacataacttttatgtgtactgggaaacgaaatatttcttatgacttgctttattgtggtggcctggaaccaaacccacaatacctccaaggtctccttacataagtgaagacaagtggtattttgtctttctgtacctgacttatttcacttaacctaatgttctccaggtttgttcatgttatcacaaatgacaggatttccttctttgttaagaccaaatagtattccattatgcctatatactgcatttcctttacccatttatctattcattgatggactcataggttgactccatatcttggctactgtgctctccctttcttttgtgctgggtaaggagtgagtcttggtgaatccttgtcattgctctgtctttttctggccaggcatctctaaaatgtgtcccccagctgatgggaggtctgtgcctcctccttcgatcccttccctggaaagagcaccaaggaagaggtccttaatgaccagtcctgcctctcagatgagcactctcctcctccctgaccagctctccatccccctcaccactagggcctttgtctggcttcatgagaagaacaatgagcatacatgggggaagatgcttcctccaccaggacagccattaactaacaagcccgccctccccagtgaaggccaacctccctcctaacacattctctcttggaacagccaagctttcctgtgcagctgagctgaattccacttcaatggataaataatcttgcccactgacaagtcctcttttctaagggaccaggattttccaacccttgatgaggacagatctgtttggaagggaccacaagattctaggaattagctggaaatcaggggtgaaattatttgccaaggccagaatgtataacaaatgcccctgggagccgaggaaaagaggcggcaccttgctgcagcacctgcccctcctgggtgttagttacatgtcctgtgatgtggttgccaagaactccttccaggacgaggtggtggccctgaaatgcacaaactgacccaattgcattattgcctgtttttttaaattaaactttttattttgagatacgtattgattctgatgcagttataagaaatactgtgctgtttacccagtttgccccaatggcaacatcttgcaaaactatagtaccatatcacagccatgatactgacatggctacaatcccctgattttattcatatttcccagttttacttgtgccccatgtatgtatgtgtgcatttagttctatacaactttatcacgtgttaagatgtgtcaaaatacagaaccattctgtcaccacaaagatccttcctgttgccttttataaccacacctcccttgctccctctacttcctcatctctaaccccaggaaccactaatctgttctttgtctctataatttgtcatttcaagaatgttatgtaaatgaaataatatagtttataatctggagcttggcttttttactcatcctaattcccttgagattcatccaagttgttgttgggtgtaagaacagtttgttcctcctcattgccatgtctggttttaatcattaagcaccccaacatggcacccaagcccaattacaaatccctcaggacatgatcctcagggaacttttattctaagagagcccatatgttttgtttggtgctgctgagtttgggggtgtggggatggaacatgttgcaagtttttctaggtacatgcaaacatacctaggttccttcatctccttccccaaaacagtgatcaattggattgtaatattctttagcactggttgacagcccttccttgtgtctccttgtcaccttcctccccaggagcacatctacaagctgatgaagagtgacagctatgcccgcttcctccggtcaaatgcttaccaggatttgctgctggccaagaagaaggtatctttgggaagggcaggcttgctcttagcactgttgactcttgcctgctgcttgctgctggtttgaaatgagaatatcatcccttgggttttatttatttcctactttcttctttcccttctctatctgctcccattctaatggaaaacagttaggattgtcaccaccccagccccactgcaaggtccaggatggggcatcctacctccacatccctactgcctctctctgcatgttctgcccatggtgggggtgggtacgtagggtgacaaaagactaaggccacagtggctcagcataggagtgcagggctggcagtaacaccagcaaaacccttaggacactggagagagcccctcactgcaaagtccagccccttcacctcagacttctctccctgaccagcccagagaggagtatgaggccagggttggggcagctctctcactggtcagaaagccttgtcagtttcaagagcacaatcaggtacctaaagtcatcctggggtttctccctccttgacacccccttcctctcccgcacctgccccacggtgttgcctttctctcttaaccaagaagtaactgcacccagctccttcctcctcctccttagaactcagccatggttccttgcagcccatggagtcatggatttgaggtgcaggggccctcagcatgcaggtgaggggtgacagaagcaggaataaattcagctagattcctgggaagagaggaggaagagtaggcaggagaatagggtccaggaagggaatggaaggcaagagagagggctcctggtttcagtacacctgcccaccctctgtgcttttcagctctgatctgaggcccatgtgtggttaagtgtggctcaacttgcaccaaaccctatgacttctgtgccatggcacttagggagcacaggcatccctttctcctccctcctggactcccagccccaggccctaagcacgtggttgcccatcacatgctctccgctgggctgcctctcagccacgcaagccttctctctgtgtgctgtcaccctcatgtgccaggatcctgtctgcgtatctggttgggaccacacaactccagagtcctggagagcatttataacctgctctcctgcccttgtgtagccctggaaagaggccatggagtctgagaaaggaaagaggacttctggggtatcccagttgtcagcagctctctgggtttcctgcatccctccccacaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaaggtcaaagtaagtttttcttattttctgtggctcaagacccctgatctgatcacagtttggtgactttctaaggctctggtagtttaaccagtctaggcctgtctacacacctagaagaagagaagctagaggccattgattctccttgtgggtttgaacacaaaggaaaaatgcaccccaaaccaggctgagacccctgtggctgcagatcctcccttccaagaagaaaacctctcagaggaggtcacttgagtgaggaaggaactggcaacctgcctgggaaaagttccttagagttatcctcccagctcccgaagtaagggatgttcttgagacagaaagcccttgcagataccaacaacgtctcaatactgaggagttgtttcccaaaacagtgacaaaacctgctttctccttctgtttcttcctgagagtctccaggtatggatctgatttgtaactcggcactttcaggtaggcctagagtattcttctgatttcagggacgggttcaccgtatccaggtcataaaaggtatgtgagattcacaacctccggcggagagagggaatatgaatcagcctcacttttctgctgagaactgacctggacggagtcttgaggcacagccttctgatccttcatccctaattcagcctcttttctaatattttccaaataaatgatagtcacactgaagaatcaggttctcagggggtaggtgagctgagtcctgagggctactctaggaaacttcagtaccagtgatgatggttttccagggcagctcaatggccagtgcaaggcagaggagccaagtgagccagaccaatggccaccctctgtgagccagaggataagaataacaggccgacaatgccagctgcagggcccaggactggcctgacttgagccaagtgtatgccacccaggctggccacagggttcaagctgagtcctgccatccccagaatagagacttggtatggtacccggggccaagcatgagtccttcagttcctagtacaagaagaaaggccagcccaactctgtggtgttatgtcgtttgtgttgtattttccttctgcaacctcatatctgtcttctggcagccagctgagctgacaaggggcctggctgccaaggaagccccccaacttcatccacacaggcggctgcctttggcctgtcccctctgctttcagcacagtccgcagacccacagacctcaggctgcctctttagctccctcatttcagttatttgctgggtgtatgtttgtgtctatgtgagtgtgtgcactctccgaacttctcagcctcgggctcaggaccctggaacgggatccaggatacactagcaggtatttgagcggtcattctactctcccggaacccctgcagctaggaaatgtggggtgaaaggaaagtcaggagcaccccacacctctcttcctcctgtagtagagggaggctaggcctggaaagacattcaagggctttgcctctcctcgctcctgttctgggaaccccagctaagagttccccacaatggtttctgagcttcctctagcctgtcgtacgtacatcttggcaggtgttatgtcaccttttggatactgagaaaacacacaatccccatgttattgtcttctgagacccaagaccctttgtccatggcaaaggctatgagtagaccctccttgctctaaggacacagaacgagggtcactaggaagtcactgaagttagcaaactttctggctgcctctgggcaggggaatctcaagagagaaaacagtcctaaggcagactcatggatgagtagataacttcgcttccccggcagccccttcctgacgtccctcccacaccctgctggctctcagagccagtctgttctgtgtcaggacttggggggcccccagggccccagggccacaaccaccagggctcctgcctgtgggcacggcaggttgaaagcagcaagcaagctgctcaaacccaccgactgtggtcctgcagcaaagtcatgatggttctgatccaagccccgcaagcaccattcatggcccccggagaagcaaagcccccctctctgctccctgctccaaggaggcggcaccatttctcgtgggcttctgtcttctgtctctcccattgactcttccaacagctctggctgcttctcttttcccatttttcgccccattttgctttggtttttgttattctttagctgcagctgctgctgtttgggaaccacgtataagctgaagattttttttttctgtatttttctccctacccttttttttttttcctaaagccagaaagtgagcaaggtcgtagaacttccctagaaaagttcactcgcagtgtggtaagttcagtcggttttcttccctcagcttttcttttggttttggttttttctttcttcttcttttttttttttttccctttggttgttgtttcctttggggtgggagggagtccagtgctttctccctcgactcagcccttttcttttgcgagtgtctgcagcttctcttctagggatgaaaatgcaaaaaagagcaagcggctccctctgcagaaggtgcacccttgatcgcccagcctcaggcctgggcatttgatcatctgttcagggctttgaggaggagggaccctgctgccctcggggctgtgcggtttgtgcatcttctgcagcagctcagggagaagccatcgaactataccgtgaaataaattggctcagaaccatagctcatcgaaaaaaaaaaaaaaagccaaaatttccctctgtgaaccctggcagtcacgccggtgtgggtcgcgagctaatgttgctgtgtaggcggcttttgctgtgtgcagaaagcggccgtgctgcatgggtcctggcgatgtggcctagctggcgtgtgtgttagtcgcctctgcatgagtcccttccagcccccatcagcctcatgtgcacagtgtgatagggagaggagggaagtagctgaatccctgcggtgtcctgggtactccccgggggcaaggtcctaccggcctcctcaggccttgattctaacaggctgggtaaagatgggcttcagattcctacaggttcatggtacgccccagctagagaggtagagctccccacagtggcacataaagacagccgtggcaacaggtgggagtggggagtccgtggctgttccctggggtgcatggctgagactctctaccatggtttgtagaacaacacaggccaatctcctctttccatgctggtcggcccaagatttgaacattgagctcagtgcacaagaaatactcaatcccgctcaatcacggggcccatcctgtaccatgaacatcaaaccagagggaaccagggagcagggtcccatgcagggagctggccacattcccttcccaaagggtggcagcccattgatattgacttgcctttgttccacctctgttgaggaggaaaatccttgtaaaacctgactactgtgtgactggtatacgtatttcatccttttaagaaaaagtctaaggctcctgggttgaaagcagcctagtcatttacgtgtcgtagctagatgcattttaagtgcatttaaacattatcttgaatttgctacatgtaaacctcaaataactctagtgggtggcaattaattaaacatcggtatccatcccttcccttcctcggtcttccctctctgtggcctttcctcatgagaaatcagaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggtagtgggatcccatctctctctgtttgtctcttttgaggactggctactgtgcgggtggaggatggttagggattttgctgacaagccaagggtgcctgtgtaagcagagccttgacagcccccggaagctcttgagggtgaccgtgcaggccacgggtgtgagaggggaagcctggtacttggacaaaacgtccagacattttcaggctgtttttcaagagaagtgagtatcaagaaaggcaagaatggtctcgcgaagctctgtgaggagcatttattgatttcctttcatcccagaagtggtgttggcttgggggttctcccaaggtctgttagcaaagcatttggaacaagaaagcaccaagacacccctaagtgtctgaagtgcacacatgggagagcttccagagggagtttcagagtgagctgaaggagaaaagtatcctaagctcctgagggtgtggataaaaggcccaaactattaaaaaaaactaaattcctaaattccctgctattttatgaacaagaaactctaacaggtgatgcattcagaatttggggttccagtggtggagatggattgccatccatccatgctcctcctgctcttggggtgacaccatagccccacaagatgtggctaagtttggggaataatatgacccatgtgttggctctcagattacttaagattggaacccaggaatctggtctcaacagcccagtggtctcatcaaacagaactaactaactgatcaaccaatatgccttgcaatttgatagccattctctgactatcatatgcctaaagtatttgatttctctaagagaagatctacgtgaatgttttatctgctatatactgcaagctataaaactaaatgaagggccagttcaatagcattcctgtgttgctgggaaagatgtgtaagaacatgacccatgtcatggggctaataatggaaacaggggagtgaagctgggcagctcacggaccaaagacgtgaggccaattaccatttaggattaattgatggcaaaaagaaataatgttgatccaggtgattggataactcattcagctggaggcttgtcaagactgaatctgaattcagaatttctccccagaacatgccaatgtcctttcttttcttggtagaagagaaacacttggaaaaaacaaattgttctttccaagtcttatgttgtgccatgacatagagggattatctgttaagaccacatatgcccccttttccatgagatcctaaggagacatttaatatggttcatggaagcttttagggccatgttagtttgggtgacgaaggggcctggtactccccagtcaatagaggaagtgctgtatgagcttctctttccaatgcaagcttcattccaggttactcaggacttggatatacaaagcaaatgtctggggacactgggccaagcatcctgtcattttgcagactgaaaccacaaaccctgcttatttgataaggcccaggttctgaactaaacatgactgaagtccacgacagggcgcaactagcctaccatgtacgttcatccaaaatggaaaacaagactccctctggtgggcccagcctcacagatgcccagctgaccaggcaaaacacaggctgggtttcagcccctattgatcctcagctgccctggtgcagtgaataacccacgccactgtacatggccacccttgtccgaggagcctgtttcagaaagagctgtaacacacagcagcttctccagggcccccaatacatggcctcaggtcatgtgatttggagcctgtctctgcctaatcctgctcatggggaagcttcctttcacagtggctgtaacatatgaaaaccacagtaggagaaatctggctagtcactgtgggttgcctttgcttcaccttccagctgttcttcagattctttggtgggaagtctcaggcattactgaccagggagaggaggtgccttctctcactgaagactctttcctgttgcttggtgatgtctagcctgccactctctgctatcttcctggttttgcagttgacagaggacaataggagcatgaaggtggccagagctgaaatgctcaccctcccactgcttcttgagacagagtctcactctccgagcctggagtgcagtggcacaatcttggctcactgcaacctctgcctcctaggttcaagcgattctcctgcctcagcctcccgagtagctgggattacaggcacacgccaccacacccggctaatttttgtacttttagtagagatggggtttcaccatattggccaggctgttctcaaactcctgacctcaagtgatccacctgcctcccaaagtgctgggattacaggcatgagccaccacaccccgccctctgctctctcttaagtgtgcttgttgcttcagcttccacagagtctaccacagtggggtggggggcctcaccaaagagggcctggctctgacatagaggaccaggagcatgcgtgggagggagagggggcaagaggaatcggggccaagccacagcagcagctcccttgttgagatagatactggctgaagccatctggtgagagctccaatctggggaggagaagctggagaaagtcctttgctcctctgtccagttccacagaaaaagccgcagagggtgatagcactgaagttaggagaaaatggcagccccgagtgaggctggtgtcagcctccctgggtacctttggaggctcagttgaaaccttacctgccctcttgagagcttcatcagctccagccttgggctccaaagatagatagatagaaaatggggttgctggtgccagagcaagcactggaggccacggaggagaagggagaggaggaccaggcgttcatccacctcctaagagagcatcgaagtttagctttgccaaggtgctccttggaattgcggcaggaagggccggaagctgcagaaggcttggcatgtgatgggtggcatctctgcgacaggctttcctgtcctgcctgcctgccaaggaatgcagcaggcaagtcagatggggagcgggaagctctgggagccagctgccactcagcctccctcgccccctccttccatccccctgttccttcccctgccaaaagccaaggaagagctaatgagagccaagaagtcaacagctcactcatccccctccaggcagctctgcagagagaaactcccagctccaggcccaggtgctgaccggaagtggagggctaaggctctccgcaggggagggggcaggcaggcaatcagggcagtcagccaaccggcagaagcagctcctgcccccaggaaggcggtgttgttttcccctcctcctcaaggtttcatggggaacagccttgcaccctggtggaatgagttcccaaatacctagactcagcagaatccccagagggctttgacctcagttgaaatgatctttctgtgcctctggcaagggccaattggctaaaaatctttccaaagggttagtttttattgcaaacagtccttggactcctttgggaccactgggtcacaaacattagtgccagcctctcccatctcagagcactgagatccagctgcagtgaaaccctggccctggctggagctggagggagacttccatcgaagtgtttgggaaggaaagcagggaaacctgcctctctggagcagcaagtgcatgtcctgggactctgagacacctcagcagccctcctgcagactggctcctgcttccagcctcagcttgctagctatgtgacctcaagcaaatcactagccctctctgagccctggttttctcctctgaaatgacttggactaggtcgtctcgatggtcccttccagctagcggtgttctgcaggtctgtgcttccctctgtcctgagatttctgagttatataactcattccttagaatgggagaggagctgtcttcttgcccagttagttacctgattcagaagtgcctgccagcctgtgaggctgggaaataaactgtggatagacttgagttgggtgtatttacaaagcctggacatgcactggcaggagaactgagtgccccaggctccccacacctacaccacaggccctgctcagttgttcagggttcactcgtccacggtgagtcgccggagggtcagggaggactcacagagaacagggtgagtgccctacacccttcagcttgccagttctgcagtccccacccttccggtctggatgcccagctgtgtgtgtgtgtgtcaggtggggtcagctgggcagaaaggtggaccccagggtcggtgttgccgcatcactgcatgcactgtggggtcccaggggccctatgggtataggaaggaatgaaatgtgagcacttgggaatctcagcacactctgctgctcacctgctaccaggctttctggttccccagggaaccctgggccagcttgttgctgtcctcttttagcgatgggaaataagagtatgagagacagtgttatcctgtttacaatcagtggtgaagtccgtggttaagaccaggttacaactcctctatgcttcgcttcttatcttgactctgtgtgaaattaggaaaagcatatttactgttatagttttgtagctggaaaatgaaaatataaaagtctattttttataaactacaaaatgtaaaacaacagactcagtatggctggtgggtacagagaagacaaagtggctcctcacggggttgacaggagtctcgagacttttatcaaaaaaggccagaagttggttgtcatttttgagacactgggccctagaccctgacgtttccgttggaaggaggagcccccagctgttcccgctgatggttcaacctgtccgccaaaagcagccaaaatgctctccccacggagtgcccacttggagaaaaaccccactggtgactcaccttctggacatgtggggcaatcagggcccggtggaggcagctgctcctggctttccctggtgggccctccctcgacccccgcccaggccctctcctgccttccccagaccccaatgtgccaagcagtcaagtgaaaatcaaatcctctgaggcagaaagacacagctgtgtgtttacagccactgattcagatccaaatcgcgtaccctgccagtctctagcaaggcaggctgggggcaaagtgtgtgtatgccaagcagggatctatttcgggaggtgacctgcaggccttcgccatgacagtgccttcctcccacccactctcaggaaaggtgctctcactttacaagcggctgatggggttgtggggtctcggcatgcttgtcacttgtgcagtcagaccccagtgccatcctcgtgcagccacatgggaactgtgtgggctcccacctgcctagtaagaaggcagagagtgaaggggagtgcagggccccccgcaggataaacagcgggaaggccgaccactcagaagacaggatgcccgcctctgcctaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagtaagacccccccccgacccatggaagtccccccaaaatgagctcctggtggaaacaacaggggatgcttcccccttttaaaatagtgatgagtgtccctggtttgagttgagttaggaaagcatgacattttggaaggaggccaggatacctgtccataggtaggaatagcctgtaagatgttgccctcctgcagtgtggctaaatgggacactgccgggggtgggactcagagcagtgggatttttagttttgtcatgtttgcccaaaggtggatgagagaaagacccttgggtgtttgcttagtggcttcccaatgggtgggaaggtgagacggggttggaagcatggagccaccccagcagtggcagggccacagggcagcggttcttccatgccccctaatcatggccacattgtatcagcctgagcatgagcaacagcaccatggccacatacgggaatgggcctcattggtgtaatatttggcagattctctccacaccccccgtggcggtctggcttactgttaagaagggtaaccttaaaaaatacatttcccactccagaaaatactcatatgtggcctgttagcagcacaagaagggtgaaagcaatgcccattcctgcctccctccccctgctcacctccacgtccctgtttgcccctttgtaggtgaagtgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgcgcgcgtgtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcagctttaggctatataacaaaagtgggaaaggaaaagtgttccattgctttttgttgctctaagcaatattaagtcttggttctaagcccccacattatcaggaactttaacatctagagacaattgagagagaagagctagagagagaaagtgaccctggaagccacgtcggaagaggctggagtaaaaatgtctagccccccagcagacttgatggccaccgtgagctctttgcatttgtcttcaagagtggacacttccgggttgctccagagagcaaggctagaacaaatggctagaagatagataggtagatactaaaaatattctaacaataacagaatattccaacaatagactatgtcccctcaaagggcaacgagctccatgtctagccgtttagaagctgaatggccaaggatagtgcagagtaggtttctacaccagatcccatgatcttttgcaactggaattctatgctgccccaaatacttgttaaatggatccgactgcatttcattctgtggtttataaataagtcctggaaaaggagaatgaattataaggaaggagtttgctgagattggaggagagggatctgaaagactcaggactagactccgccttgagggagaaaaagccacaagatgacacactcaaagcaagggaaaccgtcaggaagtggaattactgcccttcacatgtcatccttgccttcttttctgttttttgtttttttttttggcatttgctgccgcagcagctgagctctgggcaacagggctctctctcccgaatgtctgaaaggaggtcagcaagtggaggacacaggcgcccactggcacagggcattggcaaccatcgtgcagtgagccccagcacagccagggtggccatgtgcgtggggcgtcctggcccaaggttgaagaaaactcatcctgtcatagttcccatccggaaagggtgttttgttgaaagcaaaaaggatcataaagtcatttgccttttacccaatgccagttccagattccaggtaaatgagctaacatcaaaaacacctcagccggctgggcgtggtggctcacatctgtaatccgagcactttgggaggccgagacaggcagatcacctgaggtcaggcgttcaagaccagcctggtcaacgtggtgaaaccccgtctctactaaaaatacaaaaatgagccaggtgtggtggcacatgcctataatcccagctactcgggaggctgaggcaggaggatcactagaacaagggaggcggaggttgcagtgagccaagcttgcaccacctcactccagcctgggcgacagagcaaaactccatccccatcccacaaaaaaccccccagagacctcggactgaggagaaactatgcccccaccctggcttccctcctctagggccctgccagggggacttgtcctcagcccagctcagggaaagggaagggttcccatgtcacattctttccagctgtcctaagaaccaccccgattgccgatgacactccctcctctcttgggcttcaccagggctgctttcaactcatcgtgggattgtgtaattatggtgattacagcttgtgacttttttcctctccatcttttgctttcaaattctttgaggcctctcattaaacatggcgatcccggtaaagtcagcaaagttttaataagacactttttacagctaaagaaagcccagtcagggttgattgctactatgttctctcagatactccattaaaactctatcaggtgcagttggtgcctaggtataagaggtgggggagagggaaggcagggaggcagagggcacctgtacttagtgacagggctggagaaccattccacaccatgcccctggctttttttgtttgcactaagcaccaagtacatctgagcccccgtgcctaacaggaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaatcactagcctttgtgagtcatcacaatccggtggttttacacctgatggaggttttacacctgatggaggtttccttggtagtgattcagcttcacatctcattcttggctaatctttaatcatagcttgcttgcttgctttttgttgttgttttggtttggtttttgggggggtgttttttttgagacagagcctcgctttgttgcctaggctggagtgcagtggcgcaatctcagctcactgcaacctccacctcccaggtttaagcgattctcctgcctcagcctcctgagtagttgggattacaggcctgcaccaccacactcaactaatttttgtactcttagtagagacggagtttcaccatgtcagccaggctggtctcgaactcctggcctcaagtgatctgcacacctcggcctcccaaagtgctggagttacaagtgtgagccaccgtgcccagctcatagctttcttgaatagttatcatagctgtaggacatcatgagaaggaccatcaaggagtgtggcttgtgtgtgtgagccccgtgacccacccttcagcaggttcatccaggttcccctcatttctatattccctggggactacacagatgcccgcacagtgaagtgcatcttgctccagcaggactgtgtttctgagaggtccctgattggctgctcgtggctgaccgtcccataccaaccagactgccttttaccctgcaggtagccagttacctcactacctgtgtctcaaaagagcaaggagctggattgtgactgagcagcaccaaccacctggagttaaatgtcaaaaacgtggcagggacatttcccccaactgcattcccatccactactgaaggtggcctgctcgtgtgaccccttgagaacaacggtccctttagtacccaccagaatgcagagaagtaagctaagttcgagacaggcaaccccagctgaatccctttttctccacctgatattatgtgaccctgggcaagtcacttgcatgtctgacaggtacaacaaagcccactgcacagggtagatgttggcattcaatgaggatgtgatcacaagagctgccatttattgggagctcacactcacagtgttggactgtgtcatgctggctttgcctgggatggactttggttctacttcagctccatcacttagttgtttgaattgcacagcttctctaagcctcagtttcctcatccataaaagggagataagagtaaataagtaggaataaaatgcataacgtccttagcacactgtgtgcagtgcgtgtgcttaacaggtgtagctcttagaatcagtttcatcattatgatattatttgcagctcatacttaggctgcgcttattaccttatttaatttccaacaatattctgcaagataggcatcattatatacatcttgtggttgagggtgggtacgtgggtatctcctatatgacagtctgcacaaggtgcatgtattacagagatcagctcatggtaactactcaataaatggcagctatgattgttggcttatttttaaagtcaactcagagagttagtttttctgcatttcctggaaatgaagggactgtggtgcccagcaggccagcttctgttctatggtcgatttcctggggcccctaagcacttcccgggaagctgtgggaactggggggcttgtcagcctgtaaggtgctgggaggtggggagggccaccaggcaaatggtgcacgtgttgtggggatctggcatttggccgcctactgagttgaaggactcgaaggtgcctcctgctaccagagacagataaggaatgggtctacccaagataagaagatgaaatccactcctccaaatgtagccctccatgtgacagaaacactcacctctcagctgtctgcttgcctggagccaccctgagcaatgcaacctcaacaagtccagttgctccgtcagtccaataaacagaggtttctcttttttaaccacttattccaaagcgaggtagtggaggagtcagaagcacgtggcaggggatgctttgaaattccttgataaaccggacccctggggtgggcactcctactgcctatagtaccgacagaaacagaagtggagaagttgtttatttccaatgaggtcaataaatgcctttttcatgggggagaattccatttttatatatgtattttaaggtgaatgctttaagtttgcagtatttgtcagagtggcatcttaggagctgatagaaaactctacagccaaacaagcgattgcctgtgcaccttgcatgagatgcttctgtaagtgcctgtggtctcaacatgcacatgaacgcatgcactggtgtatgcacatgtgcacaggtgtatacacaggtgcatgtgccgcctgcctgatgttcgcctctgtgttcagtgtatggtgtgcatataaccataagctgcaaacctgcaagtatctctgttgcatggattgcatgccctctgcagctgtgtgtgtgtctgggcaggggctcctctaaagccacaggtcttcacagtttcagctggataagttattcttcacttcccttcctaaaaacacaattgcctagtgctgctggcgcagagtcagaatggccgctgcatttcacccccgaggtggcttccttccagcagtgggtgagtgatcccggcgttcgcacactctctaatctgtggaatccttctgcacagaaggtgttccaaaatccaaaagagatgatctgtttgtccatggcatcgtctctgcccaccactcctgttctcatgccctggttccagggacagtcggcagcacccatttcttggtgtctctgttttttctgcccattttttgtacccatagtttttctctcctaagaaacaaggagctgaggggtccagaaatgatgctgagatgagtcccttgtcccagaggcaatgtgcagataacatccttagatattgacccagtaactctcttctcctagtcccattccctagcagaacagggaatacccactacctttgaagatgcttctaaatccaataacagcatccttaggcttcatttcctggtgaaagcttccataactcttcctctgtgggccctgggccaaatcctgcaggaaacgtagcaatctcacatttctacacactacaccatcaggggagaaaaaagctgggaaaccgcccatcctctgtcccatggggaccaaaagcatctcagcagcacgtgaaaagagcctgtagggaaataaggttctctgtagctaagagttccaatgacctaagtttctgtccaggtatctcctgaaaacgctgcttagtctgttccctggtgtacttcctccggttaggaatccatgtctgataagtgcctgctaaattgcattcctgatagtggggaagaaagaaatgagccggccctctttgcatatgcatccaaatgggcatggacattcactgaattgttatgcttttgtggggggatgagaggtcagcaattctaggctccgccttttcagctggctaaaccaaggaccccaagaaatgtacgtgttttgggtgaacacatttgcaagagataagtgtcctcaggaggatggggtcagagtcctcataggtcctcaggagaatcacatactgccaaccaaataactttctcttgccgctttgtccacaatatcaagtaactaaattccagcttcactgtctcccgtagtcatagtcaagggttacttgaatttcctagttggaaaaaagtagcatcaacttgttgccaatagcaacacagccatgtccctgtttcctagagccttttggtctttgcctaatttggagtgaaccagagcttagatgccagagtccatttgggaaggaggaggagaagaggaacaggcgggcattaagtgggtcacaggaaggcatgccaccgagaggccttacaggcagaatgccaccctcattccactcctgaagccaccaagaatttcctgcaagctgagagaagaaagagcaacagggttgttccgtcagatgagaggagggagagaagagagagctggtgtgaaaagggggcatttccaccacacagggatgcagagtagcagggaaaatggagatgcacaacttggacgcgagaccggggagtctggacctggcattctgccactcatgtagggctcagctgctgagtccttgtctctcccaccatccctacccagctccggatttgtccctgcacagctggggggccatggagaaaggtcccccatcactcagcaaaactgacaggcagaagaaagtgatgagcatggtgaggccagggtcagagatgccaggaacaccagcagggagggcttcctccacctggctgggcaccccgaattaggcacttggcctagaatgatttaaagtggggttggttttcattagagtaaggccaccctgcctgccccaccttagaaagggaaacatcacacctgctcctgtcctccctggggcatttgccatgtgtgttcctagaggcatcagcatcagtaacacagggccacaaacagaacggtgggttcacccagcctgtccagcagctaccacctgaaatctacatgcaccaagccatggtgacctgcaccccagctcaatgcagtaaccaaaagccccttttgccaggcttgtcagccagcagatggcacctcctttctctcaggatttccaaatgggatgaggggaagccgcttcgcagcatagaacctgcctgagataagctcaagcatgctcaagaacttaagttcttttctcagggaagttgagaaaatcaccctgcattgcccagagaggttgcccagtacgggttgggcacaggggactccttcatccctgagtgtttccatctgcctccttccttgagagtgacagccatgtgcaaagtaagaggggcatgggtcgtgaaggccgaccaactcagctttgccactgactagccatgcactcccaggcaagttactcaaactccgtttgagtctgtttccttgttcgtttagtggagtttatagaaatgcctaactggcaagcatgttgtggacataagtaagtgcgggtgcttgtaaaatgcctcgcatgcttgacagacacacaatagttgctcaatggtccatcagcaggtggctgtttgttagtaactgtcctcacagctacctgtgtacctagtgggggaccattcccaccatgccactgtcaaggcctgagtgatttgaagaacaaggcacttgaggagagagggtccatgagctacccgtgccattccatcaaacaggcccatgggagatcaggggataggtgggtccttttacatttaatccagataggagaactggcaactcttcttttgtagattcaaaaactttttaaaatattttaaagcactggtagttgccaattatattagtccattttcacaatgctataaagaaatacctgagactgggtaatttctaatgaaaagaggtttaattgactcacagttccacatggctggggaagcctcaggaaacttacaatcatggtggaaagggaagcagtcttacttggcagcaggcaagagagagcgagtgtgtattaacacttaaaaaaccatcggatctcatgagaactcactccctatcacgagaatagcatgggggaaaccacccccatgatccaatcacctcccactagttcccgctctcaacacatggggattatagggattacaattcgaagtgagatttgggttcagacccagagccaaaccatatcaccaatacaggatagagtaaggtgtctgagcctactagtggtcccagtgacattctgtgggaattgctttcagaagacgtgactgctgggtacctcctccatccccagtgtttaccaggcagagcctgagtgtttacaccacacacagcctgagtctttataccactgtacatgagaaggtaggggtcgggggggcggggtggggggtgctgttgcaagaaaaaaaaatccattacgtttattttgatcaaatttattattttttaaacaggttcagttttaagtattcatgaatgtaccatttattaattctttaatcagtgaacgtctcttttttgattaattcacttttcatctatcccttgacttttttaaaaaaattggggtattgttttatgtttgtgatatagcttcctatttaaaaggggtcaaataaaaaaatattttaaaaccacataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattctaggttaagtgtggattttcccaccatcccctgccagcgtttctccgacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttatcctcagcaagtctcccccaaccccaccccaggcctctaattccacacgtatacatcctttatgaacttgagcaccatctattcaaaggtgaccttcaggctccttgagagcacgactcatctctctctggggcctccacttcttgcctgctaagttgcatggtgagctgtattcaacgaaacacgatttttcatgagcagggatggaaaatgcctgtgtgtcacaccaaagggatccgtttgcatcaatggaggctagaaatagtgttccacattagttctgttgcgagttcgaattccccaacagaggaatccaggttcctcctgtactggagggggaagcattgaatttctccaaacccagggatgggcccagcaactgaagaagggtaaggagtgggaaattccaaggcatagatgtcatagctgggacttttttttgtcctaattttttttttcttttgagatataattatgcacggtaaaatgaacagacctgaagtacatggctcaatgaatttgacaagtgtatgcacccgtgtaacgtataccccatcaccctagaaggctccttcatgtccctttccaatcaatttcatccttctcccccaggggcaaccgtggttgatttctttcccccataatagcctggattttgatttggcagacttgagatctgtaacttcggtcttagttcatctgagcagatcagcaaaagaatctcatcagaagctcagatgtctttactctcttagcattgaaaaagatcctccctgagccgctagtgcttggctctgctgtcccccagtatgccccaatctgacccccagggctactctctgagccacagccctcctcccagccaaagaaagagtttagcatcagtctcccaggtaagtaagtggcaaaagctcttggtaacccagatagtgcatgctttgttgattaatatgtggaagtgcaatgcacagagccacagcatgtcaagcagcatgttgatttttctcactgcacaaaagggggctattccttttgtgtgtttcctttcagaaaacaaaggattccatgaccaccttcttccaggctcctagccatcaagatggccacagagctgaaatgattaatcagagcggagggtgggaattgaatgtgtgggtgttagtgaacccagcactgagcccatggtccatgaaattgaaggatcccaaattctactggattacactttgccaaatgtctcaaaggtgaaaagcactttgtcggtatgcaaagctttggtgtctctggaatgtaccttctgcagctcagttcttaatcactgtatattttttcacttggacaaaggctgcctgctaatagcattttcaaccatcctcagctgcttcgctcagctacgccaaggcctcgggctgagctggctgcggtttcctggcaccatgatccattcccaactgaccaacactgaggaacattacacactcacaccctgaaaaaaacctgcttcctctgtaactatgcaaatgccagacacaggcaggcagaattaccattccccttctgaagtggttccttcaggatcatccaaactggagacagagatgagagtaaagagacggggcagtgccctggagggtacaggcaggagctcccctctctctgggcacagcggattcctcgggagcttcctgcaagcctataggggcatgcactttggggcagctcatctctgaacacaggtagcctctactatcagatttcactttgatcactgaaaactacaggagtctcagctcttcagaagggaagcagctgctgagcaagtgtgattgcagtatttcttccccaaagccccgggccaggcatctacccatgcccgcatcctgcatgattaaccgccttccagtctgagcctgccctcactcacgcgggaggtcactgggtagcgagtagattgcagctgggctgagctgcctctcaagccgacctgaaccctcatgacctccatctttagcagcaagctggcatttggtaaatgcgcgaaagcaggagtggggagagggagacaaaaatgccaagcagcaccgcctgggttgctgagaggttgggaacaatcccaagggtggcccctaagctggtcagctgcaccatcctaccctgaaatcctgggaaataaaagcagtcgggggaagcgaggagcgggcagtgacaggctggccacaggtccttggagtcagagcggtgaggctgagctccaggatttagtcaggaagagaataattagcaccttcaagcccagcccagcccagcccattctgtagaaaggggaagggttgagggtatggaagcctcagggccaaattcacctaaaacaaatagacacataatcctccagaaatagaatctccaacctccctcaacccacagtcccctctccagccaaaataaccttgttaataggaatgaggctgcagtgaaggtttgggcaactggtaaacctcacctcctttgtctctgggctttgaatgtactcattggcaacagactcttattcagaagcttgagtgattttttttttcccatccaccagctaaatgagagccccaaacgctgtggatagcaaactcagaacatatatatttgggtacataatgtgtgatttgtggccctggcgaaggagggatgggaggaggaggaggacctgatattggtgtgtggtggttatcacagcaataagtggcacctaaaaggagagcaaacttcctttgtgcctttcataggacagggatggacataggtaaccgggggtaggggaggtttgtaagagctctcacacaaggaggcccctaggctcagcagccccgtgtttccccagcaaggatgccccacacccccatgtttcctgccttcaggcctgccccaggaaggcacattcccgagtgacaaatgcctcacactctatgtaagaaagggcactcaaggagagtcaccgctgggtgtgtgccacagaacccggggctggggggagcccttgaaggtcagcctctgccttctaagagctattgttgtacctaacctggtctagacaaaggagtagtcattcttagtgattttcaaagactgacaccataaccctcttggattttttaaaaatctgattaaaaactccttagccaagtataaatgtatcctgctgcaggctaagtttagtgcacttgaagattcagataaggttgctgatggggtgattttgtggacgtgtgtgtgtgtgtgtgtgtgtgtgtgtgtgtgtgtgtgtgtttaagatggggagaaaaaatgaaaagttttgtctcactagtgaaaatggggagtgaaagcaatggggaggaaaaaggtcaaggagaggtagggaaaggcagactttctgacagctcctgagggcaatttcatttttggacaaactcccatctatagcaccagaattctcaaagtcaggctggccatgcctctccatggagatctaagccagatgccacattgtcctgtatccagcaaatccacagcccgtgttgtttattagataaacccgttatccatcaattcatcaatcagcaggtttattgaggaccctaccaggcttcacaaacctgatcaattttttaaattacatctagcttacacgcagccaagcccagtaaacaagacgagccctcacaccccacttggaaatgaacatgaggaatcgctggcccttgcaatctcacggccaaacactgcagccccatgctgacgagctatcacgtgctgcccttcacagatggcggtggtgtcgctgacccactgtcaataatatgggtttggagtgctttcccagacacagtgatcaatctgcctgggtctagccatactgtcctctaaagccctgtgcaatgatgcggatttctaaagagggtgagctggagaacgggcacacactatgtaagggcaataagcaaagcgacggagcctcgctcgtgcccctcaccctcctcctggtgcccagtcgcaactcccctcctagatcaggggcttctccgccatctctccagggcacatacacaacgggactctcctggcacctctatggctgatgcaccaggcctcatgatccagttcactgttttagtttttgagaagaactgccacatgggttatagttgaagggcttgtaggctttcctggtatggggtcatcaaactctgcctctgggtgccacagatgggaagccaagaacataggagacagcaggagtgcactgccctggggcctacagtggctctgagccccagcaaatgccccccactttcatggtcccagaactggtcatcaagaggactcaaggtctttgtgtctaccctgcattccaaacaggactctgccttcttaagactagttcattcattagcttctgatcagccagatccttggccaccctctatttgagtcaagcccccgtccctgatctcagaacaccccaagtccaccttttcctcccccacgtgaacaaaatcaatttcagggcagcccgccggcattaaaaattgctctacctaaaggtttaaatacctggtttttggtaagtaaaattcccataccacaaaaagagtaccaacaacacaccctcataaggggaccctccaggactccctgaaccttccctggagccctggtttctccagctgtccaaagttaaggctcccatacacctagagatcaaatatcaagatggtcagttgggttggttggtcgtttggcctacatggctcatgcaacaattaattcacctgtctggctctctgtctctgtccctctgtgtgtgcgcctgtgcgtgcctctctgtcgctgtctctctgcagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcca

SEQ ID NO: 752 - DNA, 633454 bp, Homo sapiens; identical to SEQ ID NO: 750

SEQ ID NO: 753 - DNA, 629678 bp, Homo sapiens; identical to SEQ ID NO: 748

SEQ ID NO: 754 - DNA, 633454 bp, Homo sapiens; identical to SEQ ID NO: 750
